United States Patent 7,868,149 (PLANT GENOME SEQUENCE AND USES THEREOF) - sequence listing, part 49

SEQ ID NO: 26094 - DNA, 5060 bp, Oryza sativa
cctgtcatccttttcacttcggtcgtttcaccctgcttgagctctattgccgctagaagcgtcgctgccaaccacactgccccgctcgaccttcaccgttgtcccgtgttgccaccagaagcgtagcagcgctccaccgttgaaggaagagtggagagcagaggatggaggtagaagacaaggggctatttggtccaagaaaaatagaaaatgcagccaagggatgtacaggatatatcttcaacttcaataggcttcattctaatttaacaaatattaatgatatattttaaaaaagtaaaatttataatggcatggattgaattaacccaaaaatcactttactaattagactaaattgatttccttttattaacttatagaggtagaatttgatcttacatatttgtaaagtgatatatatcgtgtgttaatatatattgttgaaaaaattgtataaccctttgaatgatataaacaatggaacatctcctcgaagggaaaaaaaatcaatctccgagccctaccaagaaacatttcaagttgacaaacacaaaatgcgtgcaagttttgaaccgtaaattaattggtatcggtatacttaaatataggataccacacgtatatttattatatctatatatacaagactcaaccaagactgattgagatttccaagattctctctacaagtttctgacaaataagaaatgcatcgaagcatcaaggagtgaacaattttcctgaactgttcatgaaaccatgcatctctgatgaagattgtgaaacatctttgatggccttctactcttctagcatccgtgcagagcaggtttcagagcttggacagtgcagagtccatcacggcgacgaagaaatctgcaccaaacagaaaaaaaaaaaacaaaaccaatgattgtgttagtataaccggtgagctggtacctggtatacgacagtgatagaatatgaacttgatcgaaatatttgatcttgatggagtgtaacggcctaccggcatcctccttggtgaagcacagagggggagtgatcctgaagacgttcccgtagaagccgcctttgccgaccaagacgcccatctctgcatgtacgcgtgcaaaatccatggcgatcaatctcatcaagccacaactcgatcagaaaccacaagaaaatgtgtccatgaaaagcttacctttcatgtgctccatggcgcggcaaatctcgtctttcgccggcgtcttgagctgcctgtccgtcaccagctcgacgccgagcatgaaacccgtccccctcacgtcgccgataactgcattcatccatgggagacggcaagaatgaatcaaccacaagcagccatgctgtcgtggccatggcggccggcaactacttactttcgtgcttgtcctggagagcgcggaggcggtccttgaggtaggagccgacggcgtgggcgttcgcctggaggccctccttctcgagcacccggagcacggcgagcccgccggcggtgcacagcgggttgccaccgaacgtgttgaagtagcaccgccttgtcagcacctgcgcgatctccggcgtcgtcaccaccgcgcccagcgggatgccgttgccgatgccctgcacgccatgcaccgtcaggcttgatgttcgatcgagtcatcatgcatggtggcgagcgaagcggaacggattataccttggccatggtgactatgtcggggacgacgccgtgggtctcgaacccccagaagtggctgccgacgcgcgcgaagccggcctggacctcgtcggcgatgcacagcccgccggcgctccggaccgcctcgtacgccagcggcaggtaccccggcgacagctccacgatcccaccgacgccctgtatcgcctccgatatgaagccggcgacctgcccggtggtgccgaactcgatgatctcctgcacgtcgcgcgcgtacttttcggcgtcggagccgaacgcgcccctgtacgggtccgggttcacggcgtggtgcacgccgctcttcaagcacacggacgaacaggtgatcagaatcgagagtgttttcatcgatcggtgatggcattttgtatgtactgacctggacgacgctgaacttccagttcttctgcgcggtggcgcccatggtgccagcggcgttgccgtggtaggagttccggagcgatatgatgtcgtgggagccggtgtacagccgcgccatcatgatggcgagctcgttcgcctccgtgccggagttggtgaagaacacaacctacacgcaacgctcgcgcgcgcgcgcgccatcgatccggtcagagcaagcgtcacaagaatcggcaactggcaaatgccggccgcgacagtataccttgaggtcgccgggcatcttggaggcgagcgcctcggcgaagtcggcgatggcgtggttgaggtagagcacggtggagtgctgcaggcggccggcctgcgcggcgatcgcgccgacgacgtccgggtggcagtggccgcagcacacggtggcgatgccggcgaacgcgtccaggtagcgccgcccgcgctcgtcgaacaggtactgcatcttaccctccacgatgttcagctgcacgaaacaaaaacaaaaaaaaccacggcgatttatcgttaatgaacacactgcagcgagccccatcgtaactgaatcccacaaattacggaatagtttgattgccaagaatactataccaaaattcagggaaatttcaaaagagcacgaaaaattaatttcagcaacaaattagaaatgcacatactggtttggaataaaagtggaagagggacgggctgaggaactcggcgcgcttccgtgcgatctcggcggcggacgggccgtcgtaggggagcgggacgtggttgaagtccgccattctcggcggcgcgacggcggccgtctccaccgccgctgcgagcctcgacaaccctctcctcgcaatcctacccccctgcatcatcataaccacaacccaacctaacaattcaagaaaaccacaatccgttcctcctcctctatctcacgcctaatcgctgatcagtcgatcgaacgatctcctcgacgacgacgccggaggaagaggagaaattaacaggtcaggtactcaggtgtgtgggtgtgtgggtgtgatcagggacgcaggtgtgtgggtttatatgtaaggcgaggggtgcatgcaaccggcaaagagatttcgccggccggtgattgacactatcaacggagaattcgaacgttgcgacgagtgtatcatatcccgctcaaatcccgtaaatttttgcatcatctacgtacagggtgtgtgggaataaatcataattaggcaggcagcagcacacacagcgctgctctcccatgaatctggacctgcttcctttcatgggttacctttgcgattagttagtgtttggggttgagggcctaagtttaacctgtgaaccgggtgagaccatcacaggttcattgaacctagacgtgctatggcaagtaaaggggtaaatggaaagaaaaggtacaccagactagcccaatatacctaacccggcccccacacattggcaagtaaatgggtgagtgcctttttttttaaaaaaaaaagatggattaaaactaaaatatgtggtggaaatagaaacctgaaaattaccattggatcgaaaattaaaaatctgagattcgttcacgtcacttcagtaaaatttttactcatgagtgaactgggagtaaaatttttacttatggtgacgcggacgaatttcggacgtccatttttgatcaaacggtagtttctaagttttcactttatatacatatatatgttttacactacatattttccctcatatccaaacccagatgtacacatcctgggtgatgcaaccgtgaggtttggttgataactcggactgttttgataagtgttgtgaacagtgtataagtattgttagcttgttcagttgtcccatatcgatatttcattgatgagatagtacaacacttaagggtctagccagaccaattacccaaaaagcgtcgtaaggttatacttttacggtcctttataattaaacacttaaaaaaagcatatacctcgtagtgcttatgaatttttttttgatttttgtgttgaaaatttctattatttttttcatatatgaaaatgttgttgaattccgatcaggaccgagaccgaatttgtcggtcctagcatttttgcgttgaaattcggtcttcacttttcaaagaccgaaccgaagactgataccaaattttttggtcagactgaatgcccacccctatgtccacaaaagacttgtattcaacagtaacaacttgtacgtactctaatataagaagggatatttttttctatatttgcacataatagatcttttcacttggatgtattatttgattatttaaaacaagttaactagacagctcatgagagtagacttgtatattggttgagtccttttgttcttacttcctccgtcacaaaataaatatagttttgtactattcatctccaacgtttaaccgttcgttttatttgaaaaaaaaatatgattactatttttattgctattagatgataaaatatgaatagtactttatgtgtgactaattttttaaaaaaaattataaaattttcaaataagacggacagtcaaacgttgaacacgaatttttataactgtatttattttgggacggaggtagtacttcttagcgtgtagttgtgtacatgcactcttgttaaggacaaggacgaggacgcgctctgttgtctagtaatgaaacaatctcaaaggcaagtaacaactccttaaacaacttgatggatatcaatcaagccaatatggtatatatgatggtgattagggaacaaacaatatgatattgatataatgaaactgttctgtgagatgtaatgaaaaatgataacatatcataggaaaatgtcttggtctaatcagatgtaatgaatttgttatgtgacaatgatattgatattgatgttctataaat

SEQ ID NO: 26095 - DNA, 791 bp, Oryza sativa
agtaggttttcaaccctattttatttttttggttgctatgatggtttgcattgaacatacacttaaactttataggggctgatcggaaacactagctgctgcagcgctgcggctgtggtcgtgtttagctgttgcggcttgcagccgtttttcagctgtcgcagcagcaagcagtatcgaacacacctataaaaagtaatgtttcgctgtaattctctttatctctaatatttcgtatgcagggacggatccatgaaatgaacagagaggggctcctcctcttcttcctcctcctcctcttcttcctcctcccatctcccattctctcaattgtgatccagtgggttaggaaaaacttgagtcccccagcaccctcactggatacatcgctttttatatattacatgagtgtaccaactcttgtttgtatattatattagtgtaccaactcttgttatgaattatgacgacagattgcatgccattggctcatgagtagagcattattggttcagtagcagcagtttgtgcacccgtaacatctagttggatccaaatggagccacacttagccggttagcccacacatcttattgcagaatgcagagttgttgattagatctttttttaaaaaaaagcttttgataccagatgaggtgtgataaggaaacaaaccaacctgatgcttgctcggacatcactaagacaccaacccttatctagctaactcgtctgccatttgcatcatcgtatatatatgagtgagcatcactgaatcttaacatgaaaat

SEQ ID NO: 26096 - DNA, 369 bp, Oryza sativa
atctttgtagaaattcttttgaaatataatttagagggggaaggcagacaggtgcctttagtttcagacctttgttcacacttctgccaagattgttgtgttcctttagtggatcaattatgttcagatattttgaacggaactcagtattgcatgcattagaatctgttttttgcaccgagttattgaggaactctttgtcaaacagcaaatcactgccaggtgtatttgttgcttcgactgcaagacatacaaagttttagggtaaaaacagaatatatgtattagttggttacagtcaaggataagattacagtgtagcgcaccaatttgatttggcaaataccattatgcaacagggccatttaa

SEQ ID NO: 26097 - DNA, 1066 bp, Oryza sativa
tcagggacgttcggtgtactttttcctttttagaaaggattgggagtttagaggatgaggctattaactactttgtttggttgggatgcataggaattttggtaggatggggatgagtaattgaggaaggaactccctccttttcaatatctgggtagggggtgataattgggagggaatttctcctttactttgcctaaacaaatctcagccatccgtttattaatggcttaatctctaactaaactccctatcaatttccaccacctctactaaacaggatattgggattaaaattcaaattcccatcttagtctcaccatcaattccctcgtgtaaactcccaatccccttccctcgagttgccaaacaagctgtatgggcttttccgcgtggatatagtagagaaataagttcaccagaggtctcttaacttaacagcgagatttttagaggtccctaaaccacaaaaccaaatatgtgtacccctaaactcacacaaactgttcaaaagaggtcccatggcagtatatgtgggtggttaaactgacgtggcatcctagttagcaaatttttttaaagtatgtgggacccacatgtcagttaacatcgttttttcttttcttttcttctccttctcttctctttctcttcttcttcactaagtgagcacgatgggcgggcggcgggcgagcgcggctgccgagtggcggcgggcatcggcaggcgagcgtggcctgcgggcgagcgggcgagcacgacggcgggcgagcagaggagcgcgacggctggtcagcgcggcagccgagcagcggcgggcggcggcaggcaagcgcggctggcgggcaaagcggcgatgggcgggcggcgggcgagggcagcagcgggtagagcggatgagcacgacggcgggcaagcggacgagcacgacagcaggcgagcgaacgagccgacggtgggtagaacggatggcgccccatgccccatggcgtggtggtggagatatcggccgatccggagtccaggaacacggagagcgtgtaggactcgtcgatggcggggccga

SEQ ID NO: 26098 - DNA, 1282 bp, Oryza sativa
ctaatgattatgcataagatataaataaaagaggtgattatataccctacaaactgaatcgcgaccaccagtcagcaagatatcgattgttggatgtagagcaaggcagtacacccgagtcaaatggccatgataagacctaataaccttaaaaatgaaaagaaacaaaatgttacgataatgccaatatgccctgtatactgcaatctacatcgaactataagctaaccttgttttgttcaagatcccaacactttacttgtttgtcatcaccagcagaaaataaatatgtgtgccgttggctcacagcaagccctacaatgcacattgaatttatcagtaaatgaacttataacttatagagtaaaacaagtagcagtggaaggctgctatacagatcctaataaccaatgccaagaaaaacgtaccacgaatttgttcaatatggccagtcaatgtaagcttcaatgttcctgatgcaaggtcccagatctacaacaagacagaatcacatgatgaatgagctaacagcatttagaaattatagtagtgttgcttgttggggaagtcggtttgttgacttaatgtactagtaaatgtgaggagggaaagagagaaaagagatagcctcgtttttctatcagaaccataagatcatccaaaagaaacagctagtaaaaacttaatggccaaataaaccctgataataggacttcacgaacaactaataagcactcagtatttttctgaatcctcaggggtcatccacagagtaacagaacatatacactgttaggagtaacaagattgctagacttgaagaaattgcaacaaacaaacagaaaaattttaatagaattaaaaaaaaaacagacatctgttgtcgagctcaaaactagcccttaaacgaataaaagtgctatatacgagatgaaataaagttgtggtatgctgataccctatgatcagtgcccatactggatatgtatatcaacagaaattagtgtaaagaagaaaggggagtttgtattcatataaagagtgcaagtctcagaaaacaacactttgttgtgtcaaatggccctagcctcacttgccattatcataccacgtggtcttttgttgaagaaaatttgtaagggatgtatagcaatccagcaaaaaattaaatctatgaagatttcagatgtatgccacaaaacgttcacaaacagcttagaataataaaaagcaacataaacaaactaaatctatactcctctaaaagaccccaatggtggtg

SEQ ID NO: 26099 - DNA, 3046 bp, Oryza sativa
gaataattttattttaatttttgaggctttaaagtgtatggcggggttctcttttttaattcctgtcgcaaagcacgggcattcagctagtaacatgtaaaaatcccagagcatattggaacactactgcagaagaagagagcaagctcaccttaatcgtcctgtcggcagaacccgtacagaaccattcgttacttggatcaaatgcaattgaccgcacccatcccaagtgaccactgatcacctgcacacattttgagaaaccattagtgcaaatcataggcaaaactagaaaatccagcactaatgaggaaaaagttaccctataattcttccaaggagcatgccagacaggccgtggccatctacttggtatcctttccatcagtgcagatgtagagaatctgaaatgagatataagccatcagaaattcatatttcagttaaactagaaaattttcaacctgttctatcataaaggatggaatatatacgcttgctagtgtttctagcatgagaggagtttggttttccacctcactgccacatctaacaggagctagagtctaaattcttgcaatgcgtacccacactggtgatcctgttagaccccatcatcgacttaaagcaattaataatctattgagtggcttagcctctctccctccagtttactagttccaggttagggaggctaaatttcttagcctctcttcttggcatcaaaacacacatgccattaggagcctaagaagcacctatacacaatgatggtattgcaactcagtggaacaacattttctttaacaactactacttcaagttatcaaggctgcccacattctaaagacgaaaaaggttagctgatacccattcctgagcaccaagacccacccatatcctaattcacctaagcactagagccactcaaaggtggtgttcataaagggctaaggggaaacgccatgagctagttcaaagtttcaattgaaggcatttctgtttttggattagccacattggggcaacatcaagtgtttgagctgcatatcaacgattaaagcaaagataagtgaacaaacctgtcagatgaaccaggaattgttatagttgtattcttgcctggtatcgttgaatccctaaaaaatcaaaaaaaggaagttctcagtgcctacaattaaaaaaagagtaaacaagttacaggcaagcgaactatgaatggacttacggtgctttggggagcatatgtggtgcaggaacaatagcagtactgctgcctttgttatcagcatctttgacatcttgtgttcctgaaaagatatttgtgagctcaatgtaaaagtaaaatcagttttaaacggaagcttgctatgcttgtgtcaggtgtctcgatttttgcagcacaaacaatctacatcaatgtgcatttgcgtaatactgtaattgttcaagaataccatgagattttacctacggaaaacaaaagatgcaattatacaaaataaaagggcaccatattttacctggaagcgccaatgcagttgaaggtgccgcatcactcttgacctgtcctcggccctgatctgttggtaggttcttcaccgcgctgtactctgcattcacctgaaagatccgacaacgccatcaattattttcggggcttcatcaaccaagcaaataaaggacggaatcttaacaagtagagaacagagacgtgcgaacagaccttgcagccgacacgaacctgcttactgccgtccgccacaacaaccaaaccaaaggggggaaacagtttagcaaacagcgccgttagggttctagggtgaacgatgggggcagagaggggagcgcgcaggatttacctctccggatcgggagtgaagaggagggagtgggtgggcgcgaagaggtcgtgcgagcgcttgagcgacttgaggctcagcttcttcagcgactgcggctccaccggctccgccgtcgccatgacgacttcctgctgctgtggagggagtgagaagaaaaaaaaccagcagtcaggcagccatcgccatgaattccgatgaacaaaacgcacgcacacacgacagatttcagctaaagctcgacctagatggtactagatgcttagggtttgtcgcctctcaccgatgaacgccgccggagatacggcttcccctgctcttacgccgcgtgagccctgcagatccaagcccgcctacctcctccccgtcgggccccgcccgtcgccgccggccgccctgctccggtggtgtcgctgctcgccgaggcggaagagagagggggaagcagccgctgtgacggcgcttcgcgaaccgcgagtaagcaaagagattaggagaggcggcgcgttcaagtgggccgcccgcggagcacccggcccatcagtgagacgggcacgagttgggccttctgaatcgtctactataggaacaagttcaccggaagtccctcaacttaacagcgagatttttttgagatccctaaaccacaaaaccagaaatgtgtacccctaaactctcacaaacagttcaaaggaggtcccatggcagtatatgtggacggattcgctaacgtgacatcctaatcagcaaaaaaaaaaaaaaaagtacatggggcccacaagtcagttgcacatcgtttttttcttttcttttcttctcctcctcttctctctcttcttcacagagtgagcgcgatgggagggcgggggcgagcgcgacggttggtccgcgcagtagccgagcggcggtaggtgagcgcagctgtgggcggaacgacggcgggcggagcggcgtcgggatgcgggcagagcagcgatgggcgatggtgggcgagcggaaggcaagcgcgacgggctgcgagcagagcggacggcgggcgagcggacgagcacggggggcggaggaggggggcgcaacggcggaggtggccgaagcaggaacgtggcggcagtgggcgagctccgcgcggcttactctgccagtcgcgtcggcggcggcggcgagagtggcgcgcagagcggaca

SEQ ID NO: 26100 - DNA, 9046 bp, Oryza sativa
catgggacccacgcggggcccacatgtcatcgtggccacgtcagctcctctctctcccctcttctctatcactcttcttctcctctatggcttgggcaggccgaccgacgggtcacggcgtcacgccacgcacgagacgctggcgtcacgcgagacgggcgggtgcgctacgaggagggaggggacgaggcccacgaggcgccaacgggagaatgcgctgcgggcggcgggggaggcgaagagtgcgggtggcagggggaagcgcagtgcgcgggcggcggggggaggagcggcgcgcgggcggcgaaggagcgactgccgacggcggaggagcagcgcgccgggcggcggcagacgacgcccgagtcagggttcgtcgacccgcgccgccgccgccgccgtggccgcggacgacgtcgacgtcgacctcagcatcctcggcggcggaatgaactacatcagctagctcaccggctggcgtccggcatccatggccgtgacggcacagccgcccacgcgtgccgagggcgacgtcgtccgcagtcacggcgacggcagcccgggtcgatgaaccccgcctcggcgtcgtccgcgttgctgtaccgacgctggactacgagcaaagaatagcgctgcggtggagcagcctgtaccggcgcatcgtggtggggcacggtggccggccagtgaggcgcacactgaggacctgggatgagggcgagcgttgcctcggcaagtaggagctcgcccgccgccgctcaatctgacaatggataatcagagaaacaatcaacaattaggactgatatgtagacgtgaattgaaattgccaacttgtagtgattcctggtacgtcacaagcaaagcatgtgcaggatggccggagtggcaggagacgctgcagccggcgccggggatgccatcgctgcacgcctgcacatgtcgcttttgtcgtggaacaactctggcgcggcggaacggtagcacatcatcttcgatctcgccctggttcgagtcaattcatcactagagagagccagaggagcacgagcccctagccccgccgcggatggtgcttgcggaggcggcgttgtggtcgtggctggcggcggaaccacgggagctgagggtggagctgggccggctctgctcccgcgtcgtcgcgcgcagagtggagctcgacagcgcgggtgatgccgtgctggtccttcctggccgttgtcgaccgcgtggccgtcgccgaggtcgagcttgtcgcctcgccacggtctgctcccgggctcgacgcttcgcctcccctgccgcccgcagctcctccccctgccggcccctcgtgggcctcgtctcctccctcctcgtcgcgcacccgcccgtctcacgcgacgctagcgtcgccgtcgtgcgtggcgtgacccgtcagctggtctgcccaaatcacagagcgaagaagaagagtgatagagatgaggaaggagagaagaggttagagagagaggagctgacgtggccaagctgacatgtggggcctacgtgggtcccatgctgactcagccgccacgtcggacaaaactggggtcaaaaccaccgaaggacctaaagtaaatggttttgttagttcaaggacgtccggtatctggttttgcggttgggggacgattttataactcgatgacaagttgagggaccttcggtgtactttttccttctaaaaactacctccaaccaaacgggccgatatagtttcagcccattacagtgcttgggccgacgaggctgtaattggagtatttccatttcctctctcttcgcggagacttatcgtctctcttccattctgcttgaactaccgcccgcgccgccgatggccgccgccgccgcggcgacgtggcgcctctggaggccctactcctccgctctcctctctcgccgggtgaacccgaggttcctccgtactacgccgtgcgtctcctaccccggcggcgccgcggcttctgcggcgccaccctcgcctccgcttgccaccacctgctccgacgattggggcggcgggatgaggtgggagtccgcgcggaagaagagggtcgtgctccgcgtaggctacgtcggcacggagtaccgaggtttggtttgtacggccggatgagatgtttttactgctccgattctttggagttggctgtgcttattcagtgtgctatggcctccttttgtccttgtaggtcttcagaagcagcgggagctcagcgcggactcgagtaagctctgatttgtatgatgttgatgctaggtgctgctgcttcgttcaggtgttgagaagttgagttgcaatgttgcgatcaataaatagaaataaaaacagttgcattgcaaaagtctgtgtggtagaactagaatattggtatttagtttcatcctagctgcatcgaattgttaatcacttgttctatgcatagacgtatagtgccttgattgttctatgtatagacatataatgcttgctttgggcgtgtcctttgccatcaactaaaggacaatctaggtcgaagtattctaccgttaacactttttatgaaagatccagattgatattttcatatgttattatgacaagttgattgtgagcattaacactatataagacatgcatggagcatctcatctatgagatcggtggtgtaagcattgcatctctgtaaatgttgaatgggttttctgatctctttccgcagcaattgagtcagtcttggaaacagccatcttcaaggctgggggcattcttgagagtaattatgggaagctgcaaaaagttggctgggaaaggagtagtagaactgataaaggggtaggattttacattttgacctatagagttgcacaaatgattctaatgtgttctttctgcttctttttgtctaacaaatgcttgtatgcatgcttagaacgaactaatttcaggtacattcactggccacaatgatctctctgaaaatggaaatccctgatcgagcatgggagaatgatcctgatggcattgctctttcaaacttcattaactcaaatttgccagacaatgttagagttttcagtgttttgcctgctcaaaggttagagactgaaaatcattgatatggagtgattgattgagttatgcatggaaaaacaacttttttattcatggtaccacatgcattcaatctcaggagtttcgatgtgaggagggaatgcttgtatcgggaatacttgtatcttcttcctgctgaaataattggaattaaaggtggttgtagctctgaagaagtaatggaacacctgtcagaattcaatagcattctgaaaggttttgaggtatgtgtatgatcaagtatatcgcctgcattctgtgcttagactgtgcaaaagaacatgacatatgatctctttgataaattgtttgatagcagatgtgtttatggagacacccagatactgccacatagttaaataagaataaaacatgagtttgtatgaccagtaaatacaccagaggttataaatatatcctgtcaatccattgtggaccttgactttgaattttactcttgcgtgttcctggatttgcttagatccagctgcaattcgtgagatggaaaaaatgaagtggaaaaacttatttggcacattttagcatgcttggaatccaagagggaaggtcaagcaggcccagtagcatcactgtgtcctaccttgtcgatttccaattatttgatgatggatgtacttcagtgaagagtttaacaagttcatctaaatactagactaaatttaagtttaggaaccatgtaggggtggtataactaaatagatgaaggactcctggttcattacactcttgcataacagttgctggagtattggacccaatgtgaattgtgaatttgcaaaaaggccagcccagtttgatcctggtaataatttcaccttttgacatctgggctttttccccaagaaacatctgattggtacatagcccaggtgagttgttttgctgaaccatctgaattgtttgttatgcatttcctttttactcaatacagtaattatagacattgtcagagtatttttatctctcattttacagtttattctgcatgtgcacagtttcattaaattggttatacatgtagggaaaccatccatttcataattacactgctcgtgccaagtataggaaagttctagcaggaaggcatcgtaaggtaaaaggggcaagctcagctgtaaattccatgcccactgaaatgagtttggaccaaagctcctctgatgacggaactacttcagaccatgatgaagaagacttgaactcttcgtcgataattggttctagtgtaccagaagacagttataaggataatcccgaattttctgagaagcaggttcagattcgagctaggtggcttcatgagcctgatgaaaatgatcgactgaatgcttcacatttcagagatatcctcacattctcctgtggagagctccagatttcatcaggaattcaatttgtggaattgactatatcaggagtatctttcatgctgcatcaggtatgcacaagaagtgaccccactcatcaatgaaaactaaaattctgcaatattactatgctatgttcgaaactctttgtaggctaattaatagtgatgttctttgttgtcaagggaattgcacacttgataccaaaaataccactctcaagtctcaacaaactagtagtttaagctgtttgactgcttctaaaatccaaactgtagtgttttgttttcactgttaaatgtttaattccttctgaaactatgcataatcagcaaaacgtttggtttgggttcatggtgatctattcactggttatatgccttagtatgaactgcagaacgaatatttgctgtaacagtattaagtattatgcatgcatggaactagtatgaatatgccgtgatgttttttttttttttgacctcagatccggaagatggttggtacttcggtggcggttaagcgtggattactacccaaagatattatagcactgtctcttgcaaagttttctcgcattgtgttaccaattgccccttctgaagttttggtgcttagagataacagtttctgcctgaggaacaagcaagggactatagttcgccctgggatccaatcaatgaatgaatctgaagaagtcaagaagggggtaatggaattctacagggcagctcttgttccagagctagcaaacttcctggatgcatccatgcctccatggaaagaatgggtggagaacttggaccgattcacgagcataccagatccacagctggaggaagttaggagcgcttatagggtgtggaaagcggactacgaccgagtaaaaatggccagaaagagtgccagcagcgactaatttgttgccaagcccatcgcacagtgaatgatgggctaaataaaattcttagctgaagagaaccccatgattctatctcggatatttcttcatacaggagcaggagcagcctgactgtcgggcagagccttgttttgatcatggccagtgagccattgagactgagctattggttgatcggactactacaaccttcagatttggttcaattgaatgtttttgcttaccgttttgcctaagccaatgttatgttgtatcccggccactgcaaaatctttgcagagcaatactctgatcagttgttaaaggaaaaccgaaggtagaaacatcgttaattatctgacgatattcaggcactgcaaaatccgcaagcatcataatcatctggtgatctcgtaggggcatggatgatatgttcctggcatggacgcgcgtctcgtcagtcacgcgctcacgcgtcaaggcagcgtgacctctggagagcttcagtgccctaattgtcgccttccgagcagcagcagcagccaaatcccgtcgtccgagctggaaaagatgatggaagctagtatatcagctgctattactacgctacgctccacaattatacacatcatctgggcgccagagctaggacccccccagcccccaggctcgtccgtgcccccggcccgacgacgacgaccgactgcctcgcgccgcgcgcgcggcagcagcagctctcgtgagccgcatcggcgacgtaacgtgtgcgtacgttttccctggccatcctggccccccctccccctcgcagctggagcaccacgacgacgacgacgcggcttgtcgcttcgcccgggcacggctgtttgtgcgacgacaacgacaaagccacgccgtgtacgcgcgcgcgctgatcgatcggtggtctctctgccttcgctcggagcgcgggcgactgttacgcccatgaagaaactgcgaccgccggcaaggacgacgcgctctcgtctcgctcgctcgctcgcgcgcgcgcgcgggtgggggtgggggtgtctcgtcgatacgtccacgtacgcgctttgttgttttgcacacggggagggagggagggagacgcgtcagtgcgtgtgaggccgcggcccgctcacaggagaggagtcacaggcgggcgcgggaagaggaggggcaaaaccgacgggggatcacgcggcggcacgcatcgatcgagtccgtccgcgggaggggcgtcacgggggcatagtgggtgtgtccggtgtcgtcgagccgcccctcgtcacccgtgtcccctaaacaaacggcacggcagcccgctgcttcccctctctccctcccacgcgcgcgcacgcacgcacgaatctatatgtaatgtaacaccgtcaagatatttgttactatgaggtaggagatgaatttatagtcattatcttttttttgaaaaaattaattagatactccatatatctctatgagatacatcactctataaacataaaatgaaaaaaaaaactatttttagaggttagatttatttttcttcaaacgtttatgagttaaatttaaatttgcatatttatgaagtgaaatatcttaggcatatcttattaattttaaaatattttttatgattatttagatggtgtgtaaaaattaactagtgttacattcccctaagtaatgaaaacagtttacctactaggtgattgatgattgcaaccgatcactccactttgctccatgcatatccagtatgtcacagtatgtcactcgctcgatcttgggaatggatataaatgttatcaacaaacacacacagtgatatgatccgggaggtctaaggctagcttcctttctcattgattggccgccatctgcatgcatggctccatgaattttggaaccggagcgatacaccttttttttccatctggtggtacgctggtatatctacagtgtcaatgaacagtgctactcatgaatgggagagaggtctcgcctatccagctacacgatgctcacccactgggctccatgcttgctctctgctccagccactgtttcagaacacagagccacagatgcatgcatgcatgcaccaaatgccatcaatcaggagcttcaaattaactttcaaagatctttccatcaaaaaaaaaactttcaaagagatcagggtttcaatgttgtgatgcatgctggtcgtagcactgttcagtgagtcagtaatatttagagctacgtactgaagtacagaacgtatgcctctgaatcccatctcatatgttacatgatcttatttgccatagactacatatacatatatcaataattatgatgatatgctccccctaattaacagtagtcctattacacaggaaatgcttcggtgtacttcgtttcaccgaattataggagcctatcatgcatgcatgcgccgccatgtagacggcggagacgacagatcagacaggagaaaagagaagaaattaatgccgggggaaaatggagaaagaaagaataggacagactaatcattcgagcaattgctgcgatcgatcggccatgctcgccgccggccggcgaggaggaggagatcgaaattaacagagctcgatcgatccgcttctgtgcttactcgtcgtcgtcgtcgtcgtcgtcgtcgtggtgatcgccgccgctgccggagcagctcctgatcgcccgcagcacggcctgcttcacgacgtgctcgtccaccttctccatcaggttcttcagttcaggggagagcatatacagagacaaagcaaagaaaaagaaaaaaggcatgtcaaactcttgtcccagaatgtatgccggcctacagtgtttcttggtactgaatcaatcgaaacatctgcctttacctctcgaaagggctcaatgaattctacccaaattgacttgggcttaatttgaattttggccgctaatgatataatttgttagctgattaatataattacctcgctaccgatggcttctaggcggaaggtgtcggtgcaggaggccgtggcctcgaggacgctgaggccgagctcgtcgaaggcctcgaggatggagacgaggagccccgggcagctcttgccggagaagacgttgacgaggaacccgtgtcttagggtttccacggtcacctgcatgccagacaccattaatcacagcagctcgatcagctcatcactgatgagaccagatagttaattttcagacacaaattaatcatgcgtgtagatgcagacatgggagcattgattaatgaactgtgtgtgctctgtctgcgcaacagtgtgcatgcgtgtacgtactggagtagtactagctactgaccaatccaaactccattaactggctcatcagctatagccgctatagcattacaagtatctcgtgcatgtgaacttcgctagagccactcgcaggttggcatctagctagcgcgcgctgtcctctctctgctcgtagtacgaaattaacagaagaagaagagagagagagagagagagagagaggaaaaaaaaaagcaaagcactgtgcaatgtgtctgtgcagtctctctctctctctctcagagggagtttaagctaggtgtgtgatgtg

SEQ ID NO: 26101 - DNA, 10344 bp, Oryza sativa
tgcagacctgacgcacggtcgggtcgttttttttcaatcagtgacgacatgcatgcacatgaaaagtttagcagagagaaaaccttaataagaaaggagagggtgtgattaattacagcgtgggagtgagtgatggaccggaggatttgcagcttctcctgtagcgccgccgctttcttgcgttccctcgacgacatcatcttcgtcctctgtaagtctgtatagcagcagctctctctctctctcgctcttcttaatttcttcgcctctctctctcacacacacaacacaaacacaatcacagacacacagctgaagctggattacgatgaaggcctgataacccaatcgaattagcgagagagatattggcttgagaaagatagagaggagagaaagagaggtgtatagcttgctgctagctggtgagcaagagctgctgctatagtacagcagcttagctagctcaaatggggaacaccgagatgaaggccactactactccatatgtatatagtggcttctctccccggccgtggccactcacgtgaccatattgttgtatccttctgatcatttctctcatctaaatatcaattgaagggaaaaaaaaggaaatgtgtatgcatgagaattcagtgaaggagataaagaagaaaagaaaggaaatattggacgtatgcataatgcatgtctgccatatatgtttactagtataaacctctgaatctatatgagaagggacaaaataagatcgactaacctatacatcgtgctgcatacgacgtcgaagcaagtggacgatagggttcggcaaatattattgattgcttttgtgttccgttctagctttaattttgctactaatacttaatctagatgtgaaatatgaaactggcatttcgagacatggttttattacttcctgggagcacacatgcacatgcatgatatgtatgcatgctactagctaatttaaacaatataatatatatcatcacgcgttatatacagtggatactgaaattccgtaatttgaagctgtaggctgggctgttcgaagaaatggatgatcgatacaaaagttgaattaggcgacaaattgatccatgtagctagatggacgtacggatatggtttggttccagcaatgtgcatcaccagctagaaggaatctgcttgacaagatgcagtgcatcctccatcccgtgtggattaaacaactgaccattatcattttttttatgaaaactgaccattagttatccgaggactagtatatgaacaacttgctgtacgtagtgtgaaatatatatttatatatcggatcatcgaatacataggatgcccccataatggaacacaaatatccaaggtccaaacatcactgttactacatatagtacttagcatggttggtagtagtcctccggccggtaaactgaataaatttctttcccccttttgacagggccagggagaacgatgcgtgtagctagggtagccatgagatcaccaaccaaatgaaacattctgatatgaggtgcatgtatcatgtatggcagccacgcatgtgctgggctggtgaccattcccaacgagagcaaaaggaatggaagaccacggcactagctaagctagctagagctaggcgtcctcgctcaattattttactgctccctttatattaaaaaaaataagagttgctcattgaacataactcaagtagttagcttgtgtttgattatgggacgtactagctaggtaagatgaaacgatattatccctaattttgggatgggatgattctactcgtacgtttgatccataggatgggacgatcccagtttcttaattgatagaaggagggagagatgggatgaatgttgtttgcagttaccgtcagcccacgcccaatcccgacaacatgcttgaactcgacggcgatagactgccgagcggaggaggagcagtatggcccgcgagcgggtggaaggaggagcggagcaagcaggcggaggagtggtgaccgacgggctagcaaacggtcgggcgagcgagctgccagcaagcaggcaggcgcaggtggtgactgacagctagcggtcaggcaagcaagccgtcatgcaagcgagcaagagggcggatgtgggtgatcacacgaaggagaagcaatgtggctcatgccgtgcgcccaacccgttgagttcgtccgcttatttttatcggatggcctggacccggatctaaggggaatactcctctaatgggactaaggttaaaggaagggggaaatgtgggtgtttagcaggcttaagaggatggctagaatagtaatacttggccgggttgagcagtgggaggaaggaaacaatcaggggttagaaggcagtagccaaatgaaacagggaggaacggccaggtgggggaggcaggtattcgtttttccctcacaagctattcccaacagtattttctttcttgacgagattttattttgtcctgaacttgtatttttccttaattagatctaatccggtttctgatagtgagatgcatgagttcaatatttcacatggctcaagataccgccacttgatcttgatccaacaacccaaaatacaaagtgtgtattttatctgctttttttaataatataaaagaagatcatttagactagatttgagagaagaagaaacaagagtacatgttcccgaagggcttaaaatcatatcataacaaactgtgtactgcacatattgacacacatactatgactacatattccccttgtttgctgccctgcaactagctaggagagcttggcagctgggctcgacagaagagggcagcagatacgttcgtacgaggcgataagtttttaatctatttctcttcgagagaatgacgacgcgacggcctggatatatataactagtttaactacagcgtgaccaccgcgtgcgcatgcactgtatacatacgcgcatacggccgggataccaccatgtgagatcgatcacatatatatggatgcattcatgtataccaaaccatataaatctagctatctagccattaaattaacacctacatgtacatgtaaaacgttacgaaatgatcgtatccatgctggcgatcgacttcacatgcgtggcgatcgatagagagaacgagatcgatcgatcactatacagtactaccgacgccgttgacttttcgtccaacgtttaaccattcgtcttattaaaaaaattacgtaatattatttattttattgtgacttgatacatcatcaaatgttctttatgcatgacataaatattttgatattttcacaaaagaattgaataaaaaaatagtcaaatattggttaaaaagtcaccggcgtcatatattaaaatacggagagagtatatatatatatacccaaaataaacgtagtagtagtacatccgtgacggtacgtacttacgtgctaagctagtgtggtgttgttgagttgtggatggttgggtgtgggtgtgggggccgagaggccgacgttaaccagcgaggcatgcatgcagatgcagctagctgctgctgcaatgtgctgcatggagcagctggggaggagctgagctgagctagctttggcgcgggcaggagaggagaggagaggagaggggtgggggaatctgctcgtgatcgaggtgggaggggggaagctagcggccacagcacacaggcgcagaggctgcaggcaggcacctgcagcaggggcgcccgcgacggcgccgcgcgcgcgcacgtcgtcgtttcgaagtgggctcagttattagcaatgcaagccaccacgacgacggcgggcagtttagctttcctaggctcctagctactcagctagcggcacatcatgcaattgcatgcatgatgaatttgttttctttacgccaattgcatgacggatttgtttttttaggtatgtaaaagacaacttatagagatgaatacaaatgtttatccaggtttatccctagaagttagttttttatgggacggagagagtataggtgcgctcacaatcatatttaaatttaattgtttatggagcaatatattattaataatatatttctttaataaccatttagatgacaaactgggtatcatgaatgatcaatttgtgacagagatcagttgcccatcgtagagacaatcatgcaattgcgaggagacatctctatttgtgatatcctggtcccattagaacgagacatgtgtggcccatgacaactgtatacatgtgtgcatatctagtaccacattaattattagttgagcaagaatggaaccaacttataaaagcttgttcatctatatcactctcgggttaacatattaatacgaagcaaatgacgaaagtgtaagtgggccagcccatcgaaagggttgggctaccgcggttcatgtagattgattgatgtttgtatatacaaaacacaattttatcgtgaaaattagaggttaacagttgtatatcaaattcaactttgatttaaaatgtatttaaaacaattgtatcgcgaaaataggtgtgaagaaatcaaaccgaattctatttttaaatttagctccacacaaaactgcatgaaattaaaatcccgtaatttatattgctccaagagaggtttcaaaccgaaaaatccctacacaacgaaataatggtgttgttgattcaaaaatttaaaactaatggtttatttagattgatgccatttcaaaccataccattcttttttaaattatcaaatatgtgcatccattcgtttcttgccaaactttaataaatacataagaaatcctgccaaaattttggcattgtcaaaatttggtaaaatttattttggctacaatctgaacagcctctaaactacaaaatacgatcttcaaattaaatattcctgtgagatctaactaacctttaaatttaactatattatgacaacttgaggtcatgcatatacgcaactgcatacagctgataaattaacctctagctctagacatataaagacacgagcaattaatataatactggtgcaagaatagtgcatacgtgaattatttgccccgtatatatacttttctctgaatagctatggtctattttctagagcattccatgccgcctggctagctcgatcgctcactagcttgcctgctcgctagctggagcttttgtcattccatgcaacagcgtgcatgggagagagctgatgagcacgcataagtacataacgtgataacaatttatactagacactggagctattttgtttttggaagcgatgagagatgtgccgcatgccaaactagtatatatgcaagcaatgcaagggtccaaggagaaatgctctcacggggcggagagattaatttctgccgccgtgcgttgtccggtttccccctcgtgttggcgccagccagcccacacgtgccgatcgcaacaaatcgttggcagagcaatacgaacaaatgggcctttgttcatgagttagcacccagtttgttgccttgcgatgggggacaacgatcgaagtagtctaatcagattgcgcgcgctcgtcctctgtgtggacaagatcgatcgagctagcggcagcatgaatgtttgctagagtatataatactatgaatctgaatagaaatagaataaatatttagtaagtcagtaattaagtgaaagtgggaggggtcgagtagttcaccaagaacaataaatttttagtactaataacactaagacgaggcaaaaatacctttccgacgaatctaggctaaaacaacgattatggcatcaacaggcaacatctatccacaaaattaatagcttgatctttctagttacttcctcggtcctaaaatataagtgattttggatggatatgacatattctattataatgaatttacacagactctatgtccaagtttattgtaataacacctaaaatcccttatatctttgagccgtaaggagtaattttacagctctcttaataaagtgtccaattagctataaatagacagttgcttaagagtcacccggcccgtaaaaacttttaaatatctgaccgtcaaatcacatcgagattcgtgcgtgcatgggaaaggaaataatcaagagtgtaacaggatgaggacttgaactctcagtttcagccgtaagggtgcacgccgctagccacatacgagcttaaaaggttatatataaaattatattgcaattacagtttaatgacgatataattatgctattacgtactcgtattatactccctccgtttctaaatagttgacacggttgattttttaaaaacatgtttgactgttcgtcttatttaaaaacttttgagaaatatataaaattatatgtatacatataagtatattgaataatgaatcaaatggttaaattttttttaataagatgaatggtcaaacatattaaaaaaagttaacggcgttaaatattttgaaacggagagagagtattacatttgaaaaaaaaaattaaaaaagggcctaataatataactatacccccgaccgttagcttacagcaagactgattatattacacatacatgacatctggaaagcgacatgccaaaagttgatgttggaattaatgaatgggccttagcccactcgaagattaattctttggaaaatcacaaaagcccacctcatgggatggcatgcatgtggagtttagtaccaccttgcttattctaggaaagggggacctccttaaaagggaggatgccctcctagccacttgaagcatgtgtggtggagagaagagggggaacacgtgcgcgctcgctcgccaggccgggcccgcgcacaacgtacgacgtacgtagaatggtccgtcaaaattggttcctcaccttgctgcagatgcagcctccttttgcagttttgttttgctgcaaattcagattcgtttttgttttggaaacgcagttttgttttgctgcaaattcagattcgtttttgttttggaaacgttccgaaaaatccggtgtgtgcaaacggtgtggagtccggataagttacgcgcgacttattcggttcggttacgcgcagtggagatggtgcgggcgccctgatcaagcgacccttctctatataaaccgagccgccgccttcacgcaacacacgcgaaatcaatctagggtttgcctcctactctgtgttgcgccgtcgctcgtaggttactccatcccgctcgccggcgtgcacctgcgatcgggagagcaggtctccggaacctctgccttcgatgtcctgcaccgggagaaggcggcaataaggttttttggaagcgcgttgcgcgactgctccctgttcgtccgcgacggctcgtcttcctcttcgctcgcgtgctgcgtgccttcgtagacgcctacgaaaagtttcgaccgagcagccggcctttacgccacctcagtacgtgttcaatatgttgcgcatgtttgatctattcatgttatactgtgtagtttacatgtgtagatctaatgatgcgttcgtgctagttttcatctgtaatgtcatgatttatttatgaaatagattaaatcattatatgcctataatctcaacagttgacgcgatgcaccgtggattcgtagctagagactacaaccagtaccgtagcggtacaatataactaatctctacctatatatgcatacgaacgacaaccccatcccgggaaggcatcatacacacacaaacgtcgtacgaatcgactggacccgcgcgcgtccatcgatcgatcgatcgatcacgacgacgacacagcacggccccaattttcaaatcgcccacgtacggtcgctcgctgtacacgttcgaacatactccacactccgtccagtggcggtggtggctggccggcgcgcgaccccagcgcctgcacgcgcgcgtatactacgcccgttaccatatatacatgcatccaaccggccgcgaccgtggccatctcgtacagtcgcccggcggcgcttctctcgatcgatcgtgagacgatcgagcaggctaaatcgaccgcgcgcgcgacgacgtgacccaccgatcgccgatcggcgacggccgcatgcctcgctagctagccacctcagcgcctgatcgacgaggtaacgcgtgtattgccgcgtgccgcccgggcggacttgcattgccatgcatcgatatgacgatatcctcctcgcgatcgactcgatcgcgaacgagcagtacgcgcgcggttgagtaaacggcatgcagtctcgacagtttttaactctcgatcggtcgggctactattacatactccctccgtttcaaaatgtttaacaccgttgactttttagcacatgtttgaccgttcgtcttattcaaaataatttgtgaaatatgtaaaactatatgtgtacatgaaagtatatttaacaatgaatcaaatgatatgaaaagagtaaataattacttaaaattttaaaataagacaaatggtcaaatacgtactaaaaagtcaacgatatcaaacattttaaaatagggggagtactctactatatacttacatgcagtaccgtcatgcaccgagaaccaagctacaggcggttttttattaaccagctaaacctaagctatctgccggccagtaattaagttgccacatatggtaggagtaataagttcctgttcttttctccaacaaaagttggatgaagattaagatttttgtggcacgtttttaaattttcaaacggtgtgtttcgtgcgaaaactttctatatgaaagttactctaaaatatcatattaatatattttttaagtttgtaataattaaaactcaatcaatcatacgttaataccatatcgttttgcgtaaaaaacttaatctttatcttcatctttagaagaaaaaaacaccacctaagtaagcttaagtaagtaagattctattatgcctgatacgatcgatcctggatcgatagatttgactgttgcccggtccggccagatcggccaccaagaggggaagggtcgtgtaggttttccaaaaaaacaaataataaaaaaatgaaaagaggggtcgtgtaagctggctgaaaagctgtttgtgtaggccgccggagagaatcgaatgtgacgcatatgcctccgccatcccccttccctcctttcctacacggctacacatatctaatgtgatgtttggatttagggactaaactccctgtcacatcggatgtttgacactaatttaaagtattaaatataaactatacttacaaaactaattatataaatgaaagctaattcgtgagataaattttttaagcctaattaattaatctataattagagaatgtttattgtagcataaaataggctaatcatagattaattaggctcaatagattcgtctcgcgaattagtccagaattatgaaatgaattttatcattagtttacatttaatacttttaattagtgtctaaatattcgatatgacagacccatccaaacaccccctaactatacctcttgtgtgcacagaaaaattttcacatccatcgtctatcaacctgaggtgacctaagctagctttgtatcactgtctttgatggcatatgcgcagcaacattccacatacacattcccctattttattgggcaaacaacccttttcatcgatctctctctcgcccgtgttagggtgcatgcagggaatatgttgctgagctgtacatggttttgggccacactaggcatagccctcctagtcttcacttaaaatcaagacttaattaattactccaagtcgtaatcgtacgtccgttaatgaatcttatcgcctcagatcacaacacgtacgtagtctctacaataatagcaactatatattagtacgcaaatgtgccaatgtgcatgcatgttcagaactactcctagctaagctagatcattgatcatatatcgtcgtacatataatgtacttttcctgctggtttacgtcattttctaactggattaattattattccacacatatgttctaacttcagctagaacgtgttggaccagctacatactccagcatcttgtatgtggggctagcttactaccaatatgatgataagctattggtgataaccatcgatctctcttctaactctcaggcagaattgaagctctctcgattggtagtgtggtgtgtaaccatattaatgtagagagaaggtacagtaagggggactgatttgggggagagagagagagagagagagctggcag

SEQ ID NO: 26102 - DNA, 1958 bp, Oryza sativa
tatacatgatggtctgtaaattaaataccatggaaatagagcaatttccatatttgtctctgatggagccccactaacatgtagtaggcctgtactgttggcacttagctagataccattgtagtaagaataaataagaggcaaatgaagaaaccagtaaactttaggggagaaaaggaaatttatatgatgaaaattaataaccatgcatgcaccataacttgctaatttgcttgttctttgtttgttttttccagggtaacaacttaaacatggccttaattagtgaacaactgctctcggtcatatgcacgtacgtagacaagcatgtacatataacaataatactagttaagcatgaaaagccaacatggaactcctacatatatgaaaaattcaaatgggtactcaagacagatctggaatggtcgaaatatatgctggttttgtttgcgacatacatgaacttattgtgttccttgaatcctcctcatatattctaagacaggggcaaatatctttcacacaagtagctactcctagctagtagagaactagagatagctagctagcggttcccaccaattattgcaagcacaaacacaaatcaaggtgaaagacgaagaatgccaaatgcaacttgcaagaaagagatgcgcgtggcttgtcgtaatatagttttttgttacagcaaatatctgtccttactaattaagtccaaacatgtacgtacgcagctatatatatataggagtagatcatactatgtatcgatcagtacatatacaattattattattattattattattattattattattattattattattattattattattattattattattattattattattattattattattattattttcagcttgctggacgtaagtatatatatgaatcggagtatatatattctgttcttgcaatctagctacctagctagctacctccatttcagaaggtaagatgttttggttttatctcaagtcggacttctataagtttaatcaaagaaaatgtaataacatctatgatgtcaaatgaattttattaagagattgttcactttgtttcatttttaatgttaccaagttttcgtattgctaaattttagaagggcaacaaactaaacacattcttgccattgctactataccaaattttgaaaaaaaacggaagcttccactcaaaaaaaaaactttaccaaaatttagtcacactaaaacatccaaaatttgataatgacaaatattggtagggttgaaaatggtaacaaagtgaactaaatccaccattgaatatattaatactcctatatttgcttggtgttaaaaatattgctatgtttgtttttttaaaaaaaaattgatcaatcttatagaaggttaatttatagcaaaatatagccatcgtcttacattcttaaatggagggagctaggtgttttgatttaaagaaaaagattattctcgaaagcaattaatattccttttaggtattcaactagggaatggagcaattaatttcttgcacaacatatgtattactattagagtacacgacgctgatgtaatggatcaacactagcgtcttaattatatggggaaaaatacgtaaattaaaccatggaaggataattaaaccatggatgacgcctacggtaccgctcaggcatggcaacagaaatacagaacaaacaatatttaatatgcagcttatagctatcacacaagtcgagcaagcacgcacgcatggcacgatatggatcgagacgccgtcacgtgggtcaccatggggcatgcatgcaatgcatgatcagtttgtgacgaagactgacggtcactactacaaaagtgatttttctatacgagaccccatgatttttgcaaacggaccataactagtggcgcctgcaaaaatcacgcggcattttc

SEQ ID NO: 26103 - DNA, 10695 bp, Oryza sativa
ccaaattggatgattctttttcctaaatgtttctaaaatcatgctctatcatgttatctgtgttgctactgttattatttaggccattttttcttgtaactttgttttatcaatttaaaatttaaatttcaaatcttcaaataatattatgaagcaataaacgatttcagctgaaaaagtcaacaacaacaaagttgtataactcatcgatatctataatttctattttggtcatttcttcatttgacaaagtgatactaacattttcacaaaatttacatctctctcttatagttataaaactatataatagatatgtacattttgtgaataatcttacaaatcactttgtcggatgaataaatgaccaaaataaaagttatagatattaatgagttacaccaatttgttattgacgactttttcagttgaaatcatttagtatctgaaaatgttgtttgaagttgttataatttgaaattcaaattcagactgttcaaacaaagtcatatagaaaaatgaccaatacaaaagttgtagatcttgataagttatacaactttgtttttgataacttttccatttgaaatcatttactacctaaaaaactatttgaatttcttatattttaaaatttaaattttatatagttcaatcaaactcggatagagaaatgaccaaaagaaaattggtagatctcaacgacttctacaactttatttttggcaactttttcatatgagtttatttaagaccataaaattttattcgaagttctcacatttttaattaattttttaatgcttatttttacatgcggaccacttaaggagccgcatgcaaaaattggtccacatgcaaaaatatcaacagttttttcagttttttccctcctcaccacttcaaaaattttcatctcccctcctctcctctctctctgtctcctctctctgatatcctcacccctctctttttctttctcttcctctcactctctttctcttcctctctctctctttctctcctttgcgcgtggccaacgagggggcgccgagcagcgggcggtaggcggcgtcgagcagcgggcggtgggcggcagcggctcggcggccgacaacgacgacggccgcggtgggagcggcgacggcgggcggcgggagcggctacggcggcggcggcggctcggcggccgacaacgatgacggccgcggcgggggcgacggatccgatgctgccgccgacggatccggcaccggtgacgacgatgggtggcgggggcgatggatccgccgccggcgacgacgctgggcggcgggggcgacggatccgccgccgccgacgacggccgcggtgggagcagcgacggcgggcggcgggagcggctacggcggcggcgggctcgcagcggggtcgcggcggcggcttggcaacctcggctcggtggccgacaacgacgacggccgcggcgggggcgacggatccgatgccgccgccgacggatccggcaccggtgatgacgatgggtggcgggggcgatggatccgccgccggcgacgacgctgggcgacaggggcgacggatccaccgccgacgacgacgccgagcggtgggggtgacggatccggtgccgccgccgacggatccggcgccggcgacggcggggggtggcgggagcgatggatccgctgccggcgacggcgtgcggcgtggatacggcgctccggtggcgggctagggtttggtttggggttttttcgattttattttttttgtttgcttaatttattttcgcatgcggccggtataagcaactgcatgcgaaaataggattttcgcatgcggttgcgccggccgcatgcaaaaagggtgatttttacagacgatttcgtccatgcggttggcacaaccgcatggaaagttggttctcagctgtatggaaaaaccatatctgtagtagtgggtgtcagacgagttagcgtgacaacgtacgtacggctgatccatacacatataggcagcctgtgagcctggtatatatgagtttaaatatccattattccttacctagcttataatccgatctttaatcagcaatactgcaatatagctagtattccctccgtttcaggatataagacggtcaaaatcaaattgttttaagtttaaccaagtttgtagacaaatataataatatttataatactaaattagtttcatatcaaatcaataattgaatattttttaataaatttgtcttgggttgaaaatatttttatttttctctaccaacttagtcaaacttaaagcagtttgactttaaccaaaatcaaaacgttttatacctgaaacggagatagtacggtataacttcaattcgatcctataccatacacgtccgtgtgtgtctctaattaatttctttatgcgaaatgctttcaaattaatttcgacgtacatttggcgcatgcagcgcgtgacgtaggtgcaaatcgtactcaggtagtcaggtataggtacgtggtgtatcgatctgacccatcaggggggcgtcggtcacatgcgtacatacgtacatgcgccattgttcgtatatgcaggctctgtgtgtacaaaacggtgtctaggattctcgggggcggtaaactagctcccaaggctcacgtgacggcggcgagggcgcgatcgatatgaatatgatcgagcggtcgatcgggagagagccgagcgctttggaaagtacactcacatgccattggcagaatgtaccccctgcaggctgcagccatactactggtagctagctcccctgagcataccgatcagatatggactttcatctctagagaaaatatcatctaaatagttatcaaaatatttgatattccctccgtcctattttaaatgcaatcataagtttttcgtacccaactttaattgttcgtcttatttgaattatttttataattagtatttttattgctataagatgataaaatctgattagtactttatgcgtgacttatgttctcgaatttttttaaaacatttttaaataagatgaacggtcaaaatttggcacagaaaatcatggcagcacttacaatgggacggagggagtaataaagagtaatacatagtgtgaaataccacaaaccgctataccaaattcgatttctacaaattgcaacagaaaaataaattaaactgaaaaaagtaatcgtacatttataattatatttgttatttttgttacaacttgtataagttgaattttaacttgcatgtttatagagtaatatattttatattaatttatcttgctaattttttaataatttagactagtaatatacccgtgctaaacgctacggtacaatatcattgtctttaataacttttaaatttcattttagaaattttctatgatctatgcatcgtatcgattcacctttctatgttttcccctccatgtccattcacctttcaatttttttttcttcctaatatttttctctctatctgttcagcttccattttttccccggtatatttaggttgtgttccctaaaagaaaccactccctccactcgtaaaatggaacgatgaattaacacgtgattaattaagtattagctaaaaatacttttaaaaggattaatatggtttttttaaagcaacttctgtatataattgtttttatgaaaaataacacgcttaatgattagggaagcatgcgtacgggaaacgaggcagtggaggttggaaacctcaataaacaaacgcagccttattgatatttgacctcaaataaaatttataaataaaacacaatacagtactacctcagaaagaaaataataacatcgattttcattattcatacgtgccatcatctctcacaagtacaatacatagatcagatcagaaaacaggtactgcatagatctcagcaccttcagtttgttctcagcacatcatccagcatgttttactgaaggccaacattttttaaaagcactgaaaagcataatcatgtattaatcccttgagacttctcttcataccatcaagttttggcaataaagttgtgtagattaaccgaggagataaagtaattaaccatgcatttatgcataagtgtgatttagcttgcacagaaacatgtatcttccatgccacagtacctatctttagaggtaggaatgaaatgaaaaattgaacaccagttagcccctaatgtaaatcagtaagatatagtccaaacgtagacaccaaacgcggcgagttacggaatatagaacctgcaatacaagaaaagatgatatcaaaatacagctatatttctttttcttgaaaaataatgttctgtaaaggtcaaagcaatccaacacaatcatggtaccccctatagttacaggcccttcccgtcaatatcatatatatgcaagccatcgagatgacattgcaaaaagttattggaaatgccatacataataagatgttggaggagaaaagctcatatatgaaaccaaacaaggacaggccgatgaccatataaaaaacaatacatttcgagccgcatgttatatttttatacaaagaaaagaggaacgaagatttaaaaaaataagggccaaaaaataaccccacatattcgggggctggaccccccattcatataaaaattggatctatcactatgctggaggtaaatatataataaacatggtgtgcataagagtagcagtcccgtataagagtagttgaaaatcatatggccgctgtatctcttctcacgcacaaaaaggatccaaaatatcttgttaataaaaaacaccactcatgcaagatacaaggttgcaataaaaaacctaaactcaatttattcatccatggtagtgcagacatattatgattatagagcaatatatcagaattatctgttgtttcgcatgagtatatttcaggaaagtaaggcaaaaacagacaaacaacaggcacactacttactccgttgatataagaaatttcagcatcgttatcactataatatgaaattttagttatcctgagcaggaatatttctgttatcatctaattaaattttgcatccaaaatggttgaactgtaatgccattattttgactcacaagcaatgagaagatattttcagacagctaggtcaaagttctcattccaccaaaaaatacagaagaaaatccaccaactttctttaaatagttgtgaaataaacaaaaacaatcatgtactggtacgacatgtttcccttttacagagttccaggaagtgcatcgaactatctaagtacaccagcaagacaatgcggctattttgatcattttgcctgaagaaatgaagttttatactccactaaacaaatctaaaactcatgaattagaacctgatgggctgcagacgagatcgagctgcaaacttctagagcccctgctggaattaaactgctctcaagaaagaaaagaaaagacaaacctttgttccccttctgtagttctcaacaacaatgttgataatcaatcaccagataaacaaaaataatggagtacagtgtaacagtgaaaatactgtaaatatatacatgttgaattatctgatcccatacttccccttttgacatacatgtggccaatgtaaaataataatcagcaagaatagattcattcttattttcaactctctctttcagtcactttcgaacaaattctctgtgatttctgagggaaggaatgtttcctacttgacattttcagaaaaacgtattgaagtacaacatactgaaacataaattgtctagaacagcatcatttagtacttgtagttataaactgaaacatgtaactggtaaacataaattcgctgcgagggagactttcctggatggtcgtcagtgacaggcggaggtcgaggacggagatgcagtgtggtcgtggatgacaacatgggcagcgcaggtgaaatagacgttctacggtatcaacggcgccgcaagatcggcgaggtggaaattgatgtccctgccttatccaatttagcttgttgtcccagacaactaagcattctgtataccaagccaaaaaaaaaaaagatagtagcatgcagattagttcgtagccttttaaattcattcatgcacagaaagcatcaaatacccctcacaatctaatttcagccgacaatatatctgataatgcaactacaatttgaaaatttctaccttgtgcacagatagagtacaaaaccacacattgaggacaaaattgtttgatgaactgaatgtaagactgtttatactgcatttaatcgagcacctcccggacatggaaatttgaaaccacacattcagtgaaacacagagaaagaaaatgattgaatgctgcaacgatgaatcctaggcacgcagcggcggaccccgtcgcgctgtaaatgaaagatcggtggcggggtgactgattgggtgagaggagacttacatattagggatgggggagagagagagaagggagagggggatgggggacgaggggctctgtaccttccaacgacaaagggaccgcgtgagtgcgattcggagagacggcgggtggtgcttgaggcggccgcgcgttgccggaggagatcagcaaggcggagggacggcggcgcgactgcacgcctcggccggagaagaaggtgcgcacggctcactggcggcggtgggttgagggatcgggtggcggcggtgggctgagggatcgggaggaatcggcagcgacggcttatcgcgagcggcggcggcggtgaggtgcggtcctgggagggcgagagggggagggatgcgcgagatcgtgggcggaggcgccgccgtcggagaaaatttcgggcggaccgcggacggagagaggacgcgggtctgggagcgcgagagagaggtgggtcgggggtggatttggcaaccgtacgtgaggagggcggtggagtccatcagatccgttggttcaagcgcggatgatacaagtcgttggatttgatgaatgaagtatgaagaatgtagaactgtgttggtgaattatagggtagaagatgacatacacgaaacgaggtatatcccttcaaggaatgaaacactttcccaatagtatgcaacaaaagagtcaatcaaaccgcagcgtagagtaacgtaatgcaatagtatgcgtgtgcccgcatctgctccgtagcgagccggcctatcgatcgcgccatcgcccgcctcagaatcatttcccatgtgattgatatacaatttaactagggctgtaaaaaaaaggtttgggggctcagctcataagctgctcgatctgactcactctatgcttgatacgagctcagctcgagctccagatgagctgagctcgagcctatatatatcaaaacttgctagctttgtcgagccgagctcttgacctcctgtcaagcctaacatgtatattttatttattatttatcaaatcatatttacatgttctttagtgacatattttgaataataatttattacatgctatgttttcaatgaatatgaaattagcatcacatgaaagtacttcaaaacataaatctagtgatataacgtgcataataccttttttagataatacacatgcacaatatttagcatagatattaatatgatcactagtaaaaattatcgagttcgatttaagaaaatgaggcgtctataatttaggaacgagagagtaccatttatatgtatccatgcaatgaaatagtttatattggtatcatgtatttatctttttgtacttattcattaatatgattgaattaaatgagttattttttttattgagaatcatcctcaaaatataagtgcaccacttattatgagctaattaggcttgatgatattcaagcttgaactgagtctgcttggaagctcggatttttcacggactctcgattcgttgataatcctacagataacgagaggatgttaatttcaagagtttagaatatatatcgtcgcgtccccggcccgcgcgacgatcggcgcccgcgcctgcatggctgcgttcaacgcgcgcgcgtcccgacccgatcacatgcatgcaagctccgacgcgcgcgaggggcctcgcgtcgccggccggaggaggcgctggcgcgatgcaatgctgccgtagtcgtagcggtgtgtgcggcgctgctgcgctcggggggagagggaggggggggggggggggttgatccattttggctctggctgctgatgagtgatgatgcatgcgcctgctgctgcgccgtactagcggcgagcgatttggcgtgcttcgtcgtagggatgatgatgatgtgtggactggtatagtacactgctgagggctagtactgccatgcaagttaggtactccgtcgtctagcactctagcacaggtgtataatccctccgtaaaaaaaataaatatataattaaatataacatattttagtacgacgaatttgtataaatatatatctagattcataatactagtatgtgtcatatctagtactagattgattttttatgggacgaaagagagtatatacatgaagctaattaatttctccgttagtttaactacctcttcaaaaatatttaacattaagatgcacttgatagtgttgtggcaaggcgtgtgtcatttcaacccgaggttccgtgtttaatccctaaaacactcacaatttctctctctccaatttttgtttcttttaaaaaaaatttaacatctactagtattagaataagtcgatagcttattttaagcatagtaaaaacgcaggccttcatataaacaagtactccctctgtcccataatataagggattttggtgaatgtgacatattctagtacaatgaatctggtcagacagtctatccagattcattgtactccatccgtcctataatataagagattttgggtggatgtgacatatcctagtaagcgatatggcacaaagcccacctatatcaaaattacttgcatgataatagagagaaaccactaataaaaaccgttgtacatgtccttatagtcagaatgttaaatatttgattagatcttatcctagtaatcaaatattttttactggaagtttaaaaaacattacatggaagatatgtagccacacgcacgtaaaattaatttcaaatgttatttatggagttcaaatattataagataatattgtgatcaaagatgttcactcgtaaccaactgaaaatcgtaaagcttttgttgcgatatggcacaaagcccaccattcgcaatttcggtccattaatattttgggaggatcagagcagctcatcaggcccacgcccaccacaccggctcatctgcgtgtctttccttctctccttttcctatgacgtgaggcgttcttttcttcgtgtcgcatttcgggctccttgtgccaagataaaaggaaaagttcaatgggctttcaaatttcatttcaaaccttacgaatgtggccgaaaagaaaaaagaactaacgaaacgtacgtgagggcttgcttttcttcgtgttgcatttcaggctcgttgcgaagataaaaggaaaagtggcaacgatttcaatgggctttcaaatttcatctcaaaccttacgaaatgtggccgaaaagaaaaaataactaacaaaatgtgacgaaaaaaagaagtgcaaaattgatgcgcatccggggaatcgaaccccggtcagtaccgtgggagggtactatgataccactacaccagatgcgcttgacgcttgaaattaaacgattatttatatattctttacaatactcacttcaaatgacatcaactaaaggcacacttcattgaattttatatattcttctggggaaacaagcttgatttcatatcggtttaatttctgactgttgcatagcactgtcgacgaatttacacatccaaattcccctaattccctctttaaaaataatttgggaaatcaacaagctcgcactgattgccctctgcacaggccggcgtgttgtgtggacatccccgtcaacagtcaccctcctagctgctaaatgaattgcttccaataatgatttctttcatcatcctggcctacctaatcagcaatcaatccggatcccatctgatgtgctccatcgaggcatcgactcaccgcgcgcagaaagcgaagcgcatgacaccatcgacctatcccctgtcactctttcagtactgacgatctctcatccgattcgccaagcaccaaccaagcagttcggccagccgagaatgcaaatttaaccaacacaacattaagcatttgcacatcatcatcacgcacgcagtttattatactcgtatatatatatatatatatatattataagtgctcctttggaacattgagaagtggagagaatctatgaggctgaaatcctatgaaaaataatcctaatcagttctttgcaacaaatgattgtgtggcttccacaaaattctttagaacttatatggaatgacccgtttcgatataattttggaggaaaactagtaagggcgtgttctttctggtttgattttggcttattatttgcacgtaaaacgagatacattattagcatataattaaattgtgtactatatatttaaaactta

SEQ ID NO: 26104 - DNA, 2842 bp, Oryza sativa
aagataaagtactatttgttagaattttgtctttttttggttagggctaaaatatagtaatatatttgaagatgagacttaaaacatatatgcaataccattgaaagtacatgcatatttttttaagaaaaataatatcatatttgctagttggtatgtacgaagtatgcacatgattcgttccctatttggacatatgtttctacaagattgagcagttctcaaaaatcttgcgaagtttatgctccaatcagcctagagtgtaactcagacacggagagtagcacaaaaagaaaagtagaaacatattttttttaccagtttttatatgaatatacacatttagaaggaatttgcaaaagtatatcattgtcgcgaaatgatgatgcaaattcacagcgagtttatacgggaagtacgcaaactggtgacgtgtacgagatgtcaacgctgtgttcggcatttggtgttgggagctaatcccttctgcacgtaaatcggagtgactcaataatgcattatcaattaagtattagctatttttttaaaaaaatggtttaatataattttttaaagaaactttcatatagaaaatgtttacaatataacacgtcgtttagcaatttaaaaatcgtgcacgtaaaaaaataggaaggaaagtgagttgggaaagtaaggggaagaacacagcattagtagcgaacggcgattgcatctcctcccttctctctcctttgccttttgcattttaggtcccagctcgggcttcaacgtctgcgacgccatccctctccccttgatatccccgaagaacgtgtgaccagtttttgctccgcgttcttcacaacaccacacgcaaggaggatgtggcagcgaatctttgacatggatagcccaggctgaatgccaactgtatgcattgtgaacgcccttatttggccattcacaacgcgcacacgctaggtgtggtgatgttggccacgtagacaactcgcttacgtgaagaagacaggggagtggtttcttcaccggatctgcatgaccaaagttggttactagaaccttgcagcagtttggtaaaaaaatgtgcttatctggggatggagagagagagagagatagagatggaagaacagtgtcagacagaaaagaaaagctcaatttgagccggagtagagacgctcggggaggtcgccgctgttgcgtgggctcggggaagccaccgctgtcgttgcgtggattcggggtattgaggcaagaagctggaaaaggaagggaaaagccctgcttccgccgccgccgtgttttctcctaaacagcgccaacggtggtgtgtgtgtgtgtgtgttaggggggggaggatgggggcaccaaatctgcatcgccggtgggagaggagagggtggaggagttggggaggtgtggcagattttgctccgaaggtgcaacattttttgtttttgtgctgggctagcgtgaaaaaaattggtggtgggccccatctaaagctacgcaccctggggagatgggagccccatttgctttttctatgtggacgcttaggctgcatggtgagacctaaaacatttctactatccttagggtgtgttcgccgttgctcgttcccaaccgggaagagtacgcacagaaaacagagcgatccattagcgcgtgattaattaaatgttagctttcttttttcaaaaataggttaatttgatttttttaagtaactttcgtatataaacttttttaaaaagcataccgtttagcagtttgaaaagcgtgcgcgcgaaaaacgagagagaagagttaggaagaggggcatccgaacacagccttaatgtacgactatgtatatttttacaaattctttccaaacatatatattcctataaaaccgatgaaaagaatatattttaaattttatttcagagtagcacgcggtaagaacaaggacagccactacgtttcaccatcgctaccagaatagactggcgaatggtacaggcattgcctttcggcagctgccaataggaccaaagaaggaagtcgaaaaggaaaggcgctccgatgagcagaggatgaactgccttttgatcagaaaagcacaatgtgtcagttcttgtcggaaggagaaatcagaaagtgatgttctcggtgtcaggtgatgtaatgtgagcagactgctctgctgtgtgcaggtatttaagttccagaattcagagctgaaacaaagaggagctgatccagtggtaatttgcacggccacacaatccattttgtcatggtactgcggccattgttccaaattggaccggggaagagagcaatctgaatattcagggcacaagataataatgggagaaaaaaaaaaggaaagctggccttagagagcactattcacacacttttgaccttcggaatacagaaatttcattcgagttaattcactttgcatagaaatcgacacaaaaagttctaacatccaagagaatgccaacatagcactattaaagaaaaagacgcatttaccaaaccataccttcctttggtagagacaaatgggattcaagcatcaagcaaagaacatcaaaatagagcaacaagagaatgcttaagattaagctaacatattcccccgattttttcttctttcaagttaaacttaaggtaaaagaactacaatggtataattagttgctacccattagccttcttggcctaactatagacaattgaggaggacaagagatcgacagaactttacatggacgaatatatatgctattagaatcctcgcatttgcgctctcctgaggttatgaaaaaagctcaacctg

SEQ ID NO: 26105 - DNA, 5046 bp, Oryza sativa
  unsure (1)..(5046): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatatgcatggaaggttttactgtaaaaaaatagtgattacattcgtgcgattttaaaaaaagaacacttgagtgacatatagcttgccccatgcagcttagtacttagggtgcattcgaatatgcttatgaactgagctttttagcctcacgcaaaacataacaagttattaccgtataattaattaattaattaagtattaactattataaatttaaaaataaaattatttgatttcttttattaaaatatgtatatataatacttacaaaatgtagtttaggaaatcgtactcagggaaacgagtaagtaattaattaaccagaaatgggagccttaattaccagtgagtacaaccaggtcggtggggctgagccctttcccggcgaagctagtgacgaagttacccaggtcggtggtcggtggatggaggttggtgttcgccatggtttggttcgtcgtcatcccgtccctcctcccgagctccaccgggtacgatggacctcctagctgcatccatgtcgtacaatgttaatggctgctctcttcgtctaaaaaaaataaatctactatcttatatccagattcgtagtattagaatgtgtcacatctcatttgagatttgtcttttacaggacggagagagttgttgcgttcaattaatttgagacaagctagcaagcttgggatcgacgtacggcgacgacggagtcgcgggcggcgacagcaaggatgtcggcgcaggagacggtctgcctgcaagatgcctcgagttgcatcttaatgctagagatgacctcgaatcccctcagcgagttgacattagggaacgcaccctgctccccccggaaggtggcattgtcggccagcagtatcgacgcgtcgcatccctatgaaattggtaagaaaattaagtctatgacataagagacatgctattgaaaaaaatgtgaataagccataacggttacactgaacaaagtataaagtatatgtctaataaactgtgacaacaaaaaaatgtggtgtggtaaagtgttatcgtgaaccaaacaccctggcctgtaaatcacaacatcctacctagccaattcatgttagtagtatatcccaatagaatttcactgagatcaagaatatatctctttaagcgtgtgttatgaggacacattcgtggatatataagtatagtgttacgtgtgtagtggcatgtgtctatcatgtaatcggaaaaaaaatcatataaagcaatagagaattaagtaaaaaaatcatataaagcaatagagaattaagtataggggcaggagtaataattaagattttaagactaatggatgagacttgcttggacaaagcagtcgtggaagtggagcctgagcagggaggcgcccatgcggggctccctggccaccgccgcgttcacggcgctcctgatcgtcgacagcgcggtcgggcacgacgaggcgtagaacgtcgtcgacagctggcccgacgccgccgccgccaacgccaccaccaaaacgctcaccgccacggcggcggaagagtaggagtaacccatatggtcaaaatgaaatatcacaacttcacaagctctctctcgttgctgtggctttgcttaattggtgctgtactgcttaattacctgcattggcaatgcacacccacagtcacgtatatatatagccacagagtcacttgacaaagccctcgagagctcagcttatagctagctactcccttcgtccctaaatgtttaacgctgttgacttttttaaacatgtttgaccgttcgtcttattaaaaaaattaaataattattaatgatttttttatcatttaattcattgttaaaagtatatatacatatagttttatatatttcgtaaaagtttttaaataagacgaacagtaaaacatatttaaaaaagttaacgccgtcaaacatttaagatggaggtagtattaagcacttgtctttacatgctaattattgtacggctcgtgaacagaaaaccccaaggctctgtggccctcgggctctgtggcagcaactggttagttagcttgtcctgctgcatgcatgcatgttctccttctgcagtgcagtgctgagggactggaattctggaaagatgtagtatatatacggaacgacatcaatattactatcgtggtctcaatcaatgacgacctgtaataactaatcatgcacgcacgtatgtttccataacaacacaggtacgcataatctttggccctaattacctgaattagtagcacaaactgtattgatcgatgcctctaagtatcttcagaataagccgtgttaatcaactgggactcctgaagtgaccgaggttaattgatcttagtggtgttggagagcgctatgtacctgcttgactgtttaattaacgtatacatacgaacatatgcgataaatcatgatatcaaataattcagccgaaatcatgatatcaaataattcagccgagataattaaacgccaatgatattattgttggagcggatatatttatgatttcaacacggcttttcttatctgtttacgaacaaaacgaaagagtgtagtgtgctctggtcctgtcatacttggataaattactcacaaagtttgatcatgggaacaaaatgtacactgtagcagggaaactaatcatcttctagcggttgtggtcagccagctcagtgttagcctgtatcgactaacaacgaacaaattaataagacagcttaacaagaaacaatattcatacccatcagcatagggacatcctttgcggcacatgcatttgcatggatgcatccatcgctgtaggcctcaagaccaagagaaattaaattaggttacaaggctgaaattagatagctcttgtttgcctctaatcatcaatcaataactcccctaaccccaccgtttttctcattttcttgattttttttggctatctggatggtttacccatcgctcctcctcattccggctcctcgtgcacgcctgcatgaccgctcgtaagcggtcactggtccaacgatttttttgggcgctatgggggcgtgcgcacgcgccggtctcgacggcgggttggaacctgtttgattaaaaggatattttgcaaaaaaattccttgtgtttccacgaaatatcgtatacgtccttggacaggttcacacccgttgtgtttgttgcgaaaaaaccctcctatttcacaaatatacaatgtgaagaagagaaaattccgttttaggggtaacgctgtaaatattaaaaactaaggtgttttttcgaaaaaaccaccacatataccctaaaccctaaccagggctgttccccactccctcaccacgcggccgccgccccacccacgccccgtgctcggcgccggcgccggcgcgggactcccctcgcctccgtccgctctccccgagtcacctccgtcgtcgtacgccctccacccgccgccgccgacgtcgtccgtcctccccccgctctccgttgcctctccttgcaggccgtgcgacggcgcggctcgtggcctcgtctccggtgccaccgtagctagatctggccctcccacggctggatctagctccgccgccgctggatctagcggccggaggagacggcgcgacggaggaggatggccgcgatagcttcggacgacgaagcggcggaggccgacaggtgcggcaccatcgtccgccttccccgcgaggggttccgctgccgccaccgtcacccgtcgcctccgcatgcccacacacaccacgatctgccgccggtgcctcctccctccttacccctccccttgtggtgacgtcaacgggacggaaggcggacgcgtccatcaaggcttgaggtggcggcggagctgaccacgcgaccgccgcccgtcggagccggtactccctagccccttcttcatgcgccaccgccgcctcctcgttcttccctagccgtcgtcaccgcccgtactcttcatctccccaatgccgccgcttcctctcttttgccctgtcgtatagcaggccaaacgggcggcccggcccagcacggcatggcacactgacggcacggcccactagggcacggcccgttaggcacggctcctatagcgggccgtgccgtgctggcccacgtgccaaggcctcggcccaagcacggcccaaggaggtgctgggtcgtgccgggccggcacggctactgtagtggaccgtgggctggtagccggcccactagtacatgtggcccataaaaattgaaatttgaggggaaaaaagaaaaaaaagacagaaaaaacattataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggtcggtgggccgtgccattccggcacgctaaagtaaacgtgccgtgccgtgctggcctacgggctgaggcgtcggcccaaacacggcacgggataacgggccgtgctggcacggcccacaggctggcgtgccgtgccgggccttggccggctacagtactgccgtgctcgggccggcccggcttggcacggcccatttggccaggtataccctctcgcctcgctcggtggggtgtcggatttgacgagcaaggtcagcggcgaggagcagggccagcggatgtggcaaggtggcgaaggcctcagcagccggcggtgggcgctcaaagcggacgaaagcgaggccgccggcggccccatcaaccgccctacccacca

SEQ ID NO: 26106 - DNA, 617 bp, Oryza sativa
ggttcttcattcgcatgggaggtttcagctgtacaacaagatgcctgttccaccatttcatggtccaagtactgttcgctgctaccattgccatcttctaggtaaaacaaaggatactgatttggtgtctcttggatgaaacaggacgattttagactcaaatcagtacttgatgctaccatgtgatctccatgaaaatgtgtaggcacattcaaggtggcatatgagtcattgttaactaagcactttgaaagatggtgaggacctctgttctcatcttgattattgcaggaaattttcatgctcgacatctcatcccacaatgccttgccaggaccaaggaaggactcacaacgaaatgcatcattatagctttcatctccaatgtctggccttactccacttccaatcctattcaatgtattcttgaaaaatccataaatttcatcaggaataagttctggttgtaacaagagaacttgaccaagcttctgagcaccatacgaaaaagcagtccgaatacgattaaagctggctgccaaaagtaaaatgtctacataaattagtagaagtgaaataatgtacagaaaacccctactatgtgcaagttcaaccgc

SEQ ID NO: 26107 - DNA, 666 bp, Oryza sativa
aactgatgctggattgcttttaactctcacttgtcgagtgattagtgtcttgttctgtcctaaagataccatgtgctgtaacacaaataaggtaactgattagcagaacaactaaaggtttaagtgaagctgtcagtgtcagacatccaagggacaagatgtatagcatatataatgaagatataaaatagtcaagtattcatatcggatctagattttcttggccctaagaggacaatgaaaatgtatgccaaaaaaaagtaagagatataaactcatgacaactgagaacagagagctcctaccttttggagaatatgttgatctgtttcatgcatattggagatatcatctgagctatcatacaattgaacagaattatctgaattagcataagaagaacatggtgacagtccattggttggagcaattgtttgagagggtattaataaaaagttctgctgacaagacgcaccccagttgctctcatcatgtgactgctgtgaagaatcttcggtgctatgagaagaggaaactggagataatctcctctcatcagtttcagtagatgaaggtgataacagacctggcagcaccacatcagaattcgatgtgatgttaacagctggaatttcaaacgagtcccttgcaaccttacagtcagaa

SEQ ID NO: 26108 - DNA, 1219 bp, Oryza sativa
tcggtcctctgtttttagtcgtcttgactttgtccgtgcgtcctttacttatgtgtaatctcttcgctccgtacccacagatggtagatctggaaaagtggtctttatctgttgctattctgctgaacacttttaatgcgtactacgagatgtctatacagtctttgtatagctggaattgcttggaaacgtgtggcaggctatagttgataggcattagttttgcagtaggagtcatgttgtggtgtcacctagcaaatgatattcattgggcatcaaagcagtaatgttttcgcagtaatgttttcgcttaattattgtcacatgtgtgtatgtgtgccaatagtgcgcaacacagaatccctgcaagatgccaattgactttgacttttctccgccttatatgttgtttctagttcttgtttttttttttttaaaaaaatgtcgtatttgctgattggttgcttacctgcttgaaaaatatgattttgtgattcatgatagcagctcacttggtggcatattggtcgctattttctagtcatttcatcattcatacttaagacagttatattatgatttgtttccatggatgtatttagttgttttggcgcatgcaaaactgacatgactaagtatatatgtttcttagtggaataacatgatggtgacccaacaaaaagttcatcttttaattgttctcttggaaaaaccaatggtaacacactcacataccaggaatcttcgtggatatgtgatatatcttggttgtggttctctatcatattactacctgtatatgattgttgcaatgacttcttattctatctagcaatatctgttggaccttttgacgtgccaactttttgtgcaaaaatatttctttattatttcctagttctaaaatgtttcttctttattcgatatgtaggtctttgcatatggatcagttccattgaagacttaccttcctgatggggacgttgatctgactgtactcggcaatacatcttatggtagtactttaattgatgatatctaccacatccttcagtcagaagagcagaattgtgatgctgaatttgaagtaaaggacttgcaactgatcatgctgaggtgcaatttcttgttggcatgtttatgcttgctaattgctacacattccgagccattcatgtgaactgtagtttgggaaaatccttttgtttctgctggtaac

SEQ ID NO: 26109 - DNA, 7067 bp, Oryza sativa
aacgaaacaatagagcgtttaacagcgaatgcaaggtatcctgaaaacaacatatcaagtagcattttatcctgaaaacattgtatcaagtggcattttatctggtttattctagtgggtgacatcttgttgaaaccttgagtatgaagtggcatattatccgttttatccccgggcagagaaaacagacatccgggtaccgtgtatgaaatcattcagatttttttttttttggcaagcagcagcttgttaatgccaaccagtcaaccgattacacagaaaacgtacggcttgatatacaggaggttgcagatattctatcttgttgatcaaccgataggactcatacggaaacagcattgtaatcctgcgatgctttctgcatactcctacttgaatactatgtagtcctatcactactgttcactacataatgctgctatagtatttttcactagttcatacgcgatcaaatgattagtcctcgggatcgaagtccctaaccttcacatctgcgtctaccccatactggatgcagttgtcgatgtgcgacagcacatactgaatgctggaaaaagaaatcagggccagttagagagatgaaaagaggagcacacggtacaaacaggtatctgtacatttacaaacttgatgttaagtttttatttcactaaaatattttgcttgagacttgcgctataagttcgaccgttgacttataaaacaaaatgttcactgatggaatgcctaatccccacccagagtagggagtcgaaatagcagttcttgaagccaggatatatacagcacagacactaccatattatttttatggagtaggatggacatgtgtcttcaagagatgcgatacatgaaaagttggcatgcatgctagtagcatgtgtaggacttatagggtaaaggctcacgatcagtcaagtccaaaagagttttgcaacaaaatatgataaaatttaggcatccataggcctgaaattcagaatgtgaagtactgagattctaaaggaaaacggcattacctgctctcttttcttaaatcaagtgggatgaaattcaccatgctgtaatcatcaacctacatgatagtattaagattaataatgattactgatagcactgcattagagcaaaatatctttgaacaaaagaatacattctaaataaggtaatgggaagatagaatatggggttactataacttcgtaacaatcagctcagacagtcaggcatatattatctaatagtagttgattcagaatttcagatatgtacaaaagataaacagcatgagtatacccttttattcaaaatgctcacacaacaaatcgatggttctaagcctcctgttaggagccacacacgcacaaaaaaaaaaaaggaacactacagatggtggtggagataatctcatgaaagtgtcggaaaactcaatagatcagaaactaaaatggtaatagcattaaggtaaaggggcaattgcatctgtgcccccacttttgatgccaattgctgttttacccccattttttagggtttgcagttttacccccattttttgaatctgaaacagccgtctaccctcacttctaacagccggttttaatggtgttagttatagagaaaatgacatttatacccttggtgcaattgtccctagataaaaagtgattatatgaatcagtactccaattcacctcctttttcttttcaaaagtcactagatagatattgacttaatttcaaggttttcatgatctcactactcaatgtttatatgaatcagtacattcctcctgaaggttatacactgatacatagcaaaacattagatcgatttgatatcgaacaaacctcaacgagcattcaaatcaaatgagccctaattatgattcaccttctctccagaagataattaacaaggttttcatggataggtaggagataacgcagaaattagacagagcatcttgtcgatcttcttttttccggggtcgccgatgaacctgccgccggaacggagggaggggacgagtgcggaggcctcgtcgctggtgcatagctcgaactcggcgaggccgtagcggctcagcgtcttcctcacctgcccacgggcgctgccgccgcctcgcgcgcggccgctagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttctcggaacacgaaaaccaattcaacttctaatagaaacaaatatcaacatatataattagctcattttatataaaatatagtataatttataaatatttttaaaattttaaataatattaataatgtggactagtgttaagagatgaactactattaaaatctaaaaaagtatattgaaggtcatagagttataaagaaatggggtatgtcttgtggcttctgcggatatccgaatagcactgttcaccggatatccgaattattatccgtatccgacggaaaccctgataccatattcgtattcgtatccgagagaaaatatccgtattcgtatccgtatccgaactatccgagaattatccgatccgaaaggtatccgtattcgtttttatccagagcggacggaaactatccgctccgttttcatccctcgccttgcgctcgcccgcagccgccgcctccgcgcgcgccctcgtcgtcgcaggcgtcaccccacgcgcacgcccagcgctagggttttgcccgaaaccgatgcagggggtgggaggacagactcaccatcctatccattccctcaggggtacataggtaatttcatatttcctaaaacctttttttaattttcttttgtatttctttaactcaaaacgcgggacccaccaaatggctgtcacaactgagggtagacagctggttcagattcaaaaagtggaggtaaaactgcaaaccctaaaaagtgggggtaaaacagcaattggcatttaaagtgggggtatagatgcaattatccctaaggtaaaaggggaatatgggtaaaacgaatgcaccaaaaattgttaagatactgtcatgtttgattcaccacagctaaacttggtggtatctcccttccaaatcatcaatatggctaaagaaaagaagagctgctcatggtacctcgtatcacaaaacaagtgtgtgatagaacttgaaacaccaacaaatgtttaatcaatatttaagtttattttgttgttgaaaaaaacaagtatttcatgaaaatggtatgtttcttgatacttagaataggctacagtacattatagcaaaccttaataatgtaggtaatttgcttcaaaggaataacgatttttttaaaaaaataatgctatatgtccggcatttatgaatttgtgagtctgtgacatccttgaggcactcatgaccagtgttattagattcagactggactggcggtttgaatcggaaaaaaaaggaacccagtgctttccccagtctggtcaaggctatttgatcatttctgcagccaagccactctggacagcaaaaacctatcaaatcagctgtttttttttgtggcctggtgagagaaccaagcccagtgagaaccaactaatcagaataaataggaaaaatagcatgatcgttaggctttgagcacaaggcctccctaccctactgaaataaacgcacgtagtggccaccaggccatgctcttggctgggaacagcagtgaaagcatagacatttgaaatacatgtgctgcctgaatgtataaagaaaaacctgcagttcaacttcaaccagtgaccaatgacctgagacctgaccgggtcagtcacaggttctgacaacaggctggcaaccacatattttgacaaatataggcttttataaaggagtaacaatatacagaagaatttacaggttcatgtcatgcgtaccagttcagctaacgatttgtttaacttgccaaacttgggtgccatctgtcggttcagctgtgacaagagaacctgcgcctctggattcagatacctagaaaacatcaagagattaatacaaagcaggatggttgaatctttaaataaaggagaaatgaaataaacatactcttccacatcctttttgttggcgaccaggtccatctttgaaagaatgttgatatgaggaagttcaagctgaatcatggcagaaagagaagccatgcaaccactgatgtattttgtcacatcactaacaaacttaaccaagaaaaacaaaactcaagtcagacttgtctacttgtgtttggggccagtatcttttttcaaggataaatatatttggttagtgatccaagagtccaaacctgtgaatcaagaaagtacacggcacaaacgttgaaattttttcgtttcaaatgttcaacaaagttacgcagaactgggacatgagtgaagagttcaatctggcctggagaaacaagatgtggtctctcattgtcatgattttaggtgaagttaaacaatctaaaatatttcagaattcccatgcaactacaggggaaggacataatatctgtattgctagagaataacatgagcaataggtccttgtacaagcttatcgcacaagtataattcgttagatagagatattgattaatcgttggttttttcaaggccatgtatggtaagaatagtagtcaagctctacgtaacctccaactacatttaaagcacacaatcatgaaataaagaaagttacctgggcaatcaaacacaagatagtcatcatccaaataaccatccagttgctcatccaaccaatcatccaaattgtcttcaaggtgcctatggttttcttaaggaacaactgacagcataaaatcctattaaataaaaaatatacccataacatcctctttagattgacatgatattaataccaagggttttttattggatcctagtacacatataactctacagaacgttcaaacaaatgaagagtcagcataaattgtacactgctagcctgcaagtaatgtgaatgggtgaactaaacaagactaatcaagtttgcagtgttttaactaacatagtatggagaattaaaaggtggtgtctgtgcaaatgtctcccgacagatggagtagcaaattgaacatatgatagcaatgacatagtttctaaagtatcatatgcatatagcaaaactacttactcttgggacatctatataaaactactgctaatgaatggcgaaatagagaaagaagttagtaaattatagagttaataagcatgagcagtccatctcaccaacattcatcagcatacagatacagatctgatgattgcatggccatagagatatataatccagttctgattccgagtttaatatatttcaggtgagctgtctcatcctaccgttgattgctcaaaacaaaaaatgcatggccatagttgagaggaaagtatggcactccagttataatggccaagcaaataatgcttttgagaccaatatgtactaaatctcaagagcggagagagccccaaaagctagttgcagagcaattgcggaaaaattgtgctaaaagaaaagtttctacccacaatggcctgatgttgcccctgcaacccaattagctttcgaaacacaacaacagcacattgcaaataatttaccacaaggatcagttaagaacttaaatagcttggaaagaaaagggcaataaaattaaaagactcaaaacaggatactccatgcaatagataagcccgccatttggtcccatcccaagttcctccatgacatcatccaatgatatgagctccctaatatctacaaaattttaaaaagaagccaagtataagcgagccgggtggcatttacatgtgagcagaagaagcacaagattcttacccgtagatacaggatagctgaagtgctctgcagcaggatcgagattgaccatatgaattgtcctacccacagtctcacaatgttgatacaaactggagcaatatgtcgactgcacagcatatacaacagattagggggaaaaaacaattaccagcatctcattttagtcactaggaaaacttgcaatacatgcttgtaaattctctgataatgttatcatgtgccaaacttaatactcccaaattttaccggaggtggtaggcatcccaacaactagtattacactaaccaaaccctagtgaaataagaataaactcaaatacaatcgacaggaatcattccccactaaaacagcacggagacaatcccaagactcgccccgaatatcctaaccatcgccgaggaaatcccaccatcatatcaaaccccctccaaaaccgaaaaacctaaaagcatgaaacgaagcggatgggatgggggagtcggatagacccattcaccttgccgctcccggcggggccgatgacgagctgcgcgtaccccatggcgggcgagaaggactagggttttagagaggggagaggcgggggaggaggtagttgctctggaggaggaggaggaggaagcgcgcggcgcgggttagaaggcggaggagatggcggcggcgagcacagcgtcatctgggttttggtgcttgcggcggccttgtgatggaggcacatgcaatggagcgaacagaagttgctcgatactggcgtgcaggcttgagcgccgttgggtctgaacatctgcagcgctcgaccgttggatggcgagcgctgggtatgatggacaccagcagcccgttttccgggaaatttaaatatttgccacttttagattcgataattatccaaatatccttattaggtttgcacttaattttttccttttaagagatagtctcttaactatttgccacttttttcccctcttaagaggaagtctcttaactatttgccacttttgccaacgtggcatactcgggtgaaaaa

SEQ ID NO: 26110 - DNA, 6449 bp, Oryza sativa
ttcctcttccccattgacgtcggcatcattgtttctccactgcgcctgcacccgtcaacattggcggctcggcgccgttccgcctcatctgccgttctacctcggccgccgccctctcccttcgtcgttgtcgcctcttcgcttcttccaccgccacgaggagtccttccggcggctccgccttctcccgtcgaagctctgcctcccccgccgccactgctccacttcctccaccagcgccattggctctgcctcctctatcgccaccttgcctcctcctccgccaccgccgtcgccgctccacctcctccatcgtcgctgctctgcctcattcgttgccactctacctccgctgccactctgcgtcctccacccaccatgaggagtctgttcggcggttccgcctcctccgtcactgctcactggcgttgacaggtagaggcacgatggagaagagaggcgatgccagcgtttatggggaagagaaagaacggggagagactgacgagtgagtcccacaccatttttcacccgagtttaccacgttggcatgccacataggcaaaagtggcaaatagttaaaagaccacctcttaagagggacacaaaattaagtgcaaaactaagaagggcatttggataattgccaaacttaaaagtggcaaatagttaaattcccccgtttacccctagcccactagaccacctccctcgccctatcacgcttctagcatagcttaactcagctatagggttcacagttgaattcgattcggattttatgaagtcgggactttttgaaggacacaaattgctcggcttttcagtcatgtccaaaaacaatttcaaactgattttttttttgcaagaaagatgatgttttactgatgagaaacaaagttattacaatagttgagaacaagaccttgaatacaagctatcctattgcaacctcttccaagttctaacatgacgaaactttacctcgctagcaactcatttgtgataatgtgcaatattgtgattttttttgacaaaaaattatccggatttcatccgttttcatcgtcattttattaacggatttccaatgataacgctcgtgaagtcgtttcaaattgcagcatagatcaaaaccgatgaagtcgtttgccctaagcaaattgcagcataggtcggcgtcgtcgtcctccatgggagtcgggaccccgagcgccgtccggcgctccctgcacgcaatagctaggcccgtctcgaactgaagcgccatcagtgagtcgcctggccaacataattttgccatcatgttgttgcatgtaccccgatatcacactagccttcccaaacgcgatcacataaaattggatccactaactactaataggcacatagcagccctgtaaacgccaccacatttcaccgattcctctcactactagccttgccttcgccttactttctcccttcctctctgtcgccatagaattggccgtgtaatggctgccacctccagccttccacggacagcttccgccgccaccaacggtgaaaacagttcaccacatccaggagcacatttcgacacctcaacatagccaacgtgttcctggatacactttccccaaggctccagaaagattcaggttaagaacatgacgaccaatcaaacaccccatgccaagcaacgtctgtccggaattttacggccactaatgcaatcacttagcattggtacactaccggatggtaaagacgttaatttctgatcaggcatgaagaaattgaagcaaacaaattataaggttaagatcaccatcaacctttgaaaaaacaactttgcataagcatctactacatccagcagcatgaaacataatgttcaaggtatcagactttggaagatacttaaatactaggccaaacggttcgtatttcaaaattcagctaacacctccactggtttcactaagacgaccacacttcaagccaggtgttcacttctttgccttcttaggtgccctgcatcattaggaagttgtggaccataaaacttctgaaaataagcaaacacgggttgaaatggaaggtgtcatgatacttacgctgcagtttgagcaggagctgccgctgcaggagctgctggctctcttgggccctgtttgcattcagagaagtattaaatcacatgatcagcaaataatcaaatattaatagccaggaaaatatactttgacaatgaaaaaattacttaagatttgacagaaaacatattgtaaaattgaaatgtgtcagtatgatgtgaggaaaacatcaattaacatatttcaatattgaatcatgagtgttactaactgaagaaaattaaactatagaaccataggcaaaaaaaatctcacctgagccaacctctcctccctcctggcaatcttcctctcacggcttgccttgctcttggcacgcttagcctcaaactggtcagagagtgtcttctctcttgccttctcagccttagacttgtggatactttccataagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctcccttgtacccctacgcttacctgcaaaataggaagaataaggaatatgcagacacacatgtttgcactaagataacagcaaacttaaatggacccaacgcaccatagccagagtgacgtcccttctgcttagcctcatgggctctccgtgctcgggacctggagtgaatcttctggggcttcttgatgatgaatccatccttgaccaacttacggatgttctgacctgcaagtaggaaggaacagaacatcagatagctttcccagcatttcaggaacgtgttatagaaatcaaagttcatcaccatgcaagcacatatacaagtcacagggaaataaaaccaagtatctagaacagcttttcaagacgatagtaaataattactagaccatcggaaatgagtatttatactccaaacagaacagaacatagactttgtttatgaaagtatgcacgatacccaacatagcatagcaaacaatatatcttataattagcacaacaaaacttgcaagtaaacaaaccacaatgcatacatttacacagtatcatactgcagttctacaaatggtgatgaacaatcgaaatgaaccgaatgaacttagatgttatagaattgtaatttcaacagacaaaggaatgttcccctattgataaccgtgtgggcattccctattaataatcctgtgtgcatgaattgcagtcttcatcctacctggcatatgtgacgaacaagaataagtaatacatcaagcatcacatatcatgtctatatcatgtctatttttcatctaatggaggataataagcacacacatccccagaacagcaccgtggatttgacagaacccctaagatcaatctaaaccctaaccctaagttccatgtataaatcatttctcgaaacttttctacctctatgcatccatcacaaaaacgaacctagaaaaactgcaacaggcaacggtttaagtcccatgaagcaacttcctccgcaactaaattaaacaacacactacctagaacacatcaaaactactccgactaagcgaaccaaacgaaactccacatcggaatcgccacggcaacagtttcgcgccgcagactagcactatagctccagatctaaaggaaatcacgcgcaacacaaactaccaatcgcacacaaagatgatatcaaacgggagttgaggggagttcttacgggagttggccatggagatctcgttgacctcattggggtcgagccagaccttgcccttgccgcacttgagcacgctggcggcgagccgcttctgcagcttgagggaaaccatctccgccgccgccgccgccgccttcgaggttcccttcctcctccctctccttacctgggtgggagtgtgtggtggaggcgcgagggggtgcaagggttggcgaggggcggcgcggagggcttatatagcccccctcctgtgatggggctagggtttcagcgcgagctggctgggctgggccgtcggcccatcagtggttggtgtaggttccaccgcccagaaggctcgagtgagtggagcgtgtcgctgtcggggatgggatgacgtggaggacttggatttgtcgccggctttttttttttgacgaggtttatttaggttttaacgaaaaagctttttgcggaatcatggagaagagaatagtctagcatactcctgagtgaattttctgaaactctggacgccggacatttgaagctttcataaatgagtaaactatattgatgatttgatggctccaatttctgtgagatacttaaaagttttttctgaaaaaaaaaatgaaaagagatacttaaaatgtactctctcttttgcattacagtatcaggatcagtgtgggttcagaagcgaagattagaaacttctctaacgtgcacattaaaacgaatggctcattaacagatcagtaattaagtattagttataaaaacttaaaaattgattaatatgtttttaaaactgtgacactgcgaagtgggccttcaaaattctaaatttagcacgggtattcacatttacggctaattttttttcagtgatagacaatacaatcatcgacaacgagacgtccgtggtaacttcattaatcttaagatatgcctagcctttcggatgtgctcatagatatatctagtcttctgaatgtgctcttagaaggttagcgtgtgcctttggttagcgtgcgcgtgttgtgagtgtctgcgttgtccttaaaaaaatttataatatttaacagtttgaaaagtgtgcacgtgaaaaataagaaagtagaagttgataacatgttttattttgttttgtattaaaaaggttgctatatttctcgtaatcttaaataagtttaacttttgaaagttataacgtcttaacatgaatcggagggagcatttagaagtgagcgtagattagtcaaggtgatatcgatgtagtagtagaccagtatgtcattttctgcccatgcctgtaactcatctaaactctaaattgtttgcaggattagtaactaatcggcagcataagttttggtacctcaggtgcattttactacacattgaaccacacctgcattttatactagcttatattcagaaaagtgaaacgacagacatagaaacatataatccttggttgtgtacatccactatggttgtagaggcaggtttaatctattttcttaaaaaataaacataatccaaatatatttcattcatttgttctcaagtcaaatgtgataatatttccacgggcatggttgctacattaacttattacatgcagattcgccattgggaaaaggatggcatgccctagaaataaaaagcatctacttcaatgaatcaaaatatactgtttactatttcagtaacaggaatggaatcttgttttctccggcaccatttgcagtgcaaaaacaaactcttcaatacgataaggaactgaagatgtaaatgtctggcttgctttatttacgggtgagctagagctaggaaatccacaggacaggaatacattagtcgctatcaatcagaaggaccaatcattttctctggaacaacaagctcatggaattctgattctgtcaatactccgaggtctagagcagcttcctggaaagatgaaaaagagataaaagatgaaaaagagatatgatccacaacagtaaatcacaaaaagattaaaagcgcacaacatcaacatattgcaatttatgttgatacactaatatgaatggcgaccaaaaagatcagcgcaaggggggaaatgatggttgtcctaaatctctatatgtagcaccttatcccaatagcatggatttatgccttagaatattgatggttctgacaatcaagccaaaatatgaaattatgtttgcacatatcaccttaaggctaacgcagaccattgcacatcagtttcgaatcaaaacaactaaaataaatggaataatcaccttcaatgtgcttccttctttgtgtgctttcttagcaacagctgcagcattgtcatagccaattttctgcatttattaaatagaattaagtatgcactcacgaaagcagatgtaatagaaaagataaatgtaaggctacaaaatggatgaatttcacttacagggttcaaagatgtcaccaacatcaaagactggaaaaaaaaggatacacaaattaatcaagcaaatttgttgaaaaattgtatatgcatttttttcctacagttcagt

SEQ ID NO: 26111 - DNA, 8199 bp, Oryza sativa
ttttttttccccttcacaccggattgttgccaacttctcttactgcggtttgctaattgctcccaacttgcgaaacagatgtttcacctgcatctccgcatcaccaaagtaaagctcaaaataagttgagcactgagcagcattaggctaagcatgaatcgatgaacaatataattcaactagttgtcaatcgtagtgatggaaaatcgataggcctttgtgttggacaatttgaactacagagcaaatgaaaggcaatggaagaaaatggaaactgcatggagtactatgttaatcaagtcaatggtatagaccttaaacttcacgagctaacaataatatttttatcaagggaaattcgacagataaaaaagtagccagaagaacgaaaacaagaaaagaaggtaacattacatcctgcttcttttttaggaaaaaaaacattttcaaatacaatatttatttcttaccgatacaaattgataatctcggggttacagatttgattagaatatatacttgctataaacaagtaggaactttcttacacctcaagtgataaccttacaagactaacaataaaataaaaatttgatcgcaaaacacagaaatcgcaaaagatgtgctcttcaggtattctacgctagacatggcttcctgcatctatcctcaagcagcagaatctacaacttctgccggtggggactagggagaaaggaatgcatcgaatagcctaggtatttcagtatctgatcccttttgcaacctcaaagaaatgggcaacattttcctcaggagtgcctaccttaatgccatgaccaaggttcaatacatgcccactattaccagctttctgcacagtgtcaaaaatccgcttgcttatgaactcttttgacccaaaaagaacgccagggtcaacattcccttgaaccgctatgttagatcccaatcttttcctcccctcagccatatcaaccgtccagtccaagctaacaacatcaacacctgtcagtggaagcctctccagcagtccaccagatccacttgcatatagtatcagaggcaattcaggatgtgtttctttgacactatccacaatctgcttcagataaggcaagctaaactcctcaaaatcaactgggctgagttctgtagcccatgagtcaaaaatttggacagcttgtgctccgttgtcagcttggtatttaatgtagttagccatggacgtagtaaatttctgtagcaaattatgcagaatctacaataatatagatattaagggcaaatttgcccacatgaacagataaatgaatggaaattaatctaaatatgactcccaaaatttcgatcataccaaacaataagcaagccaacaatgatagtgaacctcatatgcatcacgttaacaaaatataataacgccatttcatcatttgcaatactttatcagacaaagtcaagtataatattttaaaatccatgctaattacctaggactgtcagcaggctgcataaccttttttttttcagggaaggttgattaatattcagtattctatgtgctcacaatcagcgccattataaaagaagcaacaggcagttgtctataatggaagagaactcatgtactctttttatcagcaataggattgtgtcaatacctctggttctgagaaggccattttcttaatctttgaaaagttttttgatgaacctccttcaacacaataggatgccaatgtaaagggagctccaacaaagcccaacacggcagcttcattgttaacctgaggaaggaaacagtgggtgtcactccaatgaaataattagtacacaaaacaaagcacaaaaaatgatcatagattctagttaactatatatttgcagaattctgcaagtttaactaaataacttagtatacaattgtgctcgcaagcaactgttcactttgcatacacaggccaccaaatccaacagtagtacaatgggagtgttttgaaaaagcattgcaacgtcaactgctgatgtcatccctctccagcacaacctccccaaattgtagttcatatctcataaaacaaatatggaagaacactattgccatagaggcatggaatttcatctgtgctatacgatctgcactctccaatctccagaatatatcagccctgaatctaaaagtcagtaatggactaattgtttgatgctaaacaaggatcagaataatttatagtttttcaataaaatgccaaattccaagtaacagtggagccatgaagccaatccaaaagaatggaaatgagcttccaagttttagtgattacatttccatcttttaattaatctaaaatattgacttgacaaactccaagtaatgccattttgagaaaacagcacaaaaaatcagcattataaggtaattgatcaattagagtgtaacagttcaaagattgtaggctgacaaaggaagtgaaaataaatgatcagctactttttatgatgtaatgctctccaataggccatctatttccaatctccgaagttggattctgaaagtcaatactaacctcttcccgcaaaatgtttaaagcctgcccaacatatgggacccactcctctggaacaaattctctgacctcattcacagcagctgctgttctcaagggatcaaatatcactggaccttttcctttcacaatgtcaaaaggtatgttcatcccaggaagcggtgtaaggatatctgagaacaggataacctggcaaaatcaaattaaaaacaacagcatcagaggagatagcatcaataacagagcattagatattataggcaaacaacatctcaaatccacgtaagcttcttttctcattttttttcatgcaaaagcttcttagatagccacaaaagaggaattacaaacaacatacagaaagggccaaaatctgcagcttactccatcgggcttgaaaaccttccatggttgtagagagatctcaacaacaaggtcaacattttctgatctttcacggaatgaaggatgtcgctcgcagagcaattgatagctctgttaaaaaaaagaacggcaagaagttggtaaggaaaaagggtcctgattgtaaggattgttgcaacacgaaaataaagtattacttcaaagaatgggcatttgtcacgattcaaacaactggagcttgctattaagtattgtataccatggaataaactgtttcatgtttaccgatgcctgcattaatgttctattgattcatttgttttctgtaaacttaccccactttaatgaatccgacgactgtacaagaaaaagagaaaattgtgcataagggaggttccagtaataggatagtttatgagtggtcactaagtttgaaaaaaaaatcaggaagttgatgtttgtcaatttctagcagttaccgagatatggtccacatcttacttgaaacgcgataacaattgcaagcaaattggaacatcttcctctagttgcacatttggatgcaaattactctgcaatgcaggagaaaaaaaacgaattagagtaaacctgccttcatgtacctcccggcctgcctcatgagccagaccggcggtctctcgaccttcctccccttgatcgcgctcaccagcagcggctcctccgccgtcccgaccgccgccgtctccgccataacctctgaaaaacacaaccaccccccggaacgagaccatccccaaacccatcaccaatcaaactccgcctcaatctggtgtaaacaaacaaacgatacagtggatttacggcaggcgctgacctccgacggcgctgcagcggacggcgggcggcgggcggcgcgcgcgcgcggacctccccgagaggtaggccggctgcagcgagagcggcgggcacgcggtcgccattgcaggagggatccgagctgcttctgctgctgctgtgctgccggattggggtgggcagcgtctcggcgagagacgacctggcaaagcaaagctaaatggaaatcggaaatggatgggtaggtggggcccacttggatttcaggatcaggtgagccgcggccgcagatgtgcggacgagatcgacgatggttatgggccctcgtggtccccgcatcggcccacgtatggactgggccgaggaatttctcatgcaggccgccaggccggcgaatttctcagaaatttggcaaaaattgagcactttctcgtcggatgcggtcgaatttacagcaaaaggatgaccaaacatgtaaacctacacagcagctttgagttgagcacctactgtacttctgtatcacacaattcagacgaggaaaaaaaaggaaaagaaaagaaaagaaaaggaagtaattaaacacgttgttttgggtgaccatatcatagcacgtagaccatgccgacctcgagcagcgacgccggcgggacgcggagggcgacgtcggggccgcggcagttgcggcggaggaagttgtagccgacgtcgacggcgagcctcttgagcagcgacgacccgggcttgcactgcacgtgggagtggcccaggatgaaggccgtgccggcgtccctcgccgccgccagcgcctccagctcctccgccacctgcttgttgtccgccgcctccgggctcgccacgtggctgtcgatgaagaaccgcacctgcttcgcccgcccgccgccgccgccggggctcccgtcgtcgtcgccgccgccgcttcgtcggcgcgtcgtcgtcgtctccacggacgccgccgacgagtgctggacgctgtcctggatgtcgtagctggcgtggctgctcccgatcacggcgagccgcgtcccccgctcctcctccggttcgtgatcgccgccgccgccgctcgcgtcgctgcaccggtacgaggcgtcgagcttgatgaaggtggcgaggctctcgacgagctccgtctcgaacgagtccacgtcctggtgcacgtcgcggtagccgtagcgcacgatgcaccggtaggagcggtggcccggcgggccgacgcggccgatgaggtagcgctcggcggggaacacgtacggcaccggcaccgacttgacgcagacgaacaccagcacctggtggaacgccgggaggttggtgacgaagcgggagaagttggccggcacgccggaggtgaggtcggtgtagacgaggccgatgccggggacgcgcaccatgccgagcttgtcgccgagggcgagcagccactccagggtgaccttgttgtgcaggtcgaactcgtacttcttgatggtggtgtagtgccacaccagcatgacggccatgaggaagagcgccagcaggatgggcagccacgcgccctccaggaacttgatgagcgacgccgagaagtagagcgcctccacggagccgaagaagaggaggaagcacagcgccagcaccggcggcctgcgccagcacagcatgatcaccagggacgtcaggcaggtggtcaccagcatcactgtgatcacagccaaccctgcaggaaaaacaaacttgtcacagtaatctgataccccttttttttttataataccagtatgtatttctgttctttttctggatgacaatgttgcagtgtgcagtgttgcatttgctctgcagctaaaaagggttgcatgatttgcactgcaaattttctacagctaaaagagtagagacccaaaaaagcaactaaaaatatggtatttttgtgcataacaccctagctgtcaagtgatcaattcagaaatatttcaaaagaattcaaggaatttcagtcaaataattactctagccatcagattgtaaaattttgatgcatgggactttcactagtgctggtattgacaacaagtatgaaactacaaagtaattgtgagtagttttttcttaccagaggcgttccccatgtgctttgtgtctctaaatccaacagtcacagcaatgcagaggatcatgagcaaccaattaatctcagggatatatatttggccatgaattttatcagacgtgtgtacgactttcactcgagggaaacaacttaaggactggctctggttgatgattgagaatgttccgctgatgatcgcttggcttccgaccactgaagctaaaatcgccagtacaagcacaggccatctcaccttatctgtagtttgattataaatatatgcaagtttattttttttccaaaggaatagaatgttctaacattaaagttgttaacactagttccatcatagcttacaagtatcatgatctgcaaagccaagatatacctggaactgcgatgtaaaatccaacttgggagttcgagtaaaagtcatgatgctttgataagtaagccgcttgacccatgtatgccagaatgagagcggggtacactaaagaagtgaaagcaagctgtgataaattaaatgattagcagtttagtgcataaggttactacagaatgtgttatggagagattttcttgcaggatcaccaaattacctggatcgcactatatgagaagtgtccaagatcagcaaacattgcttccgatcctgcatcgtcagtcgagctagatagttagctgaatttcctttattcaacatttcaaaggaaagacaacttattttcttttcaaaaagaaaaaaagaaataaacttctaaattatgtttacattatacaactcagatttttagaagcatattgtagctcacctgtcatgcagagtaaaatcccaccaagtgacatccaaccatattttcttgtcttttttaagaacttgaacatgtaacagggatttagagcttggtagacatgaggattccaatgtataatattataaagtccaagagcactcatacagattagccaggctagaactatcggggcaaagagaaatccaacccgatgagtaccgtaatgctgcagagcaaacaggaatgctaatatgacgcaggtaatcggaataacagcatctgcatgacaaggggatcaattatcagggccaaacaggaggtttgaactggaaaaagaaggccaaatgtcattgcagaataaatagaagtgtttttggcccaacagcaggatactggcttccatttgtcaataagaacttgtgattcagtagttggttttgttatgatctagatgctggccattttatcaacattctcggctcgatattaagttgctgtcagctgagcttaccaaacgggcatagaaaagaccaagtttctaaaatttggtagcttgtggtcactcagtcacctcggtacctcaactatagagactttctatctactaaagcgtggatgtacacagtacaccactcattaaattagagtcattttgaactcgaatttgagggcctcaggtaactgctagaaactagagttgctcatatgttttttaagcttttgcacttcacctaaaaaattagatatgaatatacaagcatgtaacacatacagtttttatgtatataggctcgagaactaagcaaataatgttccttgctttagagtagctacattgtccgtatgaacttaaatgagctgagcctagtgccaacatgcttttctctgccaccaataaacttaatcggggacatgggaactagattaatcctttttgcttgcaatcagtgtcttttgttgatcataaactaaatccaaacatctagcaacgatagggaaaatgactttttacaagaaaataacttggaaacttacattcacggtggtctttggacaaggagaattcaagacctgaaactgccgagaacactgagagatatgaaagattgaggggaaagtgagcatccggtcatcaaatctgtggaaaacagacaagcagccctaagaaaagaagctgaggataccggatatagctggcgtgagaacaccgtccccaatcaccatgcatgtaccaatcaaaaccatgatcagcagggcggtatgcagcttcttgtgcttctcaagccagaccttgatgcaggacttatcggttctctcagaagagcattccaatttgtaagtggaaagctcctcatcagcaatttgcctattaggaagaaggctcacattggcatgccggcaaattagcgagtacagagcaaaagttcctcctgcaagaacgcgaaacttgcaaacttaaacgcttcgcgagcaaagcaagcacaattggtcatgcctacta

SEQ ID NO: 26112 - DNA, 5039 bp, Oryza sativa
cccctcagccaccgcccgcctctatcatggacgtcaagagtggcctccgccaccacctgccgccatcccgccgccccaagctccgtccgcccccgccgccgttcgttccacgcgcgccgccgcctctccgccatggccaccgccatacgcaccgacgcttccgcctcgtatgcgtcaccctcatcccccgccgtcgccgccttcgtgtcacccgccaccgccgccgctgctctgtcccccgcccgccgcccgtgagagagagaagagatagaggaggagagagaggaagagtgaagaggagtatgacaagtgggtcccacaaattttttataaatagaatgttgactggactgccatgaatacgccacgtaaacctaaaccaccgcagattgggtcgaggggggtaattcgtccagtttgtatagttgggggtgaagaatactaatgtgttcggggggagggggttagtcgtactttttcatttccggctttcatatagggagttgctataagacatttgacagttttgtaaaaacttccaaacgtaactagctgaagtataattagatcataataacttatatgtaattgcctaattcgtacccccatgcactcttgttcccaaggttgcggcttagaaccccatcggtgcatgtcacaatagatgactcccttgcacgaatctcaatgtcatgcaacgatccacaaaattgaaagttttaaaagaaaaaccgttaatagttttttttagctaatccatttcatacatgacgaacctatactaatataaaaaacatcagttcatcgaactcaaatgtttttttatccttatatttgttcatccaacggtccatagagttggatttacccctcaattagcgatccccatctcaagtacgcagcagttagcgcaaaaataaaagaaaacaattagtctcccacgtctaaacagcagttaggatcggtcaaagcaaaaaaaaaaaaaaaaaaggaacgctcccttttgtgcgccagcccgccgccgcctcctcccgccggagccgctcagctcctcctagcgcgcgccagcccgctgccgccgcctcccgccggagctgctcgcctccttcacgtgctcgcccgccggagccgcctcaccctacccaccgctgcctgcttccctgctcgcgccgcgccgtgatggagaggaaagagaggcggggtctgctcgccctaccccgccgcctcctcgcgtgcgcaggccggacatccaggcgtcgccgccggaaaggggatatgaggtggcggagattcttgctaggaggaggagagggggccattggaggagggctagaggtcgctgcgcatggcccgtgggcggtggagagatgaagccaggaggacgtcagcgtcggcgaggttgactgggcaagaggcgagcgtcaacagacgttccagggaggagcagtccgctggcgcggtcgcatgagagggtgccgaccggaggcagagccgaggacccctaggaccgcacccgcgccaccactgctgccatcgtcaacatcctatatgatttttcgttgttgttgttatcagggatgcgctggaacaagggcacaggaccagggccgctggacatcatcgatgctagcagataaggacaccaacaacagttgaggttgatgttccatattcatgcttgcaatgtgtttgatgaaatgtttaactagcactagcatcatctcttgtttacaatttgactatttgtattgatgtcatactaaccaaatttcaggttgattgtttactgctttcaaattaacaattcaatggttcttgatgtgttctacttaacctttgcatttgtagtagtgtaattctgaaggtacaaaacactatttctactgaacttcgtcaatttaagcaaaacttttgaacatatggtcatccattgaggctcccgcaattccagtttgcatgttctgccaccattttggatcatattttccatgcttatggaaggacttaatgaactgaagtagtttgtgttggcagtgatctccattggatatcccgtctcttcagccggtcgtcaatgatacaaccaggtcacgcatgaggtagcagtccactccaacccacctactgaagacttgtctcatttggtttgattgatgcgtggagtgaggcacatgctgtccagatcaaggtacaggcaagtcggtttcttgcacttaattttttttcatgctatttgtgaatgttggggatttctattcatggagaaacaatgtttttattttccttttatcagtgtcatagcgttcttcaaatccagggtagtattatacggattttatctattttgcatacattgtgcctgtaaatttttgcatgaaaatgtatccaagagcacaagtaatttcgagtgtagtaaattagtacaggtttctcttgagaaataaaatcttttctctcaagaagtccaatattagaatgtctacttagataaatgtgtgttttcttagaaaaaagttaatttgtaatatagtagtaaaatcaattaggattgtcaagtcaaggcataatagtaagatttagttcgcacagctagccctcttaatttctattagtgccacctacttcttaatttcttacgctgatgtctgacaaaattctgtttggttcctttctgcagtagaacatcagcttatgagatctgaaagcaacaaaagggtaccaattttacacccatgtaaaatccagtgatttcagtccattctttgtggctattttcatactgcatcttggcatttgctatccgtttaatatgcttggcaaatgaacttgaattagtacaagtggatctttagatttgtatgtagaaggtcgagatgtttgcaaatgacatatgagttgagttgagtgatctagaatttagttcctatagtggaatatggatagctccagaaattgatttttttagtccatttattttaagctctactatttgttaagtttattctcaaaatatttaatttatagtattatccacaataattggagggcaaaactgaccaaattaaagttgccatatgttcatctggagtctgaaagctggccttggtctgcttcattttggtgttgttgtgactccaaccggtgaccggagcccgtactcaccgctagctaccatccccaacctgccccaatctttctccaggttatgttgctagcacttgatctgtacacgctgtgggataattgcttgttgacaaggaagatcaaatcctgatggtggaagaatggcaccccctgtgctccagctaacaatctgattagtttcctagatgcttgattattgattttatgtgtgatcattttattttgtttttgtatcagggctgcatagagtataaaagctttgcccccctatgcttgcactgagagactcttccgtagctgtcatcgcatatagtgttgcaagtatgttctctattatctcaatgtgattgcacgggtagcatatgtattctcactaactgctcttacactaacaatgatgaatcagactagcagagagagtttccaagcaaatttgatggcacatgtccacgaattgtgatttttaatagtttgcattataaatgctcatctttgtcctgcctcctttttcccttaaatttatttacatggtgtggcaggcagtatcctaaacacttaaaagtaggactcactaaattgaagaaaaaacaaatagctctaccttgcttatgatggtccttcatattggagcacatcttccatgggtctgtagcagctcatcctgctcaaggttgactataagttttggtcagtgaaggggatgtaattagtaatggaattagaacacaggtaacactcgagttaattagtgctttgcttgcagtttcaatgcttacaccacaatttcattctctgcaattacattcacattttaagcttggttttcttctctactcccaatcaccaaactcgttttttttaatgaaaacacaacttggtatttgcaagttttctatctgttttttgcaataggaaaactgttacatgttctagacaaaaatatcataacaagcttatggatgaactttgacaggttccttgacgaaatttgaagatgtaacccgccacccatgtttcgcagccatcgcccatggacttgccaagtttctggtggtgcccattgtggatgaaattactgattgcctgaagtactcaaagtttcatgagtataacaaagattacagcttgggtatctgtaaagtggttatgttgagataaaaggacaataatttgagatttctgtttacatctcaaatgttccatttaatttttttacgctactttataacttcgcctttcagtttaaatctcataatatgcattgtttcttttatccaggattgaatcttctagcctctacaaaactgaattcatatttctttcctcttcattgttagtgtaaacaatactcttcaatatatgttgacgtgcctggcatgtgcacgttaactagtatccaaactatgagagcaagggtggcattggcaaactgccaaccaggcaaccatgtattcagcttcctgcgaacctggaaataaatgtgtcgtgcaaataaatgtatccattccaaattgtaaggatttatattttttaggttctttagcaaatattatggttaggtcaaacgatttttttgaatccattttagttgtggattttaaaattttgaattgcttggattcctcaatgaagaattgtgtttggaatccttaaagtgatgggaattatgagaatgggagtatttcttttcttttccttttttttaaacaaacgtacatccaaggtaatgaaacgattcctcagtcttaacgttcataacacccgctggcaaaaaaaaaagagagtaaatttcacaaaactacatgttttatggttcaaattgcagaaaacattttatgttttatgtttttttacacattttgacacttggcactcaagtacatatgttttggtag

SEQ ID NO: 26113 - DNA, 9335 bp, Oryza sativa
caccgagaccgtccggccttctcggcaccgtgggctggggctgggaggcggggctcgatcggtcggatcagaagccgcagaagtccttgtcgctgggctggcccggcttgccgatctgcgtgcagccctgggtgcaggcgtcggcgcagtcgaacttgttgggcgccgcgcccagcgtcatgcactggttcttcatgcagtcgcagaagcagtccagctcgccggcgtcgccggtcgtctcctccccctccgcgccagcgcccaccgccgctgccgccaccaccgccgcgaccagcagcagcgccgccgccgcggctctcctcgacgccattgcgatcccggttgattctcccgtcgtgatcggatcggatcgatccggcaggtttaattggggaaggcttgtgttgggccatggcggaggggggctattatgtgttggcatttcagctgggcctacctattcttgggcatttggaaccattggtcaggagtgaagcttccaagggaggcaaatcaccgtaggccggcgttagcaaagccgcgacaaaatcatgggcacgcacacacttggttgcaccgcgattcacgcacgtacgcgtgcgtggaaatcgtgcgtgcaaccctttcaacacgcgcgtgcgtacgtacgctcttgcacgatcgggacaaaccgctggtaggtactatagcatatctgcatatgcattgcttgcagaggtagagccgggaaaaaaacgcgtcccgtcgtgtccgggttaagcttggcctgatggcctccatccatctgcagatcgatcgatctgtcccggcaggcaggccgtcgtgacagtgtaggctcgctcgcgcgctctcccggcaagtcgatctcggcctatacaaatgtagtacaaattatcgggataaatggaccggaaaatcgaaccgaaacgtactctcggctcgtcgccaacgatcgagcagccgcgacgcgcccacttccaccgcgcagccgcacgcgagcaaaatcttctctccggcgctagctgtcgcgacgcggcggccggcgaatccgcctcgttgtctggctagcgcgcgccgatcgagacaaggcggccgctttgattcgggggattgggtgattggaccctgtcgtctgcaatctgcatgcgtgttggtgggcacggccggtggcatacgtactccctcggtcaaaaaaaaaaaaaaagacaaactctgtttccgtgtccaatatttgaccgtccgtttcatttaaaaaatttataaaaaaaattaaaaagacaagtcgcgcataaaatattaatcatattttatcatctaacaacaatgaaaatacgaattataaaaaaatttcatataaaacggacagtcaaagttggatacggaaacccatagtttaccattttttgagacggatggagggagtacggggcaccgtggcaaacatggcgccttcacggaaagctaagcatgcacggttttttttcttttctttttcacgctggagattatcatgtccctagctagtaccccttcccatcatggatggaccgatggagtacgcgtacttgtggggtacgaatctggatgacatcccgattggtctctccatcatctgggaggacggaaggcgcacgtacgtacacagtcagtacacatcgatctctatatcgattgagagattttttttctgtttgttttggagaagtgaaatgatcgagagatcatcgatcgtgcgcgctgacgacttctctcttacgagcaggaggacggacggacgcagggtgcacccaacgatcccgtcgcgtcatccttgccggccggtcgcgaccaatgggcaaattatacccatcgattgatggagcacgtacctaattacgtacgtgtatctaagcgctgtgctgtgcttgtgcctgactgcctggccgtgtatgaccagtgacatgcgtgttatgtcgacatccgcatcatatccgtgatgttgggtgctggtgtgatgttatgttgtggacttgtgttatcagtgcttaccccatgcaccctccattcctccaaacatactatggaataatggattattgtttcatgaggcagttgtaataagccgatgtattgccatttctaacaggcgattgtcttagacgcctgcatctaaacatttcccagaggtgatttgtgaccatgatcacattgatttattgcacaggcgaatcatttttctgacagccagttacactgatatagggagtgtttgaaaatcgtttttttttaagtagcatgctttgtcgaatttacaatgcaatttttcaaaagaaatatatgttttggtctaagtcaatatagtttgatggaaaatccctaaggcgggccttaaaacctcctgggccgagtttattagggccagcctaataaatgtattggccatataaaaaaaataagtgaggccatatacgacttttttttcttttttcttttctaaactcttatagctaattttgatgtccattggatccagttctatcaatctaaaccaatggctctattccttataaattggacccccccccctttcgaaccctagtcccttctccattcctcccctcttagacaccgccgctgtcaccataccaaaccctccgcctctagcaaggtcgttcactatcccttcgctctagccacctctccggcaagccatcttatgcttcccttcatcttgttgggtgagggtcccttgtcccatcatcttggttggcgttatcaaattctccatcgttgattcttgttgtcctcgctaattctatcacctataatttttcttttttgtagatctatcaatgcttgctttgccaatcgatgacgatcaccacccatagtccggtaaggtacctcatgccatcctcctcatctttgataacactggtaggttcaacaccgctggttcttgttgtcctcactaattctatcagctaccgcttgcttttgtttttgtttatagatccagtcatgcccatctcgctattgcacgaccacaacggaccatagtctagtaaggcctctcataccaccctcttcctcatcttcaatagcagtattagattcagctccaccaattcttgttttccttgataattctatcacccatcgcttgctcctttttctacagatctagcagtaacccacttcaccgtccacgaccaccaccgcgtagtgctccagtctggtaaggctccttgttccatcttcttcctcatcttgaaaatattttgggatccaacaccgccgacttttcgttttgttgttatcctcgttaattctatcctcaattgctcgctttctgatatttttaatagatccaatagccccaactcaccgttccacgcctattggcacccgtaacttggtaacgcctctggttacatcgtatatcttattttagcaacatcgttagatccaacaccacttgttctcgttgtcctcgctaatcatgtcatctatagcttgcctttttttttctatccaatagttcctaccttaccgctcgacagctcgacagacatcgtcgctcatagctagattgctattctgtgatgccccacacttttaccgctatagataaaagtgcaagattgtgaactattaataaagtattgttttatccaataataacccaccatgagatatcgcaatggagaaacaggtagaactacttttaatccatccctacaagtctgaaggccatctctattccatcttatccttgcaaagacatatacaagaggaattatataacaacggtgagcgcatccgtactcagcaagtcattagtaacaaaatataaatgcataaacaataatttatttatcaatttatattctataccatacctttcgtaccatcatcaccttcacttttcatcaaaagtctatatctatcttgtacaagggttttcaaaaagaagatttttgaaaaaactaaaatacactcgtaacattgagtaaagtttacatcaacttcccgtagcctccaatctaggacgtgagtcacaatttaatagagcattgcgcatgcttgtatcattgtactcatatacactctagatattactgtacatattccctcaatcttcctatgaatcaaggggtcattgatgaaatctacgtgaccatgaatcgtgatatctgatttaaggcttattttggggagtttaagattttgagaagcaactggttggtagccagcttttgagaatctggaaaagctgggttttccagcttttggtttttagttctttttttggattctacaactacagtttgatataatcttaaccaaaagctaaactgtttgggggagttttgattctgggagaagctgtagcagcttcttagtggccaccgcttcctcccaatcgcagctaaagagaaaagggggacaatgttgcccgaggacgaacatgttttttaattgactagtaataaaatatctatttttttaactagtctctattcgcacatgtgagaaattcacctcttattcctactcaaggatttcactaaacagtttttgcaacgcttgcagtataaaactttcctccatcgcaagctttttgccaaggtgatcaccagctgagcctgtaagcgcacgcccacacaaacactctggtctgtgtctctgccgcgcaccagagcgtggtgggtgtgtctcttgtctcccgcgcccccagcccacgcacgccacgcgatgccagcctcctcctcctcctcccgctggtcatggttgcacaagctgaagctgcggaggaggaggaagaagaagagcaagcgggcgagccccgcgtcaacggcccgaccctccgacgcgtccgccgtccccccggcggcgccacgccagccaccggcggcggcggcgccggccggcggcctgagcccgtgctgctgctactgccccaacagggagtcgtactacctcaacagcgccgaccgcgcgcgccaggaggacaggcaggacatgttgctcccgtgcgacgacgaggtggaggaggaggaggctctcgacgtcggcgtcgacgtggtccaccgccgggccgacggcctcgacgcgccgccagcgacgccggagctcaagctgaggcccatcgtcacgagccggcggcacgccgccgccggcaagaacgaggcgtcggacagctcaagcacctcggcggccacgacgccgtctaccagggcgcgggggttccacgtgagaccgaccgccgccagcaggaggctgcgccgcgtcggcagcagcggcggcggccacgacagcaacaatgccggcacaccggtgtcggcgccggcgccggcgtcgtcgtcgtcgtcggtgagcgcggggaggccgagccggcggccgcggcggcggcggatgtggctgcgggagagcgaggcggtggtgttggagtcgacggagccggagctggagctggtggacagcatgatcgagatgctgtgcaccaatggcgtccgtcggctggaggacctgcaggacctcctcgcctgctacctctcgctcaacgccgccgagcaccaccgcaccatcgtcgcgctcttccgccgcgtcgtcctcgtctggatccacctcggcagccagaggcttcttcccgccagtgatcaaaccagctcagtgaatccattgctcaactcgatgcatgcatggtgatcgatcatggcgtgctcaattgatcaattcttcatggttacttccatccgagtgatgactgatcaactcgtcatcagttactgttaatttctgttcttgacttcttgtacattcttgagacatggcgcttgtgttaaaagagatcgggttgcttgtcaggttaagtaaactaaacatagttttcttttctctttcgttaacctgtctctgttacgtttctgtactgtgtttttacggttggtgtttgtggttttgtgaggttgttggagagaatagaaagcgggcgcagcgcaggatgtgcgcaacccactttggcgtcaaaagcgagatagatcttagatgccgcctttacagctcgattggctggacaggaaagcaatagggggaattcctcgctgttcgtctctcgtcgccggtggaaattatttccacgcgtgtcattcggtgtcatttgggatttgggaatgataatatcagaatggaagcctgcggtttttacctcaggtattctccccattccaaaatagattattttttttatttttgcacagatcaggacataggctatgttggtgtaggtgttagttgaaaaaaaaaatcagggcatcacctatcactcccattaaaattctagttatagattgttcagaactagggttgtacttttttccctttgatgaacgaattatttttggacttgaaattttggggttgttagatgcatattgcatcaatgctttgtttctttttttttccagaactttttacatagccaaaaaaaaccatgatccatttatgtggaaagtggaagtgtacttgtagcaggatatctccttcaaaatgtagaatccattcatgtggtttgcacaacagtaaagaaatcacatgtaatttaattgtcatcactacaattaggagccatagaattttgtataaaattaggtaaattcaggaaacacagcaaaatgagaccaactaccacttcccaagaaaaaaatgttggtcattgaaaattcacattgggatctttgcagagtagaagatttacattcttattgtaaatccacatgctccacgcctccaccccctttttcttaatggggagctcatatgtttggtaattcatcatgttgtctctaggttgttttttttaaaaaaaatcaatttttttgttgttcttgcaaggtattaagaggtagagatatctcgcggtaccaaccaagtcgaagatatctcataatgttaattttgtaagctttcaagggccgttaagaacctttggtctgattggcgcttgccaaaatttggaagtgtagagtcgcttcaatcacttgcttggtttcctaccaattagatcaaagatccgaaagatttgcattactacgaaataaatttaccaaatattgatataatccaaatggattgccaaatacctttcaaacaaagaaataattagtagcgaaccaaaccagctctttaattttaccgattgttcctacacatcaacatcaacatcaaacaatggtgtagccaagtaaggccaaaagtaaacaccgattttcagaaaaagttctgttcaccacccaagaatacctcatgcacctcctaggaaagttggaatagaagtgaaatgagctaaaaccatttatcttggacctcggataggctggcaacccaaggatggccgaatggccacatgtgtcccctctgccatcggactcaggagacgggtgtgcatctactagcaagttgtaggtacactagaaggctttgggtgtcgctagcaatctggacggcttgcgacctactaaaccccaaccactggtgacatgcttcgacagttatagaatggtgggagaacacagcaaacacaataggagctccgaaaaaggcgatgcacaccctaacgctgttagtggcctgggagatatggaatgaaagaaaccgcagaaacttccaacacgaagagcttccgatggccagcttgctgacaaaggtcaaggagaaggccaaaacttgggccttggcgggcacgagaagtctccgcgattggcttaatttttagttatcccagaccaaaggtccagtgcatgtacaacttctttcttttgtacaatttactcctatattcaatgaaattggcggctcgctgattcgtttaaaaaaaacatttaacttcattctccattctctgctagtactactcttctactggcagagcctctctacattctgaacactttcgtgcctccgcttgccactcacctctcacaaaaatgtgccgctttccaaaccgaagcagccaacacatccacatcaatccacccctccagcttcaatttaagaaagatataatgccaatgttgaactgccattctctatttctctccacacattattgatgtatatatgaaccgattttctgacggaatgattcatgcaaaattcctatttataaatgagcgtttagttgtagcttcttacatataaaccgtggccaccaaagtgatgtggttttattgtctttgagaaggtatacagggtaccacaatttataatgcaaatttttatacttctcccatatacaactttgctatgattacacaagagaagcgtatgtgcacatatcactgtatacgcacaccaccagcgaatgaggccctaaggacaaaacatatgctcaaagatataaaaccatgcagtaaatctctaacctcaattatccttgggcaccaggttaaaggactttaaccttgatgaatagggccatgcacccatgatacaattgccactccttgctctagatctagcccgattcatcttcatgatagttggagccgccgatggctatagccaggtgtgtcgttgtcctttgtctttggccttatgagctcgaggcaggatgcgcacatcggcatcagctcatgtgcttatcacctccaccaggacaacctactttctcttataggtaccaggtgcaacattctctcaccatggatcacctctttttcccttaagccacccatatccttttcaagccactatgccacactacaaaccactcactcctcccccctcgtccgcttgctttgtcctacacggcagatcactgctggcgtggagccgtgagaactgaggagtgttgtaaggtcattcacagtccgtagatgtggcattcagcgccagggtgccagtgaggagattcccctccatgcgagtataggtcatgcaataagcaaacccctcaaacccccacgaagatgcatgagcctcgccagggcgtgttagggtgaagtatgtgacgtgcggggcgatggcttgaagccacgttggggaggttgtgccctcgcgatgcccatatcacaccacggcgtctcgctgacctctagtggccagagaagaagctccagatcattgaggaagaggaagatgaaaactcacctcgccactctagatccatacaaccgcccacgcgcgtcgccatcaaggtcatcgccccgatatgccacctatgtgggctccgaattggagcttggttcacagccccaccgttgagcttgttcgtcgtcccgccgcttgatcccactgccaccgagctccatctgcatcgtcgaagatcaattcgcccccatcggagctcgatc

SEQ ID NO: 26114 - DNA, 923 bp, Oryza sativa
gttcaggtttgctatcaggtccaggcatagaaactgagggttgaaactaaacaagctctgaataccctgatagaagggacatcccttctgagattttctgaagagataaagagcgtgttagggcatgtactatggagaccactactataagtggtctcaagtcaccggtggaagcgctcccgttccccttcactgctgcgcgctactcttccctttcttcgcctctccctcctctctgcccgctcgagctcgcgccgcctccccttcttcagtcaccattgtcgacgaggagtggcccgtccagctcgtggtggtgaagaaatctccggcatcgaatttcgtacttccgtgtggcagagggcgacgagatcggtgacgctcgagctcgagctctccggcgcggatccggcatcatgctcgctggatctggcgagctcaagcgccaaaaaggtccacaaatccggcgtcatgctcaccggatctagtcgagccgtagccgtcggcggtgtcttcgcggaggtggcgtcgatatgttcggagccactaccgtcggcacggattgagctggcttccactgccaagctcctctcctccctccctagcggtgcgggccacgacgaggcatgggccaactgtggcggcgatgaccaccagctcggcaactcgtcggtggcctccatttcccctttgttttcctctacaacttcctggagcacataaatcgtattctttctcctagaaccatcgttcaatcaccatttcctctgtaggcccctctgccaccctgcgagaccactccaaacctccagcgtagcatccgaacctatgaacttgagaccactggtctgaggcaccgcgttgtacataacctcaaagaaacagcaagctagggtatcaaggaaaaaaaaggtccggcaaaaaaa

SEQ ID NO: 26115 - DNA, 1279 bp, Oryza sativa
atttacttctgcaaattattcccataccaaactaattcagttgtgtgccttcttgcttgcagtaaggaggtgctccatgtaaggactttggagttgctggcatagcagagaattgaatgactctgcttttctaagtgcaagcaattgtgttctttgggttttatactaattctcaaacttgatgatattgggctggtcgcctctatatttgctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaagttaccatgtggacttattttttgttaggctcatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagttccatccatgcccatgacaggagccacttatccgaccaattcaagaccagcacataatttaactcgcctgcttatgtggacaaccatgaattgattgataatccctgtcaaattcaggacttgacccgcctgtaattcaagtggaataatcgagtctattggcatgacaattttgctcccaggtatagaaacaccatataggagtattgagcataaattttaagagtaactttacaggatgccgcactaaaatttgaagagtaactttactgaaacatacaatacatgaccggcaggagttctggtgtcgccgctccacatgtcaacgcacgtgcaagtcacgtgctgattaaagccctataggggctttacatccaacgataggattatattatccggaagctatgtgaatgcaatgccctctccaaaaaaaaatgaaaagaaaagaatagaaagaaaaatgcaatgctgtgccacaactatgggcaaacccagatatgttcgccaagaggaaactcttctaatatatgaaaacttcttacagtcaatattctgttcggtagataaggaggatttgcgaagcacggcaaaattcagacaggtccattccatggcgatgcatggaat

SEQ ID NO: 26116 - DNA, 521 bp, Oryza sativa
gcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaacgttgggcacggatatccatagttgcacttattttgggacgaaggtagtagtttgattggacagctccatccatccagtagaactcttggttgcacaatcaagaaaagaacatagcccgatagatccaacaga

SEQ ID NO: 26117 - DNA, 556 bp, Oryza sativa
tctcaaaccgtgtcattaacattttgcataagttttagttcatcagataactactttgcacactgagtctcagacatcaaatttgacaaggagctgaactaacagatcattaatttccgtgaaagcaaacaattctctcactgacagaacagctgaaagattaaaaaagagaacagtgacaaaataagtatataaccaaataaaggagcgacagcgaagaacttatatgagatgttagtgtagacgctggaagcggaacaagttgacgtcttcacacttatcaacacaaaactgtgtaggatgcaaaagattatgcagaggcgctagaataaggcccatatcaatccaagatgaaacctgcacagcaggttacaaggttgatcagatcgatgagtcaagcagtgcgtgcattttaccaaacagaaagtaatcgggtatgagttgaaaaggggcatgtttgtacctgtaccttggatattagtactttctgtcttggatgatcggaatggttcctcttagcttacggcactgtctctttgagctctcgtttttgctc

SEQ ID NO: 26118 - DNA, 3113 bp, Oryza sativa
aattgtattgaacaattagttgttttaaccatttccgcaaccgctggaaaacgagtggtgactacaattatgtttccctttgattgtgcttttttgaggggtgctaatagctgcttccactcatcctcataaaccaaattccatatatcatccaggacaagcaaaaatctctttgatttcaacctttgctcaatcaaatcatccggccaaccagagttctcttcattgacttttggtatcgacttggcaatctcctctttcaatctatacacattgaaattgagagagacacaaacccaaatattaacatcaaaatggttttgtacttctttgtatatttgctgagtgagagttgtctttcctatccctcctggaccaacaattggaatgacggttaggtccacgtcacagtaatcaccctcaataacgtcattgataattgtacttttctaccctccctcccataaaatttaggttctatgaaatctgaagtggtcacaggacgattcatagcaatgctgcttggaagaacaactgcatgccccattttcccagagaactcagaattcagactcattgcaatgcactggccaatgctgcggtttgattccagcaactccaggttaaggatggtggcgaccttggcacagactggttttagctgctcgacgatgtgcttcattcttgtcgacagatccaccctatcaaacttcagctttggtgttttcgtggtgtgctctatgtgcaatgctttgcagggataagcgcagcagaggaaccggcttctttctgtagaaatgtttcaacggtgatgaaggtgtcacagccgtcatgttcagttacaaaagagaggcgtggaaggtgttttatattatcgatgagatagatagtaagtagtacctcgagcattggaaaagagcttgtgaatacagccgctgcctgcaagtgcttcctcatcattggcatggcgactctcttccccattatctccgcatgagcacgccttcttcttgatgtttctgactgtgtggcgtgtgttgagcacgagtccttggagacagcccttggcgtgctcttcggcggcctcataggtgccatcaagctcgtcctggatacggaagtagtcgagctcgtccagcacatcctcggcgttgtaggcgaggccgcggagctccaggagcagctgctgcagcgcggggttgctggtctctctgccgcgggcattgtgcagcatcccctgcgcgtagagcagctccgtcttgatggcgccgatgttggggccgagctccgtgctagcggcccacgcctccacgagccctccggacagcgggctcagcgccttgccgaccacccaccgcgccgcgttcacggccaccgactccattgctctgatccctgcaccgctagcaagctgggttagagatgagaagcaagcagtggcagacgtgtaggggagaagaggctggaatgttactctggctaagagagaagcaagcaagcacactggcacagcgaatagagaagggctaaggaaacgtcgtgcagactgcagagttgagatccgatcggtgtcagtctggctgggcaaattggcttgagtgtaacatgcttaggcactacggcactaccttgccgcatttttatttggaatcagaaatcagtaacatgttctccctgcatggcttgctggctgcaatcttcagaggcttccctatttttgcctgcagcaagaatgttagaaatgcgtggttttcgttccagtcatccagtgccggacaaagcaaaagtagttttgcaggcttacagtacatctgtttgctgtgcaagtactgcagaggcttcaaaaggaagaaaaaaaagaaagagagggtgttatgaaagacaaaatggcaaggtaacagttatacaacaaagaagaaacaagtgttggaatattcagaccgggaagaaagcacaagcattcaaaatttctcaataaaaattaaactatccttactggggtaatctgttttccatttcttataaaaacaagcaggtttattttctacaatgacacgccatatataattctctgcagctacagagagtgtatacaatgatagttaaagataacttaaactcacaagaatacacgtaccttttttttccttataaaacaggcagtttatttttttcatcaaagtcatcagaacaccatggcaacggaacagaggtgcagacgttgcaattgaaaacgagcatcatgccgcattccccggtttgttcagttgaaacgaccatgatctggcataggcctcatcttttcattgaacaatattaaagctgccatataaccaaataattgatgggcaacttgcccactttcaaagcaattaacatggctgtacaacatgtgctctccttgagcgcagttgactatccattaggttctactaataatcagaaatctccgatcagcatcagtattcattttctaacttcagtttttcttgttaccacttgtgacctcctcttggcttagaacaacatgccacattcaccaaacgccagagtaaatatcaagaaagcaacacctttctggatccactaaaccatcaactgcgttggctgctatctcttcatggtatgttcatgcaggttgtgatctccaggttgccattcatgcctgcaacatcagtatgaccatgatctgccacttgccgcttgtgcaggttctctccagaggtgccattgcatgtgtaccattgccatttcaacagcaatatttcaggcttcacttataacacctcatcttttataaaaactttgatcttcagctaccacatgcttgaccacttccctttcggctcttttggtacttacctacttatcccacataaacttcatatcatctccaaaaaaaatacaaatttgaatgtgtatttcttggaagctacaacttcagttgaccggactcctaggccgctcaatttgaaggaggtggtttctggcgcccccaaagcccaccccatagccaccctccttcccacctccttcctttttcctctcattttcctttttccctctctttctactccagatccgttttcttgcgtttttgaagtcgtctggcg

SEQ ID NO: 26119 - DNA, 1690 bp, Oryza sativa
gttccgtagaggcagagatggtgcgatgataggtagctcggactagtttctattctcctctttccccatattgcgcttgcgacggaaagaataagtcatcgatgaaggttggagctaaatcttctaggtttttttttgtgtgtgtgtgtgtgtgtttagagtctaagaactcatgtatatgttttggttgtgtatatcctttgtggatatagaggccggattaatgaaaatccattatctaaaaaaacctacttcagttgaccttatagcacaatctcatgctgattcctttcaaaaacttcagttgaacttttctcctcttgcagggtacttctccctaaaagctgcggcaactctgaacttgattggcatatgcattgttgcctactcaggctaggcagtgaccttctagaacaatgcagcagataagcaaagaaggctaaaatctcaaaaagaatgtgattaatgtatataaataaaatgcaatataactgaacaagtaatatgcaagtttttgctgcagcatgtaatgtcatgcatcatgaattttttgccgagacggccgaaggaggtcaccccaattgtattaaggagaaaaagagttataagttttacattaatcgactttagacagtcgaggaaaaaaaacggtccccatagggttacgccttttaaaggtttaacagccattgattattctactggcttaaagatctctgcttcatgaatagaggatatgaaaatatggttgtgccataacttcattgattgattagaccatatgtatatgtcaacatatactttaagaccctgaccggaatcctagtttgtgcaccatgcttggtgtatgccctagacaacctatgggggaaaaaatcaggtttctaaaatggaaacgtccaatggaacttctttatcagcttgagaatatacatatcttcgctcgtgaccagtacgataccagcttcgtccatttggcatgttggataatatcatttgagcaactgatggttccaacaaaagtattactgtctctactaattagtaagtgaatggctgacttttgaactaactgttcattgtgttcgatgaggatactaaacccagagatcaagacatgcatgaccacccaaaaacatgctactcatagcatacactgcatgttacagacaccgttttatatgttaatttaacaattcaaaacaaagtaagcttttacctgcattctggaagttaaaatggagaaatgaaggatccaatcataactgattgtatatgaagatattggatgtgctctaacagaagctcatgttcttaaaatagaacttccatgcagacattgtgtccagaactgaagatagtgtcaatttcaactaaactgtttacatggacatgggaacacaatatgagatctgttcagttgatcctagatagaataagggagcacagaaagcagcatcatagtcatgctattgaaaccaaaggaattcactattctacctcggttagttggttggccacttggccttaaacaaaccacaaatcgatgcgtactaaactgcgaactatttttctataagagctaagtgtagatgtagacatgaagaactgattgactgtatgcatagaaaaaaaggtcattgaggcatccagactccagaaaatgctagctttaaaaaaatccccaaaa

SEQ ID NO: 26120 - DNA, 4565 bp, Oryza sativa
cccccccccccccccctctcactgtctctgcatccactcacctgatttaatttgaagcttcaatcaagcttcccgtatacatagagtacattcatatgcacagaactggattcaaactagttttttttagataatggattcaaactagtatacatagagtacatgtacatacagcataactgctgttggtacacacaacaggagtgcccgaatggattggctgtgcacttgtttagcagcacttctgattttctttttgattgcaacacttctaacaggatgactaagatcctgaaaaaaaaaacacatacaaaagggcatgtggataaataattggagtgaactcttttgttttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgttgtggggaacggcgtgaaggccttgttctgggaggataactggctgcagggagaatccatccgctgcaaggcgccggctctctatgctgctatcccggctcgcattcgcaaaaaaagaacggtcgcagaagctctgtctgataggcggtggatcaaggacatctctggtgcccttggtattcaagccattcttgagtatttatccctgtggcaagacattcgtgcagtgcacctcacggaccagcccgatgtgctttcgtggagatgggaggggtcgggcaattactcttcccgatcggcttatcaagcattgttcctagggataacccggttccagtctaccccgatctggaaatctctcgctccacctcgatgctagtacttcgtctggttagtggcgcttaacaggtgctggacgggtgatcgattgaggaggcgcggactgccacaccccgaccaatgtgtcctatgcgatcaatgcgatgaaagcatcgatcatctcctggtcgcttgcccaaagtcccgctagttgtggtggatggcactgagggccattggacaaacaagttctctgccgacgaacgaagtctccttccacctctagctttgcgatagccgaaagagattgaccaaggcagctcggcgtggtttcgacaccattgcaaccctcgtcgcctggacaatctggaaagagaggaatagcagcgttttcaatcagcagcaaaagacttgggcggaagtggcaagggcaatggccgccgaagcagaactctggagacttgcgcgagcagccattccggagttcttgccacagccaactgtcgagaggtcgcaacatcggataggagaatagatcttttggggcaattgtattcctgcatctccccttcacttcttgtatttcctgtaattaaactttttttccatccttaatacaaatatgcgctccttgcgtattcccaaaaaaaacgaaactttagcagcacctttcacaaaatatatctgaacttaaggagccgagcaaaactaagtcagctgatttatatcatgtgcctgaaaaggttaaaaaaactatggcagagttaagtaccttaccgcttcctgatcaacaagtgatgagttatttgttctaagaggctgagggcaataatgaggcttgcattcaatgataaagaatttttgcctactgtgaaatgttaagaattactccactgtgttaaattgaagaatatgaaagatcaaatgacatgcaaatgacatattgacctgcgttccttgaaacaatacaatctgtcaaactgataacatattgtataagtttcagttcatcagaaactagttattttgtacagcgagtctcagccagtaggcccagagtcggcccagtatcaaatttaacaatagcaagatcgtcgacggacagtgtcaatggcaggaggtgggctccttgcggatggcacaatagcgatgacatagcagagtactggagtagccagggcctgggggtagtttcagtggtcgggatcagtgttttttctgttgcacaggtcccggccttgcctgttgtgattgaaatcactttgtaaccttttctcctccaatctaataaaatttggtcggcgtccttcagccatgcccagcgataaataaattaccatgaaatcccacaattcttttttcgggaatacgcaaggagcgcattttttccattaagagaaataaaagttatttacatttgaaagaaaaaaaaacagcacgggactgatacaggacaataacagacaatcctaagtctatctctcacgctaattttggcgaccaaactccctcctgaattacagcgcaaggatcgccgggtttgctttacgccaaagagaggcttcgtccaccatccctctggccacatccgcccaagatctacactgctgattgaagatccgaccgttccgttccttccatattgtccatgctaccaatgtcaccaccgtgtcgaagcctcaacgatgtgactcacttagcaccattctgctatcgcacatccattggtgaaaagaagcttcattcaccagcaggcagttggggtggccgattgctctcaaagtccaccaccaaagctgccttgattctgggcagccgactaggatatgatcaatgctctcatcctgctgatcacagagaatgcagcggtcgggatgcggcaatccccgactccgcaatcggtcggctgtccagcatctattcaacgcgaccagccagaggaagaaatgacagcgaggtggtgccaacgagttctagatcggtgtggattcaaaggcaattcgtccaaggaacaaagctcggtaggtagattttgaagtgtatttgcttgagctttcccacttccaggagagtgagtcgggctctgcggaagaacaatcaactgactgaatcagcgaccaaagtttgaggtattcgagtattgcctgagtcccaagcgcgccacttatgtccttgatccatctacggttagacagcgcttcagccaccatccggcgcttccggatacgagtagagacatgatcgtagatggagggtgcaatagctcggatggttcctccttgcaaccaattgtcctcccggaaaaggattgtttgctcgttacctagctgacagacggtggaggcggcgacaaggtgaagttctttctgtgtgcaggggattaaatcccacaattctctcactgccaatacctattcagaacagctgaaagattgcaaaaagagaagagtgcgatcagacagataaccaaaaaatgagcatctaaagcatcagatatgaactcgtatgaaatgacagaccagtttttgtacacgtgatggaagcagcacaagttgattatcaactcaatgagatggatgcagagagattctccaagactagaataaggcacatactaatccaagaaagaatctgcacaggatttcagaacaatcaggtttttcaggtagatgaatcacacagtattaacgttgcgccaaacagaaagtgaaccgggatggctcaaacaagagaatgttcattaccaatcaaatcccagtcgctgtctttgatgattggaatggtcctcttagcttgcggcactgccttttgagctcctcgctgcctccagagacatctagtatttctagtgaacttggaagaccactcttgggcaacgaactgatgaactcactgcacgagatctctaatctcttgaggctaacaagcctgtgtaacacagaggggaggaactgcagccggcaaaaactaaaactgagctcctgaagggaggagaggtgctcaagggccatgttttgctccttggtgaagcgtttcacctcgttattgcaaaaaatggttagcttggtgagtgagggggagaggagtctgcagatgggcacaacaagcactcctgcgatgtcatccgttacaaggtgctgcagtgatgaggggttgatcccgacgaagaatttggggttcttgttgactcgcagccttgtgagttggccttgggcgagcagagaacacaaatcctcgcctcttaaatcaccacattctatgcctaagttggtgagagagctgaggttagagaggagcgacagagtctccatgccacttacacggtcaatagacagatatttcagggaggaaggaaatgggaaagatgaggaagatgatgagtaggaggagaagaaatcagggcaatcgataatagtcaatgatacgagggagcgcaggccttgtaaccctccttctatgcctcttaggcgtccttccatgttttctccaagtgaatcgtggtggaggatcagctttgagcaacaggagatgaacaactcctgtagctgggtaggcaagagcacagtcctgaagatgccgctgctttctcgtcctctcctcttggctgtt

SEQ ID NO: 26121 - DNA, 473 bp, Oryza sativa
ttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgaccatgttggcagacttcctgtctttgcgctcaggacagtccttggcccaatgcccatacttgccacacacaaagcagtctccctttgcctttcccttgcctttcttcttaaaattggttgcagcccttgggtttgacatcaggcttgactttcttgttgttgtgggatgcatgaggggttcttcttctgtaccatat

SEQ ID NO: 26122 - DNA, 799 bp, Oryza sativa
tcatttctgaataacgaaaaaaatgagaattgtgtaaataggcaaagttctatgattaaggccacgattgtcggttatttgggcgttttccacatatgattgatggcatctaatgatcacatttctactgattatatctctgggtcggttcagtaatgaggaaatgagagggaaacggctccttcaagttgttttactgtcttgtcgtgcagtctttttcttgtgggaaacagttcaacaaccactgcagcttgttgggtacctgggttcatggattcttttaagaccttttctgtggtggtcttgtttggcagtgcttaccttaaagctcttgcaaactggcttctcagatgaactctgaatatttcgttgtctgtacaggtagtgtttcagtttaccctatgagctacaactaacgacataatgtcagtgggtgcttaaagagactagtctctaggtacttttaaggtaatgtcagacttccgactgaatgcatatctgaaaactatgttcttgattgagaacaaggggggcatggttaaccatttcttttttgtttcagaaaggccagattggtatagctgaaatttgtttttttgctcattcttttctcgatataagttgaacattgccttgttttacaaaattgctcggactattcagatttacatactattgatcgtcatctcatattattgatcatcaccatttgcttggcagggtgtcagaattaaagactgccaagatcttggaagaacactattggtggtggcaaaagtgaattgttcatcactcccca

SEQ ID NO: 26123 - DNA, 5575 bp, Oryza sativa
  unsure (1)..(5575): unsure at all n locations
aaaaacagaagagctctcctatctaccatcagcatcatcaagatccccagccatggtgtcagggctctggcaagaagtcgcgcgcccgttccagcgtgttggtgagcttggtgaggttgagctccacattctgcttgtccaggtacaccgtcttgatggcgtcccagcctttcttgtgcacatcgtatggatgctggatgtagaaatggtctctcgggtagagctctctcagcgagctctcgtcgaaggagacattgtactccatgtagttgacatccatgtccttggctggatccttgaaggtgacacgggtgagccattcgagccccccgaatggcaccacctggatgagcacggcgcggctggggaggaacaccatgttggtgaggccggcgccatggacgcccatcatcacgtcggcggagttgacgaggcgcgcgaagttgggcatgtcggtgtggttgtccggctcggcgatgcgcacgtcgaacctggcgagcgcggcggcgtgcgccatggcgcgctcgttgaggaagcggcgcgagctcttgcgggagatgatgaggaggcgcggcttgtcgcgccgcggcgcgcccgtgcgcgacgcgacggcgcgctccaggcggaaggtgcggcggaggaggcgcttgaagtcggcgacggtgacgccgcccggggagcgcgccgggtcgatgcccatggcgcggtggaacgtggcgccgatgaagatccgcgggaagcagtgcaccttctggtcgttgtcgacgtcgatgacgtcgtaccgggagagctgccggaacagcggcgtgaacttgtcgagccaccaatccttgatcccgctgagcaagaactgcacctcgccgccgaagtggttggtgctggtgaagagcgggacgagcacgtcggtgtagtcatggtacaggttgccggcgaagccgccgctggagaagaggaacgccgggacggagtggttgcgcgtgcaaagcggcggcacggcggtgtggttggcgccgccgaaggggacgagcggttgaaacttcccnctcgtccatggcgacggcgtcgtggaggcgcgcgtacggcttggttctccactccttgtcgagcgggttgatgtagatcttggagtggttgccgtcgacgccgatgtcgcccacggaggcgcaccggtccgaccacttgctcgtgacgtagcacgtcggcctggtcgggtcgaagtcctcctcccctatcggccccgtcatcttgtacctcgtgctgtcgtaatcctcgtcgatctccaccacctccatctcctccgccgccttggctgcaaccacaattactcacagctcatcactccatgaatcaatcaaagctcatcactccatgaatcgatcaaaatcaaggaggaggatgaggagaggaggaagaggaggaagaagcgtacggaagggggtggagcagtagcgacccttgatgtaggtgaggacgcagagggagaggagcatggtgatgaccatggcggcgttgcccatccgccgcggctcggcgcgcccccgcgccacatgatggtgcttcatcggcgccgggctctcgccgcgggcggcgcgcgccgcaggtggtggtttggtttggatctgaaggaagcaaaaacgatcgggcgtgagcagcagagagaggttagtagtattaaaggcggggtcggggtggcgtcgcgtcgagtggatgatggcgaggcgatggcaaccagaggttggtggcgtcgtgtggtgggtcggagctcgcaacggcgcaaccactcactacaagcacaagcagcagcagctgctgcacagtgcaaacggcaaagcagagcaggcagctacagctacaggggtggggacgagtagacaaagcagtggcccagctagcgcaccagtgcaccaccaacaacaacccgatcgccgatcgctcgccgtcgattggccgaggcagataagatcgcttattcacagatgtactgcagtgataaagggtgtatggtttcaaggctgaggtacaatgtttaacctctacccctaacacgttcataattttttttcttaaaaaatgtttggaggcagcgcaaacgcaacaacgctttgttgttgatgggtacgtggttcaacaaaaaaatcaaaccagttaagcttcgttcacttttcaattttttttttgggacgctccttccgtcaacccggtgtttttctttgcgtcgattatatgtgatgttggtgaagaaacggtcgcctgcctcgtgcttcatgacgagaggtaggttggttcattcacgcgttggcgttggcgttggcgttggctacagaatggtgatcacaacagattcacagatctaccaaacgtttgagcctaccaagtacacgtaccaagctgcagcgacacgtacagcagtgtggaataaatggcataaaaatgtacagcagatggtgcctgattaattcagagttgctcgcggcggcgccgggcagcgagaggaacactcgtgtctcaggcatgttcatcctcaaatctcaactgaatttttgtcaggatgctgcggtgtcaatgcacgcgcgctcacgtgtttttcccgtttcgcattggctttcaaacgccggaatccaacacaaccgggggctggattaaattaaagttgactccttctttcaaccatgatgttaatttgctaaattgatcataaatcatgtactagtaatcaggcatagagcttagcttgtacaaacctacaagcttaactgcatagtagtggacacatgaaacttgagggagaaaaggaacccatttatccacccaattagttgctcggtcattctcataacctgaacgcaagaacaaacctgtatatatgcaaccacttgaccaatcactcgacaagcaatgccaattcatgttctccaatccaatctcaccaaatcgagaaccaacattttccaacgacaaaataatacactgaacctatgcctgcatttggaattttggatcactcgttcagttcttgcaccgttttattaacctgtagcgatgtactaccaccatctgtttcagggattcagaaaaagaactgagagagacagcggagcttactgtcgtcgttgctacgatgaaaagggttgctttcaagtgtccatctctgtggcaggtgaatggcttctttatataagtcccaaatggatggaccatttgccttggatctttgctttcatctactctctgctctgcctctatttctccttttgttaattgacatgtccttgttaaatacttaactatgtagtcgcactgaaaataaaactgttgcttctgatgcaaatttgctagagctggctacagaatgggccttgcttgatgaattgaagcaaaagcaacattgctagcgacttggaggaattgggaatataagatgttgctcgatcagacagccatgaactcccagcaccaatgccctgggcagcatgtgttttgtgggggctatctcgtacaaattggccagcgatccagcgtaccaaaccgatttgtcgtgggattaacaatcagtcgatcacaaggctacaaaaaacggagttaatcaaatcgaagactgcgtctgcgttggtcgtttcataatcacgttcgacaacttttttccatgtgtgaataaacaaagtcaatcataaggggaaagcacctttatcataaaggttaaaaaatcatgatatatgattacacacagcaggttctcaattttaggtctgttcactttgatgtaaaaaaacattaccaaattttagcattaccaaaatttggcattaccaaaattttggcataggcaggattttttatatggttaccaaaatttgacagcaaactaaatgcagccactttttttacagctttatcaaaatttggtaatgttgaaaatggcatcaaagtaaacaggcccttagcaacttgccaatattttggtaggatttcttatataattaccaaaattcagcaacaaactaaatgtagccacttttatggtaactttaccaaaattggtaaggttgaaaatgacatcaaagtgaacaggccttttttttaaacaaatgttctcaaaatttatggattacatattgatgtgcctattgaggatgtgttagagatacgattacaaacaagtattccttccgtattttaatgtatgacgccgtttactttttgaccaacgtttagccatttgtcttattcaaaaaaatgtaattatcatttactccatccgtcccaaaatataacaacttttagccctcaagatttgtcccaaaatataacttctccactaacattctctttcaaccaatcacacccctccaccattcactttcccacctacctccattacttaaccaatcacaaccatttatcattcacttctacctactttcttaataaccatgtccaactctaaaaatacttatattttgagaccgagtaatattttattatgacttgatttatcatcaaatgttctttaagtataacataaatatttttatatttgcacaaaaattttgaataagacgaatgattaaacattggctaaaaagtaaacggtgtcgtacattaaaatacggagggaggatgtacttacatgtgatgatgatgtgtacgcgtatacatacaagtacattcttacttgcggcccatgttggttagacggtcgtaacgggattacgattttgtgaagcccaagaactagattgaggtcctacgtgcgctgggctttcctcttacttgcggcccatttatgttgggctgtcaatttatgggcctcattttctaaagtggctcaatgaggcctagcaaggtttatcacggcgggccatgaatttgggatccgggcctttccaatgcttgcaaaataaaggaataagatcactttgactccctcaactgaccaacgaatctaaatcgtatccctcaagcgcaataccagaaatcttatcccctgaacttgtaaaaccggtgtaattttactcccttggtggttttggatggcggattcgctgacgtggtgcacacgtggcagtgttgacctgatctttgttccacgtggcatttgacgtggcgtttatgtggcattaaaataaaaaaatatatgcggggcccatttatcattcacacaaagaaaattgtgggaacatgtcatcttctctctcactatccttcttcctcctctctcccttatctctctctctctctccccttgacaagagccgatggcaggcgggggctcggtggcggcatcagcgagtgggtgcccggagtggtggctgtggtgggcggtggaccttggagcaatagcttgcacgccccaacgcgcggcggcggactggcctcgagcgctccggcgtcgacctggccatgatgcggaacagcgactggagctcctcctcctccgacacgggccccctccccgaccacgtccgccgcgagaccgccccttcttcctcttggacttgccgccagccgtgcccgcggcggcctcgcggaggctcgggaagttggcagcaggagtagggggctcggtggccgccgg

SEQ ID NO: 26124 - DNA, 1196 bp, Oryza sativa
aggtcgtatctcgcgacacggccgttggcgtcgcggtggcgtcgacgaaggccagcgtggtgaccgagggtagctggacctgcgcgccggtgaccgggttcaggaggtgaagctcggagcggcgttcggcggtgacgagccacccgtcggacgagccaacacatagccgctcagacaccggcggcgccggctgcgggatggcgtacgccctgccatcggagaggctcaagaacctcgcctccaagaacctaccatccccaccgccgccgccgctcgggctctgcctgcgcgccgtcgggttgaacgggagcatgagccacggcggctgcgcggcgcgaaaccgtgcggtggcggaggccgcatcagccgactgccacgccgtgcacacgccggggaagcggaggcggtccggcacggggaggcggccgagcacggactcgaggaggtcccgcgggaggtcggcccacccaggccgcctcaccgcggcgccgactagcttgttcatcgccattgccagagcagagcaaagctcgatcgcatgacaaggagaagaagatcagaggaggaggaagaagaagatgagacggtttgcttgttgggattgcaagaaacgcgaggcgaggtcgcggcttaacaatggccatgtcgcgccgttccgacgtgcggcgcggcccgtgtatttgtgggatgccgcaggcgcggcggtcagagacggctactagttttgggtgcggtcgcagcatgggactgagagggagagaggcgggtggtgcgaacgggaaggcacgcgaacgcgcggcgtgacacggtgaaaatcccgtgggcgctggtggtaaaacgtcgaacaggtcgtcggcgcgggcagctgattttggacgggatgatgagcaatttggtcctccaactttcttactcgtctcactttggtcctaaaagggccaatttggttcatgaacttcttcgctttttgcccttttgtttcagatattttggtcgtccagatattttgtcgattgttaaatagatgaggcttatagaatgtagtgaaacttgacatttctaattattagtatgtaaattaaatgttaaggtgtagtatgtcaaaatattcttaatagattcattatgtggttgtagtggtggttttcgtccagtttcccctaattaattgtgcgttgtatggtttggggctgcag

SEQ ID NO: 26125 - DNA, 1708 bp, Oryza sativa
atatgtgcatcctccaactatgaccagaaggtgacgacgacaatgctgacattgccattgtctgctccttcgccacaccaagcactcttatcttcccacaaccttgtaatgaaaacattgacagcttggggaaaagagacagcaacagcgtcagttccttcccgctacagctacagtcatcgatactgagaccctcaatctgaaattggtagccgacagtgttctcagcttcaacattcaacaagacattacttgaatcatgtatcgtgggactcctcaaacatgatagcactaggagatgtttcagtggcaaaggaggacatttcttcaaatacaacactttcagttcagttagattactaaatgccaatacattccagaatgacatatctagatggccatcctttcccacaactttcaagcaaaattcagattggttattttttgagtaatccaaccgctgaaaatctgatcccacttcatcaataagaacacgacatggagagcttgtccaaggaatgtgaggaaatgatgacagctttggacaatttacaacctcaagctcccttagtgtagggaattgggtcaagttcatctcctgtcctgatcgagggcaagttgaatgtgaaaatggcaactccataagttctgggcaatctcttataatgaacacctctagcagggagaacacatgggaagcatcatttccaacccattttgctagctgtggtatgccaagcagctctaacctttttaatttttgaaagctctgacttgttgtacaacccaaggattcttcaccggacgcattaaccaaccacaactcacctagagggggaaatttgttccactgtatgctatccaaacgaagagcttgcaagtttttggtagacaagttaacacccaaccatgatgggcaagattgctatgtggtttaagattttcaagaacatgttctgcttgtgaagaatcatcagaccaaactaatactaacttgtgtaagtgccttttgtttaaaaggtttgcttcctcccctgtctgtgcattttcaagattataaatgcacagtgatccttttagctcttccaactgccctagttgtcttaatgcaaatgcctcagcttgtcttttgacttcaaatctccttagttcttgtaaacatttcagctttcccacactagtaatgtcggagtggagattatcgtatgggacaagaaaatgccgtagccttacaagattattcatgtctcttggtaaaccaaagtgacccctgcattgttgtaaatcaaggatccttaagtgataaaatcttgaaatggtattgggtagactcatttctgggaaatatcccttattaatccttaagtagcgcaaatgaataagatttgaaaagttgtgcaacatattttccaccacgtaagatggtgcatacaacaagacgacgcggagtgcttttgctttgcttaacaaattaccaagaggaatgacaaagcttccatggtattgtccaaatagcatcacagagtgaagcttttcaatatccaattgcttatgcagtgtgctgaaatccttcttgatgttttcaaaagtcactctatcatttacatccacatcatctatcacaatagacaagtgccgtatagatggtggaacttgaatagatctcacattagaactacttatagcaagacattcatatgatgaaacc

SEQ ID NO: 26126 - DNA, 479 bp, Oryza sativa
ttcttcctctcagctacaccattttgagggggggctccaggacaagtggtttgatgaataattccatgatctgagacatatgacacaaactcactattaatatactccgtcccattgtcagttcgaataatccgaacccttgcatcaaactgattggtaaccaatttgtggaagtcttgaaagcaacgaatgacctcattcttatgtctaagcatgtaaatccaagtcatacgagtataacaatcaataaaggtaacaaaccattcgaatccactcacagaagtaactgggcatggtccccaaacatcagaatgtattaatataaaaggttcacaactacgaagaccaattccagcatatgtagaccgtgtatgtttgccaaactcacaagcatcacaaacaagtctactcttgtccactttggtaaagaggtcaggatacagcttactcaaactctcgaaagatggatgtcctaattg

SEQ ID NO: 26127 - DNA, 718 bp, Oryza sativa
cagagtgtttaaacgtaatgagtcactactcgaggaaatcaaaattgacgagaggagaaatacatatttataaatattttaaaatgcttgaatttttctcgagtattatatttacatcagatactactcatcctatctgtttgttctgtgggatccagatccagatatgcataaaaggaattcatggctttaagcttatctcctacgcttcaggaatggatcagtcagaacatcaccatcggcttgccttcgccgccgccgactggtgtctccgcctgcacggctggcctattatgccgccgtctgttgggtgtctacgtcttcactgaccggcttgccttcgccgccgccgactggtgtcttcgcctacacggctggcctattatgccgccattgttgggcgtctacgtcttcaccgaccggccgcctcgtctgccgccgactggtgtctccgcctgcacggctggcctattatgccgccgttgttgggcgtctacgtcttcaccgaccggccgcctcgtctgccgtcgactggtgtctccgtctgcacggctggcctattatgccgccgttgttgggcgtctacgtcttcaccgaccggccgcctcgtctaccaccgactggtgtctccgcctgcacggctggcctattatgccgtcgttgttgggcgtctacgtcttcaccgaccggccgcctcgtctgccgtcggctggggtct

SEQ ID NO: 26128 - DNA, 586 bp, Oryza sativa
aggcctgtctccgcccccgaaagacctaatatcaaatataattagaaggggtgaggcttcgaacccagatcgtccagcccactactttgtgaagctagccaaaatatccctaggtgtttctggcaccacttgctgccgatcggtgccgaggcgaagctgcggggtgtcgtggacgcactcgaggctgaaatcgtcggacagcgagcagtttggcccgatgccgaacgggtactcgatgtcgacgttgccgcacttcttcggacacagcggcgacggcggcggccgccgtgatgcggccgcgatcagaggctgcagggcgagcaaagctaggccaaggaagagcagcattggatgatgcttcgtcatccgtgcctggaggtggctgtcgtagcagatgctaatttttgagaggagaatgtataggcgtgttaaattcttgagaaacttgacatctatgctaagctagcttcatgcatgttatatagtacttgggcgaacccgatgacttgagtgttagaataattgggctaggcccaacttataatattaaatctcaaaggcccataataagtgttgaggataataa

SEQ ID NO: 26129 - DNA, 1078 bp, Oryza sativa
tccacgcctctcttttgtactgaacatgacggttgtgacacctttatcaccattgcaacattcatacagaaagaagccagttcctctgctgcgcctatccttgcaaagcatcgcacatagagcacaccatgaaaacaccaaagctgaagtttgacagggtggatctgtccacaagaatgaagcacatcgtcgagcagctaaaaccagtctgcgccaaggtctccaccatccttaatctggagttgttggaatcaaaccgcaacattggcctcatgagtctcaatgctgcgctttcccggatgccagggcaagcaccttttcttccaagcagcgttgctatgagccggcctgtaaccacttcagagtttatagaccctaaatttcatgggaggatgagtgagataaataaaattattggcattactcggggtgattattgtggcaaagacctgaccatcattccaattgttggttcaggtgggatatgaaagacaactctcactcagcatatatacaaggaggtacagaaccattttgatgttaaggtttgggtctgtgtctctctcaatttcaatgtgtatagattgaaagaggagattgccaagttaatgcctgaactcaaagatgagaaatctggtggcccagacgatttaattgagcaaaggttgaaatcaaagaggtttttacttgtcttggatgatatgtggaattgtggtaatgaggatgagtggagaaggctcttagcacccctaagaaaagcacaatcaacgggaaatataattctagtcaccactcgttttctagcagtcgcagaaatggttaaaacaattgatcattcaatacagttggaagggctagaatctgaagtgttttgggaactattccaagcatgtgtatttggtgatgagaaatcaataggcaatcacgtggacttacttgtcactgggaagaagatagcggaaaaattgaagggctcccctttggcagcaaaaactgtaggacggttattgagaaatcaccttgacttggagcattggacaagtgtcctcgaaagtaaagaatgggaactgcaaaccgg

SEQ ID NO: 26130 - DNA, 654 bp, Oryza sativa
tccttgacacagcaatcaccatgagttatgtctttaataattctatccttctcacccttcctcccataaaattcaggctctatagtcgctgaagtggtcacaggacgaagcatagcaatgctgcttcgaatggtgcgatttgattccggcaactctagattaagaatggtagagactttggcacagactagcttcagctgctcagagatgtgcttcgttcttgtggacagatccaccctatcgaacttcagctttggtgttttcatagtgtcctccctctgtgatccccactgtttttcttttctaggcatgtgcgttgcagtagagctgtggtcgatatcagtagagccggtgtcgttgtcgtcttcatcggtacagtcgtcatcggcatcatgttcaccagctaaagagaggtcactgccggcaacagctttctcgtcacctccgcccgagcaacaagcagaaaggtacctcttcttaatgtttctggcggtgtggcgggtgttgaggaggaggccatggaggcagcctctggtgtgctcgtcggcggcctcgtcggtgccgtcgagctcgtcctggatgcggaagtagtccagctcgtccagcacgtcctcggcgtcgtaggcgaggccacgcagctgcaggagcagctgc

SEQ ID NO: 26131 - DNA, 1496 bp, Oryza sativa
taaaggtacaagttggtcctccgcatcagctgataatgcagtcatcaaggcaccaccgtattcccagttaggaaggttgcatctatagctagtactggcctacaatgcttaaaagcctcaatggaaggaccaaagcaccagaatacacgcataaaaattttcttggtcactccatcaacgttgacaaccctatcaagatgagtatcgatgtggtagaccatactgggattcctctgcttaatggcttgcagcaaagtgggcaaacggacatacgcttcaccccattcaccgtaaatgagcttcatagcctcctcttgtgccctccaagccttgccatacttcaccctatactggaaaacctcaaatatatacaaagctaacgcagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcaatgcgaccatggataggaactctaaaccctttctgagaccatccacctggaatggttctggcaactgatttaagttgatgccgccatctagtagtgcaccatgggcatgtgttaggtctctaaactcaggaatgtctggcttcctcccaaacaccttctcaaacgcatgacattcctctaatgctaacttgtcattattagtaagtggagggaatggacggtcatcatcagagtcttcagcaaattcaacatcatattgctcaacacttgcctcctcatcaacatcatctctattgacttctactgagacagaatcgtgaccaccactcaattcgacatcaaagtaatcatctggattcacatattggcctgctacttctgtcgggtattcagggttgcctccatacgacgaccaatgaacactcgccgacaaatgttcacttagatcaagcctctcttgtactaactcccttttcatctccctcactgcatccacatcatcagtaccgcaatgtctctttgatggtcctgtctcccataaatcatttccaagcaaaggtctcttcttctctccttccccctccaagtcttcttgtaccaactcagtcttacttgcaccccctccacgacgagaataatatgtcacaaaattcttctcaacgtaatgataagaaggagatttgtttagatccaaattttctacagtacgaactaactttgatgcaaacacctctagagatctaaactgagactcttttacccaatccaagtaaacttcccattccaactgacctatcacattaatatatacttatgcccttgaccaaca

SEQ ID NO: 26132 - DNA, 751 bp, Oryza sativa
  unsure (1)..(751): unsure at all n locations
tcctgcagcccttgtttggctggtgatcagttacgtatatggttatagctgcggttcttgggagttcgagcaaagggagcagcagttcatcagctcgcagattcagcaccgtctcaatgaggcaagcttaattgctgcagtttaattgtacattgattcactagctagctcgaggcctcgagcgtccgatcgatcaagaacaatgcgtataaaatcaaagaaattgtaggattaatttggtaggcgttggattaattaattatgacgtgcagatcagcatgcacctgagcatggatgatgacgatgatcagtccgcggtgtacggcgtcgccatggtggacgacctcctgacgccttcgccgtcgacgcaccacgccgtcgccgccgccgccggcagcttcccttcctcgtcatcctcctcggcctccttccgctccgcctccgtgtcgtacagcccggacacctcgtcgtcggcggcagcggcggcggcgacgggattctaccnnnnnnnnnnnnnnnnnnnnnnnnnnnnnnnnccaccaccacccttggtgcgcaacgagccccagcccggccgttacaccgccggcctgccgccgccaccgtcgccgccggtgaccggtggcgcgttcaggcggtacgcgcggcacctcggcccgaggagggcgcccaagccgggggcgtgcgggcagaggatgttcaagacgggcatgtcagcgcttgccaagatgcacatggagacgacgtacag

SEQ ID NO: 26133 - DNA, 278 bp, Oryza sativa
gcatcacgggttcttcagagagttaaatgtcttcttctgatcacgggcgctctgtttattcccgagaagttggatttttaccttcagcatattgtgacttgttgtcttctgcattcatgctagtttggatgatcatactagtattatcctgcatctatgcagtccactcggtacttacagttgaatatccaagggatatttctcgaaatctgacttaaaagtaggattttggcaagtaaagatggcagaagaatccatatagtggactgcatttacct

SEQ ID NO: 26134 - DNA, 1864 bp, Oryza sativa
gcgccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgcctccgggcctcggctggcgccgccctcatggaccacggcgccagggtagctggcgccgccctccccccagcccgaaacccttctgcctcgcggcactggctggcgccgccctcctcaaccgcggcgccagggtggttggcgccgccctctgcctccctgcaaattgaagatccatattgcacaaatgtaccaattcacagttcgcaattcaaatcacaattcacagattcgtacagactaaaactagttccaattgcacaaatcacaatgccaaaagtccatcacatagtcctcacatagtccatcacatattccacacatcaaacaatgccaaaagtccatcacatatcccacacatcaaacaatgccaaaagtccatcacatatcccacacatcaaacaatgccaaaagtccatcctatatttcacacatgaaacaatgtcaaaagtccatcacatagtcctcacatagtccatcacattttatatcacatagtgcaccacatatgtcatactaccaaccaatagattaacttcatacaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgcgacatgtctatctcctcggcgtctggtgcgacgtagtcctcatcctcctcgtcctcgtcgtcatcgtcgtcactaggtggagccggcgccttcccctttcccctcccttgcggaatgcgtgacgacgacgagccaccaactccttcacgctcttctattctgatggagtgtcgagcggtacttggacgcgcggattgaggtagtggtggtggtagtctccgcggttggtacacgtcgtctaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacagtgcggagtgtgttctccgtgtcctcaccacccctcggagcttggaggcatgccccatttcattcacactcctgaggagctctctcgactgaaagcgtgagaagatatatgttagggtctagggtgcaaatggaaataactttgacaaatgcaagaaaatttacgactctgtctctaagtggggcgtgctccatttgatatccaactctagtccggacatcatagggattccgcccctcatcggagtcgcggtcatcctctatgtcggcttccgtccaagtagggcggaggaacaatctatatgtcctatgcagctaatgaaggtactctgagaaaagatgattttggtgtatagtctcgatgtacctgtcgttccttccggctgtcctccattcatcaatgtatctgttatgctctagcccctagtctttcaccttctttgttctcaccctgtcatacctagacaagtagaaggtgatgaaacaatagtgagcatcgacaagggttaaatggtacaaaattgaacattgacaatgaaagcacccaaagataagaaatatttacttgcgtaattcaactcc

SEQ ID NO: 26135 - DNA, 2113 bp, Oryza sativa
actagaagtgatattggaagtacttacatgttgaggctgtaagcagtccatctcattgacataatgcttgtatgccacatcccggtgagcatgtgcagtggcagtactctcaaaaaggtaggccactctcttctccatgtctggctcattgtagggccaaggagtgaagctttgcctccacttaggccttccaaccggtaatcttaaccacatccacagctgaatcaatagcacacaaccactcatgttggatgatagtgcctgacgacaacaggcctcacagagttgtccatatgtccatgccaacactgctgagccccaactgaaacggcccagatcaccaaggttggcgaccaaaggaatccatatcgccgaagcaatgtcacccccagcattaggaaacagaacccctcccaacaagtgcaagatgtatgcacgagcataacactcaacacgccatggctcagcatcgtcgtcaagatgtgagaagttctaactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatagtcatctcaccactggggaggtggaagctatgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggggggcatgagctctaactcggagcggttgaagtacctgcattagcaattgtaaatcaattagttaatataatgtcaaatacacgctaccgatacttatgtacaagtgaatcaatgccgattcataccctccccgcctcgatcgcagccccgcgatgacgggcctcgtagtacgcctccaaggctgggtaagtcggcggttgtccctcctcggccatcctacatgaaaagtaataaattcaccgttatttacctccctaacacttatattttttttggacttcttcttttttggacgcttaggacacttagttttcttgtgaccctcctggtgacacaacgagcatctattttgcaccggcgcagcatcaagttgaatgcatgaaggtggtttccttccagaaccacccagacccgagtccatttcgttcttgaatcgtttcgatctcctcttccctatttttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattcctcatcaattgcatgaattagataaacgtggataagatgtgagcaaggcatatggtagagcaatggcctttggcaagaacatgagttcacctcaccttcaactttgaaagctcttgcgccaaatctaacaccaccacgcgttataccacccctctctgtgacctcgtatgtctttttctgcttatcgaaacaccttgcagtgtgtttgttcaccttacttttttgcaccttcatcttactatcaaccttggtggaccaacgctgccctacctggactcgcttcaaagcttcatcatgtctgttcacaaagtagtcattgcacttcatgaacgtaaatgatactatggccgtcactggaagcttacgaacaccaactagcacgctattgaactgttcggccatgttggttgtcatgtaaccccaccggcggccatttctatcgtatgcacgggaccaattatctttatccaacaactcatcttcaagccatttacgaggaccttcgggaatacgctgccttagtgcctcaacgcatccctctcaaatatccacttctcgtcaatctgacatatccttaggagctcttttgtctgatgcttgtccgcaccggccttgtggaaattagcattgaagtgcctcatgcaccatcggtggtg

SEQ ID NO: 26136 - DNA, 2252 bp, Oryza sativa
aaatagaatacatatggttttccctttagggaaccccgagggattgtacacacaagggttgcttaccttacacaatttatattacactccttgcttcaatatactatcaatgtgaactcttaacagatttctaccactaaagcttagagagtggctcatgagactctggctgagggttgctgcttcttggtatccttctggcttcgctagcttccccttttatagaagccgaagagggagctcaatcttcactcatattttttatcacactgtagcatcacgggtttttcagagagtcatatgtcttcttctaatcacgggcgctctgtttattcccgagaagttggatttttaccttaagcatattgtgacttgttgtcttctgcattcatgctagtttggattatatgagagaatatctaccatatttgatgctctttggtaattattgaactttggaatattctcccaaaaattttcaacgtcttctcttgaagaaaatgatatatatatatatatatatatatatatatatatatatatatatatatgtatatatatatatgtatatatgtatatgtatatgtatatatatgtatgtatatgtatatatgtatatgtatgtatatgtatatgtatatatgtatatgtatatgtatatgtatatgtgtatatatgtatgtatatgtatatgtgtatatatgtatgtatatatgtatatgtagtatgtatgtatatatatgtatgtatgtatatgtatatgtatgtatgtatgtatatatatatgtgtgtgtgtgtgtgtgtgtgtgtgtgtgtctatatatatatatatatatatatatatatatatatatatatatatatatatatattttttttttaaaaaaccaaaaaaattattggaaacctattttttaaaatttaccacttggcattgctaaaaatattaaaacattttgtattaaaacattttgtattaggttatagcctcatcatttacccatattttctagtaatactaaaacggtttattaagaaataaaaattaattattagtaaaaactgtcttatgaagacgatcaagtgggtggtggtacgtgcaaatctggaaggaaaacggtgcaccggccggtttccatcttgccatcaaaggaagcagcagggaaatcccagtagtggaagtacagctagatttttagtattagtacgatgtggacaagacttactcctacttcatttgcatgcacggctgtactgtactccaattgtgtgaaagttatggccgaatctgccctgcacgtacgatttggtctcaactatgtattttcctgtactgtataataatctcaattctaaaatggaaaataatttgctagaactatactactactagtagtacttgcgaattggtctagaccgttacctgtatggattgaatttgtctgcggaaattctctggcaccaggcacaggaacatgctgcaattaacatgcggtcaacgctgcacagaggagagacatcctggttccagttggtaaggttaaccggattctgaccgctaacgactggaaacaccatgtaagaacaatactacaatactacggtccccatcgtttagcatattcatatgcttatcagtcagaatttgaattttcaacgttaaattttgagttgattttgggattttttttcatcgaagtatatttttcagtctttgcttttagatcgctaagaatacatatataaaaattttattcacaaattacttttcgtttgtaaatatgccgtttgacttattccaccgatatgccaaacgatggcacccgtaaaacgcagcatacgccgatgcacgcaaatgtgcaatgccattatgcaagcatgaatacgaaatcttgctcatgtacgaacataaacacgcaactatagattatccaaatgctctacaacatttataaccattgatcaaattctacatgaatcaaatccccatcaaataatgggataatatgcatagcaattttcatctgctaatgcttaatcagatcagatagcgatgattggaggagattactcgtagtagaccaggccgatattccctgtgccacctccatgtggaccccactagccatgcatccccttgacgtgacggtgatgcgagagacaggtggcgtggcggtgcacacagacacagcccgggcattgcagcgtcagtcacatgcacggtcgcccccggccggaaggagacgggacag

SEQ ID NO: 26137 - DNA, 7901 bp, Oryza sativa
ttcctgcagcccatatatatatatatatatatacccgcgtgttgcagggaattaataatttagatgtactcgagaaaagaaacttatggaagaaaattggtaaatcatgtcacttgtgatatctatctaaagcattgtaataattgatatgaaattgtaattattaatataatcaagcaatttaatataaaatataaaattttaatccgttagtataatttaatatacaaacttcaaacccaatgtacaaaacaatgtctttctttttcagttacagagataataagaggtatacacataattgtgaatgtgtctctttaaatacacgttcaaataaatgaagactattaatatatctcattgttaacgaccaaatttggtaatatcggcatcggaaaggaagattagatcgaagcggaatcagagataaggattatcgcggaaacagagtaaaaatcggctggagtccggatcagctacgattggatcggctaagttcgagtcagacttggtttggtgatgcagccgattccgacaatacgacttggtgtacgatattgggttgggtcgatatgcttcaagatgattgccacgcgtggatagagtcctgagaaggcaactgtatctattaattagtatattttatgtaatttccttagagatatgtttgggcaaaagtctgccgcaaagacttatggtatcttagagtttgttagagataagagtcatgtccgatatggacatagtttgtaattctcgggtataaatagaccccgaaccctatgtaatcaattaacacacacgtttaatacaatcttggtgcatcgccacccttttttgctttcgttttatttcgacaagttattgctttcgggttgagctgcatcggtttcgatcttcaacaagaggtaaaacttgttatggcggcttgcgttctcgggattagtgcttccatctctatgatactctaatcttgtttatgtaatccgtcgagttatcatatatcttatataatatatagcaatatcatcatctaacctacaatcagctaacatctactagtagaggtcagccgattaggttaaatatcgatgttggtttagattgtacatgatatctaccactctatgaaaattccaatggcttgattgtctagatattgtccttcttttcatacttatagctgcatcagttgtttgatcttatgagtcgtgattagaatctcaacctctagcttgcttcttggttgccgattagggtagtatcggggttttagccgatcttagctgatttaactatacttgttatatatgctttactgacatgttaaatctgccctttatattaagattttgtggcatttaagtgtattaagcttttgtttgatatattctgcttgctttaatatcttaatatagagtagtatcggagtattagcccatacatgctagatctatctgatcgactatgctatgaacatatatagtcccattattaatatatatttcgatctaagtgatttatattgtctcggcatggcgactgatctatcccaatcacttgatttaagtatatatcgatataaggagtatatattgttaatatctacagccgatcaaatagatttagttccctcttatttactcatggctgccgatcgatacatatatgacaccggctcaaagataaatgatatgtcatcggcacctagccaatcggctatcatttatagatttaaccgcggtttctttgcctttatttcttgttgattgcaggatcaaatccactggcacgctagcatacccgaaggcgagctttggacatgcactggagttaagcagatttcccaggcctcgtgtttttcatcaacactcatcacttcgagatcctataaaatgtaaccacgtatgactaaacgaagggatattagaggatcttatactattttctaacagggattttatttaggaccaccaactgctattactaccaggtaacaggactacaggaggtaccagtgacatatcccaccactaatttgaaaagagtatgatggtagtaccggatatttgtgttggtaactagatctagtagggggtaaggacaagtgtatctaagggtgtaagcgggcagacctgcggacccagccggtttacccgcttatttgtattataagtgagttcaggggcctgtctgattgcacctttaatctcgtcccattgtacaccttgtccttcgcgccgagttcaagattgcgcaccgccatcgccctaccgtcgccctgccaccgtcgccatcacccgacgtacgtccatgctgccagcaccagagccaatagcattctctaggaaatccagaccctactgtcttaaggaaatccaacccatccacctccacccagcatctcctggcctcgattttgaatctgatgactattgggtgtttctctcttatttgattccttgcacaaggttttgtcttagcaaccgagatggccatgacaaagcttggagattcccacaatgcaatgagtggtgggctgagcacttcctgaagttgtggacggctggcgcagtgctatctaggacatccagtcgtgaaagataacacggagacaacgacactgttgagagaaaggagtgggaggcattgtgctcttgcgtgacgggagagggagcagcgggggagcgtccaattaagtggatcaaccatccttatttataagggtgtataacgagacaactcaggctcgtctcttttgaactcattgtcttaacgagccagctctgcttgactcgttaactttaacaagctaaagtctagcgcaattcatcttgcgagctggctgctaggctagttaggcttgtgaacatatttatccctcctttataatttcaaatttatcattttgtcatatataaatatagtaacacacactaactaataaagaattcacaatgtaattagatgactaaatattagttaatataagcactaacaagctaattgagcagttcgcgagctatcttgttaagctcacaagctgaaagcctaatttgatttaactcattaagactacaagttcgaatcgatctgagccaatcgtgctcgctacgagttgatccgagccacaagatttgagctttgtctatccacccgtactcatttaggacctcccatcttgttgtagctagtatggtaaaattcctcttttctaatactctagtatttagttactactcttgctgtctcgcgaacgtacccacgtactattcctcccatgcgtcggacagctgagctatctgagcacctaccatctcagctttgactgatgatatgcttatggctcatgtgtgatgttaattaggccgcacatgacacaaaccccatgggctactacttttgcttttagccatgcatgtgatttaattaggctcctagctagttgtgtgttgcatggtagttgggtacttcatttggttggaccgatgagaggagaggagatcatatttgtgacaatgatatataggatagggtgtgtgtactagtgtatgtgcagcagtagaaaactcgtcttctcttccaacggacgggttagcctaccacgtctattgggggtgcagtgtgagtatatcaccatgtaattaccatggtctacatgttattgtctcgtggattatcagggggacattctcacaacgtatcaactagaacagtagaactagagattcttttgcaatgattttgagtggaaaaccaacacgataaaatcgcagctctagttacaccgatacatcaattctgtcatggaagaaagattgtaaataagggcatgcacactgacaattagtagtgagctcttatagtttttagcaaagtaagtttgctcatataaaaaaatattggaattatagtatggaataaagtccatatgaggtgtaatttatatgaaaatcacaaaggaatgcctcacaggaagagagacatgtgaacttttagtattaccttaccttactcattctaggagagatctctttaaaatggaaagggctctcctagtgacttgagccatgtataatggagagaattagaggaacacgtgtgtatgcgctcactcgccttacacctacattacgacttatggagatcatgtgcaggcattctaatcacacatcttgatatttccatatgatttgagttgtcgtctctacgcaatacatgcgcaaaacaagataaagtttgcctcctcctctgtattacgctatcgctactctacatttgggcgctgcacatcgatgtcgacacctgatactgcacggcttatctagtttggttttatgacttttggggatcgtgcatgtgttctaatctcgcattctgatatctccatatgaaccgagtcaacacctatatgcaacacacacgaaaacaatctaaagtttgcctcctcctctatattgcgctatcactcctctacatttgggcgctacatgtcgatgtcgacccatggtactgcacggcttatctggtttagttatgacttatggagatcgtgcatgtcttctgatcacgcatcctgatatctccatatgaaccgagtcaacacctctatgcaacacacgcaaaaataatttagggtttgcctcctctctgtattgtgctattgctcctctacgtttggacacatgcatttagttccatgcacgtagtgcgaacttgttcttttttttttgtgtgtgtgggggagggagcgaactcacgcgccgtcacgtgttcgtatcttcgttcagcggtgatgatatatttttatcaattctttccaacttatatattcatgtaaaatcgtttaaaaatatatttttaatgtttttcaacatgctctaatgcttgtttacatacttatatttttcctggcaatgtgatcagttctgtggctgtcgttcgatactttttgcgttgcttcatcaagataatgagccatcctattctatgtgggcacaccgtgtacttcttctttccgataatgcttaccattagccgtccgacacggaagaaaaaatcggacgcctcaatccaaatgcatggtaagtctgaacgtgcatgcaagcatattttaaacttaaaatgattttttctctcaaactatttatctaaatttcaaactaattatatcgttggatttgttatagttaaatctttataacaagatttcacatgactatattctgatgaccttttttttactttttaaatgttgcacacattgttaatgtatgttccaacaagtatttattaatgtttcactaatgcattagcaatgttgcacattattttttatatgtttcagcaaaaaaaaattttatgtttcagcgattacaattcgatgcaagctaaatacaaaaatattttaacaaaatcaaatatttgcaaatgtattgtatcatatgattttttttcaatgtttcactaattgggacataatgtttcatgcagtgataattaccgttgcagtcaatactttttatatgttgcatctctggaatattttatgaactaggttgacgcatctgcacaagtggtgaaactttttttagacggtgcaacataagtttgattttttaataaatatttttatcaaaatatatccatgtgagatcttgttataaagatctaattatgacgaataaaatggtgtaatagattatatattgaacacatattttagaaaaaggaaaagagagagaaagtagaaaaatacatgcatgtgacatacgccatgcatgcgccacaagccaacatgcaaacggcatacgatgctcatcctgacgaatgtgccagacgccaaggatgggcgggcgtccgatatttgataaaatatccaaaaatgcttgaacccgagcgcccgatccgtgcgccaaacaatcgggtgatacctccacgcgccgcgcttcccgcccgtgcccgcgcccatgcatgtgtccccaccactgcgtcgctcctgccacgtgtccccaccacgcacaacgttgcaacaaatcaaccacatattttggaaatactctattaagggaattcgttttatttgttgtttcacataaaatgtttcacctagtgtactcacaatatttcactatgtatagatctaatgttgtggtgaactgaaacattctttcgctatttactgaaacattgtttttatataaggtgaaacaacgcccgatttaaacgactaaaacattttcgatctacttagtgaaacaattccgttatacttggtgtaacatcgtgcacatttaaaaataattcaataataagctaattttttttcgttggaatatatccatgtgtggtcttgttttaaagatttaattacaacgaatttaatggtacaattagatcatgatttggattaataatttaagagaaaaaatagtttaaagtttgcttacaaaacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggcattagagcaagtgtaatagtagagctaattatatagatccacattagagttaatatgtacagtagatgagctatacatatttaatgcatttatcttgaaatatagtagcaaaatactcaacctttgctttggacaaaataaaatatattataatatgtaatagacaaaagaattattgtgtaagaggtaattttttctgggcctgtattctttttctaggttcaataggattcttagtggttggggctttcagttatcttggtaagaatattatatctgtacttccatctcaacaaattcttttttttctacagggggtcgtgatgtctttctacggaatcgcaggcctattcattagtgcttacttgtggtgcactattttgtggaatgtaggcagtggttatgaccgattcgatagaaaagagggagtatcacctgtttgcatttttgaatatatggtattcacgtgttttaactaaatatttagattgtttcataatattagaaaatatcattggtaaatttgtaaaaactataaaccgtggtggagtgccagatttactatcaccaccactagagacttttaaatgagtatatatacgtagagagttagcttttatatgaaagctaatcattttaatttttcaagttctattctccgaataactttataattgatttaggcttagtactccatattaaacttgaactcatcatcgtcatgtcggctgacgacccagcaaaactccggtccaaagccggagggcatccgcgacgacgaacacgcacttgtacttgctactatagctcattagcttgtactccctgcagggctacaagtacgaacatttggtaaaatccttatcaaacacgacgaaaaatctcttccctcgaaggctcaaaaatcctcgatcattgcctatgtgattggtccaagcatgagattgctgatcgactgtgtgggttaatatcgtaatctttatttatgcgactattaattctttcgaacttttaatgttctggcagatgaacagattaatgagcatcagtcaaccacgtgtgcatcttttgtgtagcagagcaaaatcactgaaatttttatattttggtcctttttgaaaacttattttacaaata

SEQ ID NO: 26138 - DNA, 868 bp, Oryza sativa
cgccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgtgcgcgggacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggggggcattagagcaagtgtaatagtagagctaattatatagatccacattagagttaatatgtacagtagatgagctatacatatttaatgcatttatcttgaaatatagtagcaaaatactcaacctttgctttggacaaaataaaatatattataatatgtaatagacaaaagaattattgtgtaagaggtaattttttctgggcctgtattctttttctaggttcaataggattcttagtggttggggctttcagttatcttggtaagaatattatatctgtacttccatctcaacaaattcttttttttctacagggggtcgtgatgtctttctacggaatcgcaggcctattcattagtgcttacttgtggtgcactattttggggctgcagg

SEQ ID NO: 26139 - DNA, 588 bp, Oryza sativa
  unsure (1)..(588): unsure at all n locations
ccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatacacgcataaaaattttcttggtcactccatcaacgttgacaaccctatcaagatgagtatcgatgtggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26140 - DNA, 15040 bp, Oryza sativa
  unsure (1)..(15040): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatggttactccctacttctgtcagtgtccggtggcccccccttgatagtatcaattttttctttttgagaacattgatagtatcggttgctatgcaattgtggatagtgttcactgtattgtacttctcacatttacccttttccccttacaatatactccctccatcccaaaaaaaacctaatcctaggtttgaaccacacatgggttcaggttcaaacctaggattggtttttttttttgggacggagggagtacatcatccgtgactcatccaataaaaagtcaaattctataattgaatctaaacataaacttatttatgtgcactcgtatgcctgtgatatttttaattaaaatttataggtaaatataataatttaagaaatgtagatatcatttcgtcaacttcctcttcctatattcatcaaaatattcttaactgttattttcctcgggaaccattatcctttctctccctatcgatggccggtgaaaagtgaaagggcaacttccttcccctttgtcgaaggccctctccccttcgcctctgacggctgcttgtcactgacgaagggggagggtccaaggagatgtcgggtttatctcattgtaggttttcctattccccttttgtacatagctcgaaggagatgtcgatgctcgtcttcttcgtctaggatgcttccttccatggatggcttgagctcaactagagcttgttgcacctcatgttgtctgcaaggttgctatggagttattcacctgtgtttgggtcaagcacaacagattttccatgtggtgggaagtcttcttcctccacaatgacaaggtggcgttggccgttcaaatcctctttggcgaggttgctgctgccgatttggtgcccttccttgtcttcgacgaggcatcttcaagattaaactgaaacttactaagttcattgagtctgcttcaaccttcactttcgcgaggtccctgttgagtttgtggttggatgccatcttttatggtcaacgtcatttctccgtcagcttcaacatttgggtcaatcgggagaagaagcaaatcaaggactgagttgctttttctatttcttttggagtcctttgcatatttcaggggtcttctgtaacttgtatttcttggaggccttttgcaagttctgttgtacgtctatcagcttgttccattgcgagcaacctaatctctctttgtttgagatatgttaaaatcaattatgcaatctgtatgtgaactccatatattgaagaaatatgtaagttttcttttttttaaaaaaaaaaactcatcatttcctcaaacttggcccactcagatctcatttgaagtaaccatcttctctgtatgaaacactgacactccacaagatactaacttgcttttaggacaactccaattgagcataaatcaaataatgggcaaagatgaacgaatagagcacaatgtgacgccgattgttaagtgtcagaaaaaaaatcccacaacccgtcgccggtgggattctcctccaggtctggcaagctgaagaggagtacatcagagctgcaacagtagcctcgcccctaccgtctacaccatcacgctgcgtcgcgctgccgctggtcgttcgcacctcctacgaaggttgttgggctcctccctacctccttccttccctctctatccaacggagacaaggcgtagtggtgaaacaggtggcgggcggcgaaaacaggcgaggacctcgcctctgttggtatcgtcgcctgctgaggtcgagaacaaggaagaaaggaagagggggtggcgatagcaattgaggcctgcctcgccatcgtcaatgccgctgatggtcggtaagagggaaagagagaggtgagagtgtctggcaggctggcccaccatttaaaaaaaaatgatgattgaattgtcacgtatacgtcatgtaggacagacagtttcggattgagtcaaggggttattcacctggtatagacagttcagggtgtaaaatatcccgtttatggtccgagagtataatttgtactatcgtgatagttcataaggtgcctttaagaaaaataaaaaaaatattagttgcagcggagagacaaacggaggcaactacgcaagtgattggagaaagatttatttatgtaggtcccacaatttggcattaacgctgcttctaccgaatcaaagatttgttcgtctttcgtgacttgtttgagtcgaacgaggactgaggatgtcctcgtgtggtatccaaaactctatagagaatataactagggtatgtgttgacccatgcccttacgcgacgagatgattaattaatgataaaaatataatgctaattcattttgtaacactggtttgatttgtggctgaaaccctgaggcacaactcaaataggatcaggttccttcagttcgtggataaaaggataatcatatctcttctttctataaaactaatgcccactacacacctaaagctcaacatgcaagcatagcatttattagcactactaagacctatatgcaagcatatcacatcaaccaattaagctcacgaaactcaacatgcaaacacatagtaattatatctacaatttattttattctaaaaataaacatacacatgttaaatcatcgttctcaaatcattttcataatatttcaatccaaatcattcatcatttctctattatctaacatatatcctacagcaaaacgcggggtgtcatctagttagtattaaagaggagtgacaaagttaaaaagaaacataaatggtcggcaaggtcaaagtcaaagtcaacacaaagctactaggtcaaagtagtgtttattgtctcgatcactggatgatgactcgagccatggcccaattgatgggcccatgcgtatgcgatgggtcatacttttctctcctaatcccagactctaatttggctctagtcaatgcccggtttattagcctttccaaatcgaaaggagcagcacgtgttttaatacttaggagcatcaccaacatatctattaaatagatccccaattataaaattatgatattttatcagaaaattatgctccagcaatccccctaacaaatttccaaaaatttagaagtctttagaatcttaattatataattattctaagttgagatttgcataaattattggttaacacagcagggcgagatactcgcttgctagagagatatttttgtactagaagctagcacgattaatggcacgtggtctagtaacaattgtcaaaggcatcaccaaacaagatggaacgtttttagctgctctgtaaacaaaaataaacaaacaaacgaaccaaacaaaaagttcccaacatgtaacagtgagatgaacgaaaaaaaatacgtagtatattatgttttatccatgtttaaaatgctgaactttttctaattctttcttctgtagcttttgcggcctaaaagctagtactagtactgtaataatgagttaatgacagctgtgaggataggtttagcgattatagtctagagagctcctagtttcctatcaacaaaattaaaattttcaaaaaaaaatcgtttttatatgtacgtgttctctcagattggcatttttgcacgtgttggatggaagttatcactgtactgaaaaatgaagacgaaatgctatctcaatccctctcgctctccgtttggtgaaatccacgcaaatgagtgcaaattaaggggctattcactttgatacttaaatcaacttaccaaaatttagtactgttaaattttggcatcaccaatattgataaggttgagatgtgtaaattatgtttagtttgttaattttgtggaaaaatctaatatattgtattctgatgttttctcgtctattacatcgatcctctcatgggatatatataggagtacatatgggatagagacttagagtacaatacaagtaagagtagatttatctctaggattctatctctaggactgtatcttatctataggattctatctctacttctctaggatatatcttatctctataatttgtttttgactcttatctctaactagtatattatacttctaacattctccctcagtcgtaacgggagcgaagcgaacgattgcgactgtatttgaaatcttctatttcttcatctccatcgactcaccatcatcgattgcatctctgatggacggtcctccacctgattcctgcgtccccatctgtgtcgtcgcttgactctcctctattccctcccgcagtcatagcaggagtgtcatggacgatagcgatgacacagacactttgactggagtttccgtcaatgatttttggtgtagacgttcgtcaatgtagccgatcatgtagtagccgtagtcgtggtagttgttgtagccgcatatagccgaaggcgaaaaaaatatttacgccatggtgtgaagacgaaactgtaattgttagcatcttgcaccttgtagatgtcagaggatgccattggaaacgtcttgcatatgtcagaggacatcgttggcgatgaggccaccactttggttggttctcctgcgccgtgtagcggtcatcacaatagtgatgccgggttgatgcagtcgttgtagtcgtagatgacgtgatcgatgccgtcgtcggtgacgcggtcgttgccatcgtaaagaacgcggtcgatgttattgatgaagcgtcttgcagattaatctgttagaggacgcgggatgtccatccttgtggacaagtggcggcggcgtgtttcccttgttgatgaagaccatcggcgatgttgcatcggcgaagacaattgcgcagtcgtacggctgatgatgatcagtactgtcggtgtagatgaagtcgtgcgcggggaggtccgtgcgcctgtgcaccgaagtttgaccttctcgtgccttcccgaggatgtgccacacgatccatgcatgcatgcgcatgacaatggttgtggttgttggcttgctgcttctgctcatgaggatcatggagctaatgaagatctaatctaatgctaatcattacttaatctaggaatttttttcaaatatgttgtattctgatgttttctcgtctattacatctattatctcatgggatatatataggagtacatatgtgatagagacttatagtacaatacaagtaagagtagatttatctctaggattctatctctagaactgtaccttatctataggattctatctctacttctctaggatatatcttatctctataatttatttttgactcttatctctaactaacatattatacctctaacaacttttgccaagattttgtgagtgaaatattctagatcgaattaccaaactttagtagtggagataattttcggcccaataccagtccttaaacccaaaagctggcagcttggtcgcttggagcctggttaacagttgtatggtctctagcccaataccagtatttttcagcccatatatatctgctggatcaacatacggtccaactcatttgatagccaacagcttataaggcctacttccagagttccacttgggacgatttgtgaactgagtgattttttttcctctttttttcaagatcaagattgaacatattatttttctgatttagattttcataaccccccccccaaaggaggtcctgctgatagggatccagctaattaagtctctccaacatttgtgtcgatgcagattgactgccgtgcatttgccagctttgtacatgttacagttgtgtgctactccatctcataacataagatgcgtacatattttaaaatttaacttttataagaattgatcaacggttagtattatatgaactgaattttatttgctgaaaattatcgttggattggtatttgaatgtacttctatatggttataatttggttattacaaatcttataatatatgaaaaattataagctaaggattaattttgtaaaccataccaagtttgatcgtgccttatattatggaatagtgagagtacaacccaccacatataaaattcccatcgactcgtattcctaattaagatcatgatccttgagttattttttaatggaaatataacttctggcctctagcctctgcatcaatactatcaccgtcctaaaatatagcaacctattaatctaatattggataaaacacgttgtagtactatctatatattaatctaatattggataaaacacgttgtagtactatctatatatatgaagcatatccagattcgtagtagtactagtaggttgttatgtttaatttggaatggaggtggtattaaggatgcacactgacatatttataaacactgagatttgaacccgatcgaaccaatcactccaccaccaccacaccaatgatgtttttcaatgttatttacttttaaatttcccaaatatttgataatgtcaatgcgcatacttggtttgggaagattagttgtagttactagtgttatcttcaaaatgaaactattctctttgtcccctctccgtaaaaaaggaaaaaagaaccaacttctaagtaatataatcgctgatcacaagggcatgtactagaagactatgacaagaaattgataacatttgataagttttcttaaccgacgatttttctatgtatggatgaggggatgaaaaacagtggccgaaattcctaactgaattttgatgctaatttgttttcgtaatagaaaatgccatcacattaacttaatttgtctgtatggccgactgaaaattgttgaaattaactgcagtactttatatatcctttacttacaatattttccacgtctaattaagttcttttgtcgttcacaggcatgtcttcatccaatggcgaagccacagcagtgccatcaaacctgaacaactaatagttttattcggtgatcgataagttttctgaatgttaattgatgtctatctaatggatacatcaacgatgatgagtttgagtggctgccgacctatctggaagctcgctcagcgctgaagaagaccatggaaactgtaacacacattgaaatttgaaaatactagtcattaatttgtgttccaaaaaagcttgctgatccgccgttttctattacaattatagtatacatgcaggagaaaatatatagatgcacttaataattactacctctatattttaatgtctgacacagttgactttttgttcaacgtttgaccgttcgtcttattcaaaaaatttatgtaattatcatttattttattgtgatttgattcatcatcaaatgttctttaagcataacataaacattttcatattttttttaaaaaattgaataaaacgaatagtcaaacattacttaaaaagacaacgacgtcgtacattaattaaaatacggagtgagtagtcagtagccccacacaataagaagatggtggtgtacgtggtggtggcctgctagtacgtgcatggtgacgaaagccgatcgacctctagaaacgcaataattcgacgatggaccgtgcatgacgaaagtccatgattggtgcgattaatttctagtcgagatacattgatatatcgatgagacgcattgatcttgtactggtagcataaaaaggaagcagagaatctcgaaattaaaacgtacgacgacctcacacacataaagttggcgttgacctccaaaacatgttcagaacaaattaatctacgaatcacaagctagaacctcactgaataaatctttgttactgctccactaacgtactagtcatatttatttgtgggcaattaaggagattctcgcaggacaggaggaagaagaagaattatatctctctgtgattcgttgggttgtgtagcttggccgtagcactattgatggctgaggacctagtctattgattgcctatgatttagtataaaccataaccaattagtgattgaaaagtattttatagataaaacttttatatatataatcttagcgacttaaaaataagtactgaaaatatgtaagaaacatcaaaatcaattttaaaattgaaaatttgaattttagtatagtggtttataacccatatagtgaacaattaatgagaccctgagacataaccacttcatttcctgaaaacaaccaatcaaattgcacaatatctatctatctatctatctctttttctaatgacttgtattagacagtgtgaaatttatattgatagaacagaaaaaaaattacaaaattataaccatggaagatcataaccaagaaaaaagaaaaaaaatgacccacgtaccgacaacactaatacatagacccagaagaaggctagcaccgaaccgaccgccactaagcgtgaccggtcgctgctagaccaacgaaagagtaaagttgacggcaaactaattaagctagtaccgatcgatctatcagtgaaatgcttgcaaattaagctccatcccagtaatgcaattaattaagccctccaattaacgaaacgtggatctcgcgcgcactcgcattattcttgcctccaaatcgatatgatatgatatgatcgtcgattgatcactgcagtggcgcggccggccgggataagatcacaagaaaactacttccattagcttctgttccatccattgttgccgtgagcgcgtggaccatccatccactgtcgtcgtcgccactgccgacctacctccatgtatgcagtatgcatatatgccctgacgtcggcgatcgatctcgatccctcgccggagcggcggaaacagcgacgtcaacggcagctaagctagctagcccagctccagttgtgtgacgtcgtcagctagctagctgccactgagccagccgaccattaattactctatccatcaaaaaaaaaaaagacaaactctgctttccgtgtctaacatttgaccgtccgtcttatttaaaaaaaatatgaaaaaaattaaaaagataattcacacataaattattaatcatgttttatcatctaacaacaatgaaaatactaattataaaaaaaatttatataagacggacacataaaatattaatcatgtttttttttgaacggagagagtaattgctaacctcacctcagctccagctctgctagcatgtactactgagcatgcagtgacacggacgttacgtggcacagtacagttctttgtttgacgagatgatgacccccagttgcatgccatgtgctgaggaacaatctactctacctgccgtcgtcgaattccgatggcgcccagcatacacatcagccaccagatttgttccatctctcttcctcgctaaattaaaaataaacagacgaaactgtggatcccaataataaaaacgataaaatttctgtcactaacgaaacaaacaggacagagataagaaaattttaatcaggccgggtcaggtcaatctctaaatcaaatttaaactattttaatttctcctccacgattagctcaatgcgtcgtcgtcgtcacctcgacaagttattaatggccgcttccatagtccggccacgagacgccacccagggccccacctcctcctcctcccgtgacgtcaccctcccccatgtgctctcgtcgtctcccccctctccagcttatatatacacccccttctccggatcgacggcgaggtgagagacagcgcgcgccaccgccgccgccgccgctattttcgtgttttttgatttcacggtgcgcgcggtggccggccggagatgcaggcggtggcggcggcggcggggatgatgcggcgggggagcctgacgatagacccggcgggggaggaggaggcgccggccgagagggtggggcggctggtgcgggagagccccgtggtggtgttcgcgcggcgggggtgctacatggcgcacgtcatgaggcgcctcctcgccgccgtcggcgcgcacgccaccgtcatcgagctggagggcggcgcggcggaggaggaggaggcggcgctgggcggcggcgccgcgctccccgcgctcttcgtcggcggcgaccccgtcggcggcctcgagggcctcatgggcctccacctcagcggccgcctcgtcccgcgcctcagagaggtcggcgccctctgcacctagcccgcggggccgccacgtgtcccatcgtcgtcttcctccgtcctatcctctctaccatggcttagctccatgccttccatgtacataagctgggttatctccgccatttcagaaatctagagggggtggggtgaaaaattccacgccgaaataatactaaattttgtttgggctcatgtgttcttctggaaatcaaaggggtttgtgagaaaattcctggatctaaatgtgattattaaacagtactactagttcaatgtttatctttttactgtttttattatttcaaccttttttttaacagcagcttctggctggtagtgttacacccatgcatgcatggcatgcatatctctcggttaaattaagtatgggagtacctatacatctttcgaaagatttttataatcgtatcacacagatttttaatctttgtattaaaattcgatagatataataaaaagcaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagttttataaattacactgtaacttacaagaaaatgcactgtaaatttgagtgagaaaatcgagtgagagataagaaaaaaatctttcgagtgagatatagcaaaatcgattaagtattctcctcttctgttttgtcctgatgtgatgtgtttttggtttggtgtaaattaaattactacacatgactggcgtataatccctactttggaaggcgattattttatggcagcaagataacatatttaaagtgcttgtggtgggggtgggtaattaatggaattagtatacgtcaccccccaaacttagaaccctaattaatggccgcttgctttccctgccaatgaattttctcatgatcaaaacaacgttcaatacaaaccaattggcaaaagtaattaagcgatgatcttgttaatttgatgtgattagttgtcagtaagctgcttttccgctcctcttgttgttaattgtaattaattaattaattaagatgtatgtattcacgttgcttttgggagaagaaattaatggaagaagaaacgtagagtaaagatcagtttagggttgctaacactgcaaggcagggcattgcaaggcagagtgagatcgagttgatgcatatattaatttttgtttaatttgctcgatgcatgcatgcatcatggcgtggcgtggcacgtgccctgctgcttaattcccggctatgaaaaaaataaggaaaaaaataaaagtataaaggcacccacaatggttatctataggctctctacaagagatccatgtcagcatattttactacttggaagagattaaataaagagagagcaaaactatctactaacttgaagacagtctatagagaaaaacgggacaatgtattagagaactatagatacccatatagacataccattgaggtggtttactattaatctagtctattgctgagatgtacatgttttatagagagcaacttactttatcattgtgggtgatctaataataggcacgaaatttcatgtgccgatcgatgcgtgcatgcatccatcgggacatgcagctgcagcacacgatcccacactgttcacccgtgtacgctatttaagcttcgaatcaatcaatatattcaataatcagtcaggtaaagctgattattattcgttcattacatatatacctataaaatttgaagttttcatgcgacgtggctgaattgaggaattactctctccgtttcacgatgtaagtcattctagcatttttcacatttatattgatgttaataaatctagacatatatatatatatatatatatatatatatatatatatatatatatatacatatatagattaattaacatcaatatgaatgtgggaaatgctagaatgacttatatcgtgaaacggaggaagtaattttttgaagctaccatacctagctagctaaccaaaaaatgattcagcttgacaagaatttcaaacgtggtatgtaccagtaaggattgtatgtagtttgacatatgtaatagttgtcactgatatgtgggtttacttgttagccactgctactttagatatagtatgacagaggatccgtgtcaatgtatatgcaagagatgctttagcctcgatacttgggcagttaaactagatttggttattttttgaagttgatatcagactgaagtaatcatcgtcacactttagacaaaattaatattattactagtattgtttaccctataagattaattgatacttatgcaatactttaggaattatgttcctatggttacaacatgtccaattttcttcgagtattcttgcatacttttttttaaaagaaacgtctataaagtttatagacacttataatatgtgtacactcactcatatgaatacaaaatatgcacaccttatataagcacctctaaaatattgacttgagtttgcacacgtggcgcctacgtggcaatccagtcagcaaataaaaaaaagaatgcctcccttgggcccacctgtaatacccctctctctctccccccggtcacactctctctctctcccgtgtgcacgcgcaggcaggcggctccggggtaaccatagctaaaactctcctcttacccggattcctaagaacccccatatctgcatgtagcttcgcccctgggcagaggtcgacgaggcgccgacacggtcctgttcgcacgactgcctccttacggaccattcctgcatcggctcgcccgccgcggctcccaacggtgggaaggtgggtgcggagttcgtagaaggggccgcgccgggttccttggcgcgcgtgaaggggagagagcagagagcagaggagaggagagagaggagtgcagaggagaggagagcactggcacgcctccatctccgtggagctcgtcatgggctcgaggccgccccggcgaccgcatcttctccgaccacgacaaagagaggatcgacttcaaccaagacggacgaggtccgctacccgccgcctggacaaggtccgtctccgccacccaacgactgagcaaggctcgtctccgccgccggccgcctggacgaagtccgccaccgccgcccggatgaggtccgcctccaccgccggctgccgaccggacgaagtccgcctccgccacctgctgccgaccgggcgaggtccgcctccgccgcctgtcgctggctactagtccaagatcatgcgcaagagagagcaggggggttgagggataaatctgacaagtgggcccagggagttattttgttttgttttgctgactggattgccacgttggcgtcacgtgtgtgatttctagtcaaaaccgctcaaaatagtgtttaggggggttatttgtccggtttcaataattaagggtgtaaaatatccggtttttgagtttaggggtataatccggtcgaccgcaatagttcggcagggtaattcgtactttttttttcctattttttctattacttttatggaaacaatatcgatacggacaataattttcttacccttttcacaccttcagatcaaattcagagcgctcacccccggtgctcaggttctgtcgattgaaaatgcaacggttgtttacttttgcatcggtctaatttcttttcaattaaattaattggtcatgtgtcatccttgtcagcttatatatgcaaacttgtttgtcggctagcttaattaacttgaatactccctccgtatattaatgtttgacgccgttgacttttcgaccaacgtttgatcatttgttttatttaaaatttttgtgcaaatatgaaaatatttatgtcatgcttaaaaaacatttgatgacgaatcaagtcataataaaataaatgataattacataaaatttttaaataagacgaatggtcaaacgttggataaaaagttaacgacgttatacattaaaataaaaatatggaggtaggacattatattgtttgcgtgcaaagtcaattttatacgattgtactatatgcatggacatatatatgtatactacgtgaccggtgagattctctctgactgtcattaactagtacgtacgcatacatgtatatataaaattcatttttgaatatatgcatagataaattcatagtggtggcatcatcaatgcaatctgcgagtgattattttagcagttgagttcttgtgcgtgatgagatctgattctgacatcgtttcgtgcgtgcagagatcgccaatgctgtgtgctagcttcaataaccctggggcggtctggaatgtacatttccttaattacttttttttagggtgaatagctaatatggtcactcaagtttcgcttcagacttagtttagtccttgagatttcaaatcatccaaacaagtcctccaaattaatcatttgggttaatatagtccttagacccaaaaaaagtgccacatgagcatgccaagtcatcctcgcatatagcggtatgaatgaaatgaccattctagg

SEQ ID NO: 26141 - DNA, 2261 bp, Oryza sativa
cccaaataattaatttaaagaacttgtttggacgatttgaaacttaaaggaataaactgagtccaaagataaacttcagggaccatattagctattcaccctttttttttattttatgtacggtgctttgacaactatattaatatattaaattatttagttaagtaaagtgaaaagagcatcattggatctgccatcaatattgcattagtatatttgtagaaaagacaaataatcgattcaaataaatttaaaagttaaatgagtcatatattaaaatggagttcctaattaccaaagcctgacaattaagtggttaaccatgatgattgtgtgctcgcctgctcggcctttgagcaatttttgtcgtgagcgaggtcattgattggcccagaaaaaaataggcccaagttcagatggaacccaacagtagttgatgtgggcctcgtaggatggtccagtacttcagctggtttgggcctgtgtttgtgtagacttaattgggcctcttttcttttccctactttatcaattgggcctcttgactagcttctctcaaaatatcgtagatttgatttttgagcaagttaatttattgcagaaatcatcgctccaccaaagctgtagttagcttgcaaatgttgtttaaccgcgtatcagattatctcagaatcaagcagagaaggatactcgagcacatgaacatactcaggggcgaagctacatgcagctatgggggttcctaggcatccgagtaagagaaaagttttagctataattaccccatctccaccatatatgcacccccctcatcccaacaatgtgtacccccaagcaaaccatcaggccgagcaaaggtaacaaggccaacagagaagcgcacaaccatgaggattttcttgtggtgcagcatgtttagttgacaaatttgccctgcataacagcactgttaactacttcacggtgaaacagaatgcactcggtggccagccgcagcctattaatcgtagcaggtaagggatgacgtcaaaagaaagttttgcaatttgctttcatagtttcattccattttttcgataatttcaaacgaaaaattaagctgttttgtctttttttttcttcagatgttgatgttggacgagtagttctccagttttggccacctattggttgtgattttaatctttaacttcttcagtacactgcgctgataactatcgtcattgggaattcccattttggcaagtagttttataatttaccgctaagttttcgttcttatatcactcgttcatgttaatgtagatactgaaatcaatggttttagtattgtttaccataatgttctttgataaaacatggtaggtcatacatatatcattttcgaacatggtaatatattgctactatagtggtgcaccaccctctgttttgctctagcttcgcgactgaacatacttattgaaaacccacaaagtattcattcctcttgattgaattgcagagacttaggggtatgtcgtttcttttggttaatactatatgtttatatgtttttattaatgggatctgttcacatgttcggcctccgtcaaaagtcacacaaccattaagttctattctttttttttaaaaaaaaggaatcattaaggttatgggacaaatccacttcttgtgcaatgatatccgctgaaatattggatagagattctataatgaaagttttataagaattatttcatccaaaacgaaataaaagatctctggctaccgattctaagagtgcaacaccattgtaaatagtatcttactcatactgtgaaagcataaaaaaaccaagagtgatgcaagctaaaagacaagaagataacatgcattcttttagataattctgtgtaattgaaaactatatagctatgtgttttcttgtttaaccatgtatgcattcactttgaattttttttaataaaggtatgcactttattttagttctatatatctgacttagcctaatagccttagccttggactttgaggcttgagcacatcctttatttttatttcggacttttcatggtactgaataacattagatatgtaatttgtcacatatttttatctggtttaaaatttgaactgaagggagtatagccgtcaaagttatatgatgaccaaggctgatgagcaacaattaactgattaaattgtgtctcgtgccgacgatgtcctccttttgtcgtggagcatatgcaaacatgcat

SEQ ID NO: 26142 - DNA, 17414 bp, Oryza sativa
tatgaacttattccgaatggcagtgtagaatcccatttgcatgtaagtacttgaagaattaaggccaccagcctgtaaagtttaagcaattgactgaaagatctgcctttgacttttgtaggagtggatcttgagacagcaccactcgattggaatgcccgcatgaagatagccttgggggctgcacgagctcttgcatatttacacgaagattcaagcccttgtgtgattcatcgtgattttaagtcaagcaacatcctattggagcatgatttcacaccgaaagtgtctgatttcggactggccaggactgcaaggggggaggggaaccagcacatctccactcgtgtcatgggaacatttgggtatgaatcatatccctcatccctctgtgttctgatggaatcacaatttctaatgcataatatgactatgtctttcttctcagatatgttgcaccggagtatgccatgacaggacatctccttgtcaagagcgatgtgtacagctatggagtagtgttgcttgagctcctcaccggtagaaagccagtggacatgtctaggcccggggggcaagaaaacctagtttcatgggctcgcccgcttctgaccaatgtggtaagcctacgtcaagctgttgatccacttcttggccctaacgtacccctggacaatgtcgcaaaagcagctgccatcgcatcaatgtgtgtacaacctgaggttgcgcatcgcccgagcatgggtgaagtagtgcaggccttaaaacttgtttgcagtgacggtgatgagggcctcggatcaggaagtttcagccaggaattggcggcacaagctgcagcaatctatgatgtaactggcatggaagctgagagggtgctgttatctgagatgtttggctcaacccctgtcttcactcccgctgcggattcaggttctttccgaaagcagtccagctcaggtccactgatgacaggcaagaacagaaagttctggcagagattgcgaagcctatcaagagggagtatgagtgagcatggtgcctcaccagattttgagacgcgctcgcagtgtagtaataggtgaggtttttttctgttcccttttcaatcttgcgaagataaatattcagttgaatggaaatagagagttttcaggcctagtttctgtacattactcatgtggagataaaaggctgtatagttcagaaatcaggatagtagcagggcagagcttgagctgtggagtattcaaggatttaatgagatgagctcagatttggttccatactaggtttgtctgcatttggatttgtgatgtcgtctctttttcagcttgtcagtttgagttcatttgtgattttctttgttttctttttggtttgagttatgattagttgtttggtaggaactgttgatgtatagattcagactacatttagaaatgcatttgttgcaatgaagatgataagcttctttttttctggctagttgcagcttctggctgattccacttgtttcagaagaaactgccatgtaaatctgacagaattgcttctgttcttccatacctctaacccagtggatgatgctgctgcatcagcaacttgcgagagttgatatgctttcttgagaatatggcataagtgctctgtttactacaaagtattttttttcagagaaaaagccgctttagggcctgtttagatccatttggaatagcaaatggcaaatggcaaaagttttggcattgcaaaagtactagttggtgtttagatgcatgttaaagttttaccattctagcaataaagtgagaaagagaaagagagatggagtggtcccaaagcactttttggcacaatttgctactatggactagcaaatgccaaataccaaattgccaacttttactactagtgtttagatccaaaatggcaaaaagtacaacaaaatagcaaaacttttgtcattttggaagatctaaacagggccttagtttatcatgccctttttcttcagtttggggatgaaaagtttcggcattgatggtgcaatcttcctacccttttgttatcctttaccagttacacatcttccattgaaaggtgccaaattgctatcatgtagtgctaattaagaaagctaaatcatgtatatcctttattccatagtcctcacacggattggaagaacgggaaaatcctaagcttttttgaggatcaaaacctgaaaaattcccttatgaagatcaaacaaacacaagggctcaatgaaaaatacagttcagagaaaagagtaaccttcgtgtaggtgctaccggggtagccactgaatccggcggcggtaaggtcaccacggtggcgcggttgtcggcggtgccatcgccggcggctcgccggaggtcggcggcgccaccgggttgatccgctcccgtacgtggatgagcaggcaaaggcatcttcggccttccaactaggctgttatattgggcctaaatgggcctattgggctgttagataattcagcccggtctagtgagaggtgttttgggccggccctattacggtgtctcctaagtactttttttttttttttgcccttcgtttacctctagggctcctgtcctctcaccgctcggccgccgccggcgacggcgaagacaacatttccatcgccatctcgccataataatccatggcttttcctctggcccgttagccctagccacattacgttgtttggggattgggaattgggaatcgggagagattcagagatgggagatcacctggggcatgccagatcgatgtgacgccgccgagcgccggcggcgagcggagcggcagggggcgaggattggcgctgcgttctcccctccctgaattcttccgccccgtttctggatttctcggtcgcaatccaggtaaattttacttgatcaacagcatgctgcatttcgcttctgttcatcgtgcatcgagctaggtggtagagaaggggaagagacggggatcgccgggaacgcgaaacggccggaggtcgctggccggaccgagctcctccggccgccggcggcggcttgagccgttacgcagagaaatgttgggccgccgtgagctccctggtacctcgtcacaggagtcaaattcaggcccatcgatttttgagagggattcggcccaatcaagtagtggatgattgagccgtatttctggattacttaggtgatggtgatgaactgatgatcaggtaatttttgcattttgctcgctgatttcgatctttaccactaggaattttacattttgtcctctacatgcaccggaattttcatctctctcttgtttccggccacctatcggccgtcgctgcaagaacataagcattggcagacgaagaaagaaatcagagatgtgcctcatgaaaagtgagactagatgggaaaaatatgtactacaaacctttatatgtagtagtacaaacatgtaaactaccgtaaaaatcaagaaataggatttatccatatcacgatgagtaaaacttttacttatgattaaaaaaatattagaagtaaaatatttactcatggttacatggataaattttgagtaaattccctatatacccatgaaaactcacataatctctttcatatccctgaaatttatttgatcccttctatacccttaaaattttgatcctttccatgccctgccgttacatttttcttcttttcactgttacgtttggttgcaaatgtctgttatgcccttgatgattaatttaggattgaatataagcatgaaaaagattgaaatttttgtttgagtgcaaagtgtgtgcattttatgaaactaatgagactataaataattatatatcagaaaatattgacataaattttgaaaataaaaaaatgtaataaacaaaaaaatttatttgcaattttaataggataatggatttttttttatcgggagcattcataaaaatagtatcgtgagcattggtagtcatatctttgtatgaatgctcctcattattttatgattttttttaaaaaaataaaataaatacatattttttatttcattatctaaaaataaattttatcataaataatgtatcgtacagcaaactcataactataatagtttcatgcgacaaacttttacattttcaataatgtaattcataatttttttatgttcatccaaagggtaaaatggatatttttatagaaatcagacggtcaactgacgggattggcatggaagggatcaaaatcaaattttgggtatataaggaagtaagcaaaattcaagagtatagaaggaattagctaaaatttcaggagtatacaaaggattttgtcattgttaaacgtctgtttttcgatcctaccgtcagtgttcgcctagaccatagtctagatgctagacgatcggttatcatcgagtttagagcctaaaccgagaattagaccgtttgaccatctagttagtcaaagacggttctagttctagactgtctcgaccacacaattagacagcatcgagatgagtgtagaacgtaaaactgtcgcttagactatagcctaggcaatggaccaatgcattttttttgtgtggcaggacatgaaactttgtgccctccccaaaaccaatatgttttagggttttcatcctattccatactcttcttctctgctctaagccactcgcagccacgaaatcgcaatgcttctcctttgctagttgctaccgtggaccttactcccacctccctccgacccacgactctacgagaggggctacatcttgggacatgtgtaagtgtgtttagtgtattcatttgtgtgcaaaaataatatgtcgatagtagatgtattgtctagaccatgtagacttgcatttagactagctagagtctacaggtggcggcgttgggaaggtggtgctcgaagaggaaaaattggggcgcgctaggaactttgtgctaggtaagatgactgaaagggtatttcggtcattaaaaaaaataacagtaaaaatggcgtgtagctgatagactgtggacggcgatagtaaatcgttgaggtcaaggaaaaagcgatgacatattatagatgtcgataaagtcagtagcatattgttgaactgtgacgaactcagtggtactgagcagagaatctcttaaaaaaataaaaagaaagaaaggaaagtgcattgcctagatctcctaaagtacctatatgtaatttatcttttatgggtgtgtctattttttttggcaaattatctatatatctattgtctacaaattagctatcttttgtcgaatctttattttgtcgaggtattttgctatatccttccttactttattttccgtatgtcgttaattgatcttagctattgtcatattagatgttgacttgctgggtcagtgctccaaaactcatatcattaaaataacattttgttatgcacttgcttcgtcctaaaataagcgcagcatgagtttccgtgtcgaactttaattgttcgtcttatttatttttttttaaaaaaaataaaagacataagtcacgtataaagtattgttcacgttttataatctagtaacaataaaaataataatcataaaaaaaattaaataaaatggacaattaaagttgaatacagaaactcatagcagcgtttattttagtacatttccatttttccttcctccgccgttggtgcggagggaagcgacaagatgatcaaccatagtacatcctatcctaggcctccatcggttggctttttttctaataagccaaaacggcttattatggaataaaaataaatttgtaggtaaaacttttatatatgtgttctttgtaacttaaaagccaatgctgaaaaaaaactacattgaaaatatttcaaaatcaatctcaaaattaagtttgaaaattcaaaatttggcttattctttagctttagcttattgtaccatccgatgggagccctactccagtgcagtgttaaaacacagatcctgtaggaaccaagcatcattggaggggtttaattagagatagtaaacgcatgcacatcttttcattagcagagaaaaagcgaggctagtacgtacgttgagctaagggcctcgggcttggggtgctatttcatgtcaacgggccgggcaacaaaagtttcggctttctccctccttcacctgtctcccccatcatcaccatgcatccatccatccatccatccaaatttctctctctctctagacatggagatgcagaggcatgcacggccatctaggctaggaggaacgagctgggtgtagtagtgatggcctacacaaagtttagattggtccaaagtttaaaatttggttaagattaaagacgatgtgactgagttgtgtgtataaaaggtttaatgtgatggaaagttaaaagtttaaaaaaaaaaactttagaactaaacacacccactacaacctcgatcgcgatggccgccaacatttaccgcaactttctcttctctcttcttcttcacacaggatcaatcgacgcgacccccgggagaaagttactactcgtactccgtcatctcatctctctctctacctcgtcgtctccatctgctattctgcatgcatgagccaatcgatatactcctacgccatgaccatgatcaagcaaagcaatgtacacctgctgctgtgagagttgcaattctccacggtgcatcatcgatcatcaattactgctgctgctgctgccaggtaacccagcagaacactactactacgagctggtacaatagcagactattagccagctataaacatattttaatgagataaacgataagagagaagaacagcgggctacagatctgtagcaagctgcagcatgaactccaagacattgtgtatagatgaattgaagctaatagtgggctatgctattaaacttgctctactccagcagagtagactagtgtatggtgtttctctctcatctgtgatggatggaagcatgcgcacacagaagaagaggagagaggggtactcactcctactgagaaagggacacgtgacgagggggggattgtccggtagcgcttggcggcgagccctgactttgatgcgtgggaatatttggtggcaaagtaggctgcacttgtctaccaaatgtccatgctcaattccaaacttgcagcccctctactaccaagctcactatgcacacacagcacagcttgcattgcatatatatttttccagctgctccttgcttaattttctctcctctctctctctctcttttgatcaggctgaggctcagcagcagaagcagcagcagtagtaccccatcatcatgcatccatggtgagagatggatggtcactcacatgtgagcagtagtgccgatcttgccggactctgcagggccacccactgcccaaccatttcttggctaacttgctacgactacacatatatacctagcaatgacatgcatgaaagccaaacacaaactgctccaatatctctatcttcttctttagtttctgaaaatgcacattgacatcatttcctcttcaatggagtagataaactagataagctatgtttgagggataaatttaagtatgacacataaatgggggctattgctaataatataattatactctttccatccaaaatatgaaaacatttctaggccactgattctaatgcacaaacaatgtacatttttaaccaatgagatgcttgggaaaaggaatactataagcaattcaaatatcaaaatttgactactgaattgaagtgactagaagagaattctttttccctccacctttgtttttgctgaagaacctaaaaatgtttatattttcaaaagatggagtatttcaagcttggtctatggtgtttttttaatatattcagggattgtttcctgtttctgctgccatgaaatcatgaggattccctggaacaagacaagggggaaatacaagcatttgagatcaccaaggcatggccaaaaggaaagaaatggatggcatggctggcttgctggagctctcgtctgtgtcgtctgtgatcaatcatgattccgtagaaactaccaaagcatgcaaaaggccaattggcataaaaaaaacccctggttattttaattacctacagcagcagttgctcctatatctatatatgcgtgtttcttcatgtttgatagtatatgaattatgagtatataatgacagaatcaaataaaacttttatgtgtcatacttgaattatgagtatataatgacagaatcaaataaaactcatcgtgcaagattcactgatttgcatgaagtttaaaacgactgctttcttgcaacaaaagatcttagcattcaaaagcctaaaattgtgtaagatgcagtgtaatacagtacattctactattcactttccagaaaagatgtagccagtaggacattctacggaatatcttgactgttctgtcttgagggaaattaaagtagctaactctacataatagttgcaattatgcccattccatgcacctagctagaaaaaatatttatattcaaatggaagaacagtttttctctaccatgcatgaagctacagcacacaccatgagctagcccatgcatgactctggagggaattggcaactttatctgacattctgcctatatatgttgttaaatgcctaatctaataactgcagagtacacacaattaagtactggtgtgaagaagaatatgcaatggtccaggcagggataataatacggtttattcttgtcaaaagtaacatgcctaagccctaaggtatgtctattgattgatgttcttacatttgaaataggcattggaaactattttatttgtataaccaaaatgtgaaatgaataaaaagagtactccaatattaaaaaaaaacaaggcattaactttactgataatgtcacaatactgttacggctgagagagtgagattacactgggtagtgtttatttccttgtcaacgctttattttaaaggcggtttcagtaactataatgacatagtagttctcagcttacagccttacactgctgcattgattaaagttctcgaattactgctacggctttctgaagcagtaccgtgttttcttctgaaaaatgtttcataacatttcacttccaatttcattcattttagcagagaaagcatttacatgtactccaattcagtttatcagaaatgaaggaaacctgtgcagttacaactaagtatatacgggcaacaacatgtgcataacatatgaaaaccattagcccataattaaacacagattttgaaaattttacttcatcacaccacatttattttccagataagttattaattaagtgcacccccagctcaaaatgcatgcaaatccattcttcaggaactagaaatttaagggaatgattaatggtaacaactgattacaaatggagctctaatggcagtagctctacacagctttatgagctgagaatggctaaaaattttattattacagtaggaagatgaattaactatgatatatagctagcataaacaacagtatataatttgaaaagttccatatatatgaattgaacagcccataccctcccaaaagaacatcgaattattaaacctcaattggaacatcaaaagagagagagctgggtaaattcgactcacttacccagctatgaaataatcttgacatgatcatcatcatcaggcagttcttgtcgaacgatcgatgagtagcccacgaacaaaatttgtttggatttgcttgcatgattcattcgctattcatccatggcggccgaggtggttactagctatgccatggcttgttgctgtggtggtggtggtcgtacggcgccgccgacgacgccgacgtcgtcgacatgcagggatcgaagccggccatgctcattatgttgccgtgggagaaggctcggagacccaagaagtccctggtgaggccgtcgttgccggctccggcgacgccattgccggtgtcacgatcggacctggcgcccctgctgctctcgtctgctgcgatgaagtgggacgcttcgaaggcgagcccgtagccgccggcgccgacgcaagtgctcgacacgttgctggtaggaggaggagggggagcattggtggtggcggcgctgctgctgctgttgtgcgtgctcgccgccgccgccgccgccatgtgggcgtggctcgacgggcggctcagcgtcgcgcccatctgcgccgccttctgcagcagcgcggtggcggacatgtgcgccgaggaggcggcggggtgcggcggcgcggatgacgtcgacgagaacccgaagctgaggccggcctgctgcgcgccgccgctctccggcgtggagctcccgatgaactcctggtccagcctcgccgacccgtacatcgccgccggattccccgcgccggccatcgcctccagctgctgctgctgctgctgcgccgtgagccacgacggcgcgaactgctgctgctgctgctgctgctccctcttgaggcacagctcttgcatcagcccatgcccccccatcgccatcgccgcctggtgatcaagcacatccgccacctgcgagaagagcatcccgccgccatgctgctgctgccccgccaccgccgccgccgccgtgaccgccctcgcgctctcctccgccagcgcgtcgcagaacgccctgtgcgtgatgaagctgtcccgcctgcacccacaccgcaacccgatcatcagaacctccgacgacggccatggcggcggcggcggcggcggccacgagagacgactgaccgggagaagagggtgccgcaatcgcagcggtactcgcgggtgccgcagaccttggagtgggccttccagtcggagtggacggcgtagcgcttggagcacttgtcgcacttccacttcttctcgccatgcttgcggctgaagtgcttcttgatgccggtgaggtcgccgagggcgcgcgccgggtcgtggtggacgcagccggcctccgggcacacgtacaccttcttcctcaccacctccttggggttccgctgcttcagcttccatggcaggttgtgccctcgccggtgcagctgcaggttctggtctcgctggaaccctttcccgcagatctcgcacacgtacctgttcgtcgccatcagcgtcctcggcgacagcgcgatcacctccgcctcaggatctacccataattagttagttagttcatcctaaattcgattaactcgatcgcgatcgaagaattcggtgctgacctgggttgccggggaggctgcgcttcttcttggcgggaggaggagcggggtgggacgagacgctggcctggtcgccggacgccgacgtcaggttcgacatgttctcctcggcggcggcgagcagctgctgctgctgaatttcggccagatccttgagcatcatctggacgaacttctcttgaattctaccagctgctgctgattatgatatctgaacgtatgatcaatcgatcggcgatggatcaatatcaatcagatctcgctgcgccggtggcgatcgatcgcacttgcaccctgtaacttacaccgatcgatctctgacggcaaggccggccgggacgacgactagctccactgatgctgctgctgctgctgccactagctatctactggtgtgcaccttgcagtgtcactaccggcatagacggaatcatggagcttggctataatctcagcaagaaacgaggtgatgatcgaacgatctcaaattctcaattggcttctcatcacccgatcgatcgagagaagaagagaaggggagatcgaatatattggctggttgaatcaactatcaagctagggttgatgagagagaggagaggagaggagagaggaatgaggagcaagtgtgtgtgcaagtgcaacccctccacccattggatgacacccacaattcacactgaactatagctttctctctctatctctatcactatgtatttctttctttctcttactagggtagtagtagctttctctctctagctagctagctagctagctccgtgtcagcaacaccccacaaggatcgctgggcattctgtcttttcctttgcctctctctctctctctctctctcttcagactgtgatgcactggactcaagaaatcccctgtacatgcctgcctgcctgcttacctgctgttactgtgctctaatcccattatatgctcttccaatggatgttaattactgcctccaaagctagctgggagattagattttagggtcctctttggagagctcctgaagcagcacctgataaaacttaatatctctaggtattagatatctcaagttactaaaatttttacctgtgaatactttctttaaggattgtaaaaattcttcttccgaatagtgcccagatatacatgagctaaagtgcaaagacaagtagtggacaggtgggacatgggtcacaattgacaagtctgaattttgcttatgatcaccattgccctgattaattgtgtagggccctgattaattaaagctaatggtgttcctgtgcaaggattcatactgaataattgaatcttttttctacatctgaaacaaagcatataggtagtgagtgttaactaacttcgaaatgttggaacagggcgtgataacaccaatacatgagacataaaggtcgatctgagatcatccacttctctttttttccacattgttctgaattctgatcggtcactgtgcatgcatgtgtatctttcagcatatgcacatctctcctccagctttgggttaggtatcttaattacaactgttaaattagtggagataagtgagcagtccatgaatgtttgtttgcttcaggcagggcaacaaaattagggcacacacaaacaatcagctttggcgatcttaaaagtggggaaggaaagctagcagctagctagtatggcctgatgaaaggttggtatgatttcctggagaatgatgggcttcttcattcatttatgctgttaaggaagggagaaaagtgtgctgagttagtgggtgaagcaggctaagcaaaagggtcagctttttgcatttacacacacatcattggcccattgattgaatttcacagctaagtagtacagaagtagtagtagattgacatgcatgcatgcttgaaccctgatgcaaaattttatatatgttctccttccatgaaaatttttaaaaggttgtgcccaagtagcttccaaccattcaatctcccctcaagttgattgggggcttcacaagttatttaatactcctttagagcttaaacatgattttttttttcatgaataagaaagatggtgtgacatcccagcccagggcttaataggattaatagaatacttatatcaataagttgcaacttttttccggaagccgatttccaaagaactccggggttaagcgtgcttggcttggagtaatttgggatgggtgaccgaccggaaaattcttcccgggtacacacgagtgaggacaaagtgtgtagaaaagacattgtgttattccagagtagggtagtctacgacctatataagcaggcccggcctgggagcagtctggcactggatacatggacgtggccaagttgcaacttcttttccggaagccgattttcaaataactctagggttaagaaaatggtatcagagccgactctcgtggtttcacgggcgcgtgtatcgcagttgcgcaggcatggtgtgcatggctggtgtggacccggagtggtcacacagcatggcacatgtgctggcactggacaagcgtgcttggcctggagtaatttgggatgggtgaccgaccgggaaattcttcccgggtgcacacgagtgaggacaaagtgtgcagaaaagacatgtgttggtctatgaaccccgcgcattacgaccggatatatagataattaaggatggttgataaacatataaaaaaatagttgtgctaaaaacattagaggaattaagatttgcgaggtgagacaaggcgaaaatgaggtgaagatccatctgaacctaacctctagtttggaccttattagccatttgtatagacgtaataactaatctaaccgcggatgtttgagggaccaattgatccaataaataataaaaatatattgatgatgtggctcagcggggatgaaattctatagtaatttttatttactggcttgtaactctatgttagaaagtagaacgctgctatacgtacgatcgcaacgtccgactttgttacgacgtcagcagcacatgtcagattctattaccgaagtgagacatttatcgtccaagtgattgagccttccattgtggccgtggtcgtatacggtagctagacaataaggacatatgtatatcattttcctagaaagtattatgtttgctggaatacacatcttttttcctgagtaaattgtgctcgatgaagaccggccaaactggaaaagtaaaaacaagctgaaaaattaaagccaatgtcaatgcagatgcagttatggttgtcctggtgtgtgtcatgtgtggcaggggctttgtactgctactcagattaggtcatccaacgacaagagcacaaccacactttgttgcaaaagccccaaatttaaagcctgatcttgggtcccctaccaaagcaaaaatctcatctctggcctggccttctgcatgcaccccaatgctttcctttcatctctgcagggccacaccaccatatgcccatgcacatccatccatcgtccggcttcacctatggtttttcagattcacttcacacatccctagtttgtgctactcctagctacaaattgaaattccatattggcatctcattgttcatttcaggccccaatattgggccctccagccagccagtacgtatgtcctagtcaacaatgacaggacattggtaagttacccagctctgtctgttctgaagcacacagaaattttacagcatttttacacacaagtccaatgtccatgaaaatttaacctccgaaattcctatgttccaaaagaggcatgaatcctgaaatccgtgaaaaatcaaatgaatcagttcattgatatagggattgggggaaactcatgttttaaaatagggcttcagtaagatttgttattcaaggcgttcgcaaaaacaaaaaatagtgttcgcaagacttgttatgcaagtacttaaaacctatatatatgagaggagtaactaccaatgtttattaagaggtgatgaggcttgaagccgagccagctagcccaccaacttgtgctatacagtaaaactctaaggccttctttgtttaggcttataagacagttatgaatcgaaaaatctaaggctaaagctaaacaaataagtaattttttcgtttggcttttttaaagccataagctactttcgctattaagacaaaaactaagttggaaaaacttttttttgacttatgtgagagagatatatgactctatcattaaacttaggactttaaatccattagcttataagtaacttaaaagtctaaaccaataaatctagacctaaaaaaagccccaagtctttctctagactataagattcaaatggtggagctggtgctgctacggatttatggaattctttaccactccaggctaaagaaaaccacacgagggttttaactagctatgacccactgagcccactaaccagtacatttgttctagtgtgatgataagtcaacaacaataggacagtgctaaattcaccgaggcgcattttcaagaatggtaaatttacagtattttcacacctatcagctcaatgcccgtgaaaatcctgcaaaatccgtatgttgcaagagagacctaaatcctctggtataacatataaacttgtgaaaaaaaaaacttgtggattaggaggaaatcatcttcccaataaggcttaatatatactccttccatcctaaaataagtgcagccggtgaactacacggctgcacttattttgggacggagtgagtaattcaagtacttcacctatatatgacactccactcaaatggtggagcaggtgctactatgtacatatggaattatttaccaaaatatgagctaacaaaatcacctgaggatttgaaccagctacctgcagctgcaagttggtccctgcaggcatagatggatgcaggacatgtagaaagaaacaaaagaagatgtcagcaaatgaacagtttatagacccgtgggttagcatgtccttcactcaaaaaaagtgaacttttaaactacgcatagcttggttattctttcatctttgctaattagtttcctttggagacaagcaagggatttgatagatagatagatgggtcaaatattgttccacgtcagcttcactttgcttaatttgataaactgctcttgatttgtactggtgatccaaaaagcaaaacagctactgcgccaaaacattgtacggccgatacatattcttatagtccatgaatataatatgattgatccgtgaaattgaattgagttttctaaatttttggcaagttgttgatggagccttcttgagaggttggtctcgtgggctactttttccaatatgttccttcggtgtagccaggtacagtggatgtaacaattgatatcgacttatggtacagtgatcatggccccattgtctggaatccaatgttggtttttttgtgtattatgatgataaaaataaatttcttccttttttttttcaaaaagatccaatgggtggatggcatggcgcgctatttatacattttttttcatttgtccacaaagaatttgtttttagataatcaatgcattgaaatttgagggaatgggggacaaatgcatattagagtttgaaaatataacggacaaatacattaaagttaaaacaaagtttaagggcattctagtttttttttggctttctattaggtccaatgattgttccccatttccaacttacaccatcaacaccttcgacaccattgcattgttcatatggtctggtgagatggtgcataatggttaactaggactgtggcaaccttaatgttcaagattttgtttttttaaggggaaggcgggattattgcctgatcaattaacccaaggcctgataattattctaaaaaaaattctcctctttcgctcaccaaaagatatatactactacattaatgtagtgtatattagaagaccaacgacatttttatctttgaaatgttgagccatcagccacca

SEQ ID NO: 26143 - DNA, 14290 bp, Oryza sativa
acagggtaacgatacgataagtggaaattatagaaaaggcattatctgaaaagtcattgcaacttgcaaatactgttcatcaccattttaaataagcattttttttttgtcccaggcatatgcttgaactttttaaaaactagtaagcccataaaccctattagagtgattcacactctctcaacgaggatggacggctaacagcgaaactagctcttgctagatgggagcatctgattccagtggcaatggctaaacctagatcagttaaagatgaaaccaggactttgatagctcatttaaatgcagtacctatagaacagataggaaaaaaaaaacagagattatgaggtcccaatgatgactgaaaaagcacactaatgctgttctgctgtatgaggaaatatgctggatgagtacacataccagatgatctggaaaattttggaagtgcgctatgtggaaatctttgagccaagccatccgaacccctgaatctgattatcagcaaccatgcagctagagtgcaaataatcaatgctataacagtagacaagacggcaatagcaattaggctgccgttgactctttttttgggcctgcctacatcaaccccgagaggcttcattgcccttgcatttctgttgtttccaaatgccccgtcaccaacactttccggtgctgaaggtggagaaggaggaagccctgcacaaaatccatatctttggtgaaaacttgtggtgcagaaattcagcatgttcaacaatgagaaagtgcaagatggaataagtttatgtctgacattgctgttgtttatgagatcaaccagatgactataataaattgatagcagttggtggcattgaccagtgacaaaaccaaatagagaaggcacatcaaaagcacaagcaagaatacacacctggatatacaacatacagaatctcgtagtccccaaaacctgatggttttagggaaatttttttgctccataagttttcaaacgttaaaaaagcagtagcattgtcaaacttcacttgcattggtactaggtcaacaagaactactgtcttgtcaggctgatcaccagctacatttgcacccataacacgaacctgtctctgtgccatatttaccccagatgacacttcttccgcaaaatcagataccaatggaaagaatgaatacagatcaacacttaagcggactccaactttgattggtagaacacaaacacatggggctcccgcaggtggatctgttagaggctctgggcatgctaatgaattgcaatctgcatttataaggctcattagataatgaaacaataagagcacatatattatatccatctgtaaatcttgaaaggacatactaggtatgtgaacatgtaaataaagcatgcacctagattaggcggtggtggaggtaatgcccaaataggatgggctgatggtgctttcggccctggttggggagggattggtggcatggttggagaaatatgaggccctgaaaaaggcagcattttttttcaaaattcatcagacaagagaaacatggatatttaacagggagataaattaaggctttgagagtacttttgtttgaatgagtgggagtccttgatgacactggtgcagaagatggagaatacgcaggcaagttcgtatggcctgggcaggagaataattaagttgttagtgctatcaaataaaatcaggacccatttggaatggaatattttcctttttcccatgggtactcataggataagaactaattcttgtgaaatccatacaaatagggcattaattaacacagaaacagcctatcaaatatgtttagacagcaatggcctacattacctcgaaacataggtggaggtgcatggtgcttttgccttttagccccagactgccttggagcccgtgagttctcaggacctataatgcaaaacttttgagaatctaaatgactcaatatagacaataactaggttgttggtagaagaattttgtcaaaccttgagcatgagatggtggataagatggggcaaatggaaggtgttctcctttcttcggtgccccaccccgaccatggtatctgctagaagttgctggtttaggagcagctactgttgaagggggtcggtcatgagaaactgatgatccattctttgggactgctggcatatttgtgttctggggcaaaggagtttctgcaggtgctgatcctgagatgaggaatttttgtaatcaagcaactttgtcatatccaagctaccacggcccggcaacccaatgaaattttctgagattacctctaattggcggtttgtgagctgtgccagtttgactactggattcctttggtggcagtgcacgtggaatatgactattcttatggggaggtgatgtatttgctgggggcactgagtttcctaaatatttaaaaacaaaaacctccaaaaatttagaacaaagggacttacaaagcatcatcagatcaataggattggatatgtttatacttcattctcaccattgctatggtcactacttggtgccagtgcttgctgacgtggtgcttgtgcaataataggtggtgcaactggaggttttacactttctcgcggaactcctattgaagaaatggaaaaacacaagcatacacaacatgattattttgattgacctcaaagcaaatagtttagtttacctgaagtggaaggaggaatggcaggtaaacttctttgaggtggtggatacggagggacgccattccctagagaaataaatgtatcaggtgaatatttgcataattgtaaggaacctttttggacatggacatgaagaagtccaggaacttaaggttttgagttgccactatcagaatatatacttatacgctgcctctcagaaaaaaaaaacagagaaagaatatatacctgatccaattggtctgcttggtggattgttcacagaaggaggttgcactatcggtagattaggattcctggccacagatggagcaggagcctgaacagaaggcaacaaagcaggtgtcccaggaagcactggtgcaggattttcaactgcagcttgcgggggagctactggcgccacatgagtgggagcaggaggcgtaagctcaactggaggaggcgcattatattctacataagacgtagttagtgatacactcattagaactgatgcgacatcatgatctaaccgcgggacgaactacctttagggggtgttactggagtaggcgcattttgtggtcgagtgggaacagctgggctgacagcgcccttcgccacaggagggcttgctgatggagcagagggtgctgagacaaagcaattgtaaggacaattgtcaatgctggttatgatcttgagagccataatgccacaccacattagaaattcagagcaacctgttggaagagttactggaccgagggcgattgtaggttcaggagggctagaagtttgatcttgagcatctggcgagttagcgaccacaggagaaggacccagatcagtacctgcagtggagtaaagaacacaacagggtcatggaatgtgccacacgtacactgatatccaactactaagctcaaaattgcacaaacaagttggtaaccaccctgtgagtgtggattagtactagaggcaatttgtccatgttgttttgccgtatgaaattagcaactaggaaaacaagaacaatggtaatgcaatgcaagtgcacagcaccaaaattatcagaaaagaaaacaaggtgtagtatgcaacaagtggggaagatacatattcagcgaagttaagcatttcccagtagacaagcaaatgggtggaaaataaagcacatgtgatggaatttaaagtggctagtaattagcacgagatgcctagcacacagccaaccagatatgccaagccaccgacattgcaccatccttcttaatgagaagaagcccattcaatcctaacaaaattcacaacatcctctcccaaatttgctcaaattttgaagtaggaacaggcaactgcatttttttttcccattcacagatcaattaggcagcatgtgcatcacagaatccatccatgagctctcctaacaaatcacacagcattcttctaaaaattctcctaacaattcaaacagcattctaaattaacccagaaaaaaccatggagaaacaaccaaatctccagattactggaccagcatccacaaccccatcatatgatcccaacctgaagaagaagaactaaaaaaaaaaaaacaggaggcgcaaaaacaacctgaaaaccatggcgaatgcccggagctcgtctcacctgtagatccaagaaccgaagcgagaagaagcaccgcgcaacaagcgagcgaccgcatctcgcccttcctcccctattgcgcctcacaccaagaacagccaactcaagaacagccgcgccaaaatgcgagagaatcacagatcacaaccatctcgggtggcgcgcggcgccgctcctcctcccgcaggaaggcgacggggcctgaccgccattttggcaccacgccatgagcagccacactcccatgtggggagggagaagaagagggcaatgaggaggcggcagaagaggggttagccaagcaaagcttgtactagtaccactagtggttactggttagtacagtacagtacaccacaaggcagtggactagtggtagctaaggaataaattagtgagaaattagcaacagaagaagaggagattaagaagaaggagagagctttgggtcaagatgcaagaaccagcacagtaaacattccttgcttgctgcccctgcactcctccctccaccactacccagatcatcataagctgatgaaagatgaaggattaaccaactaatcaggaagaaagaaagaacaaagcaggaatctttgcttggggctaagtaaactattcacccccaagaaacaccctcagagatgcaagctcgtcctctctctcatgcatcagagtgcctgtctgtctgtccctctcgctgtagattcttggtctgtgttgtggggggtcactctcctctcctgcatcgacagcctggtccccgttctttctcactgattactttatttactgttgcgaaatcggtgggttggatgggatcggagtatgcacagcagcagcaagaaccctagaaatccctctccctctctctctctctctctctctctctctctctctctcctcgtgccacggctttgtcggttgatcacgagggcgcgtcgaccatcaccgatcaccaagcacgcacggctgctccctcccagcgtagtaagtaaatgagcagacatcggattctggcgttttgatctgcatttgcaattcgaatttgattgcagaatgtgatggtggtgggtttatctgaatctgaaacccatcctaacagccgatctgcgtcagtttgcgtttggtttcgtcgggactcgaggttgtggcgtcgccatcaccagcgagacccatatatcagctcttctgctgctgtagctgagctctgctcatgcaccacgtaccaaaagaaaatgggattaatcttggcaaaaaaaaatcacaaacaacaggtttattagtagctaatcacgggctgttcatggtgctcttgaggtaatcattggttagaggcaaaaacaagaaaaagaacagcattaacagcgatagtcgattagtttactcggataaattgggagcttttgtcatcatacttgagctgctcgtgatcacggtaacagacaagcaagcaatgcccttccaagagcccagattacgaaaatcgatagtccaaaataggtttgcgcccgtgggagactgtcagatcctctagttaattaatcaaagacaagaaaagaattatacaacttggaatacaatactagtagcaaattactctcggagcttaattgtctttcacttcatgctcgaccagttcttgaagcaagcaaaccatgcaacatttgcaaccacaataaacaccatatcatctcatcttatctcttctcttatccatatgcaactcgatcaattcagcatcaagcaacagcaacattagaatgatgccatgtcatatttcaacctgtaaaaactaaaaagatgataaagcttctagagcagaagcttatatacacgcaacaaccgaaaatgtatcaaccctgaaaactgaaggaaactttttttccctttctttctttgcactgcatgaactgaagacatcaaggctacatcaacccatatatatgtacataacaaattaaatcgatccagaaaaaaaggaagtatgtgtagtgtatatgcttgtctccatatgtcgtggtcgcttgacctactctctcatgctttcgcttttggcatcgatcgagatggcatttgttcctgagattgcgtgacatgcaaagctgaaagttaccggtgtgctcgctctcgatcgccacctttgcttgctaacttgccattcatccacgtgaccacgtggtgatcctacgtggacacatatgtagaccatccccatttttgttttcaaatttctttttgtgtgaaacgatggtattttgtttttttcccccgaagaacacatgcaaaaattgtactacattattgcgcctagtccatgaatataagcatttatatgttgttctaagtcaaactcttttaagattgatcaagtttaacttatgacgaaactaaaaatatttatggccccgttcgaatccacctaaaagtgtggattaaattttggattaaagtgacacgcttttcaaactgctaaatggtgcgttttgtgcgaaaactttgtatgtgaaagttgttctaaaatatcatattaatccatttttcaagtttgtaataattaaaactcaattaatcacatgttattatcacttcgttttgcgtgaaacacttaatcttcatcagattcaaacaccgcctatgtcttggaactgggggagtacatgtcaataagaaatgagaatacatctgaccttgtatttccctcaacagaacctgcaagttataaaggcttgttcagactgcatggaacttctatgattagagtagacatctttaaataaaacctgccactagatcttttaaatgagtatggtccaatgactaaggtaatgctaattagtagattggaaaaccaagacccaacccaactactgctcttgtattatgttcttcagcaggagtcagaatagggcggtccaggtgtatgtgtgcagtaaagtatcagcaaccaacctattcttttacccaggtctatctgttgattcgtcccggccatcaaaatcaccatacaatgcatgccgaatgaagtggtaggttagcttaatttgcacagcgatacaaaagacgacgttgtaccagctcaatatacttttccagatcaatccaagtatcatctaactgtagtcggcaagaaaattaaccaaagtgtctgcagggccgtcctggttggtagtggcagagccaataaatttgaagagcctgggtaaatctaactacgttgaatatttgctaataaaaaaaatatttttttcaatccctgtgataacatcaaaattctatcgtgtatatgtcaacaaacatagacgctagggatgaaaacggtggaggagattcctgaccaactcagtatcttttttattctgaccgtgtatgaaaaaaaattctaatttttgagagcgttgtttgaattcgtcattagatagttgaagtgctaggtacggaaaattctgaccaaccgagaatcatttccatggaaatgatatcgtttctgaccattttcatattcccttaggattgctttgcaagtggtgagatgcgggtggagccatggtacagatcttgaaatggaatttctaatcatcttgaaatttccattattgaatttcttagtatcggtcccctctgacagcgcaatattgtttttttttttttttgaaaattctcaaaccatgtgtccatacacaattcagacaacaacagcaaataaagttccatgctgcttgaacctaaaattcccccaaatttgtttccttgatctaaaatctgtctgaacatctttcttcaaaatgtagttaggagccaagaaattaatggaagtgtcctgcctccagttagttggtccatctcctgtactcggtactctcctcatcctcacgcgcgtataaattactcatacacagctacactagttgagccgttgtttgttgctgttcgtacgtggacctgacaaaattaacaagccatcaagacagttgggctcacatgctcttgtctcttcacaaaccttaatgcaaagatctatctatacccaatgtctgaatatctatctgaatacctgatggaagcaaatgccaagaacacaagtaaatattcagggacaagacagcataattcattgccgcttaattagtacgtggggcacggatgcaactaggaatattaattagttttggttcgtgagatggatcgtcttggggagaagagaaatggataatgccatttaatttgtgtatattttaagccaatcacagttgatctgcatgcgcatagttgagaaacagcgtagtaatgatttgagttcgtgcgtggcattaattggttaggattttgggtgatggattcgatccatacctgatgacgtgatcgatttgttaggagtactgaacaagatggataggataaggtagtactctggtacagtgatgatcttaatttcatcattagtttaatgtttatgtatcagtttcatggattaatcatttgtgctagcactaaccatgtttaactgtacttttctcattttttctgaactcgatcttgccccccccccctttttttttctgaaagtgatcggaatatttgctatcttcagcaagaacaacatcatactaaaatcttcatgacaaattaatatatgttattgaattttgttaagatccgaaaatttatctgaacatgtaaactgactagcagcaagtgatccatagtgtttatcagtactgaaattttgatccgaatagttgcatgaatgcatggtgctgtaaaggggaaaagtgcaggcattctgctgagctgcatgtggcaaccgatcgaggctccaccaaccttaccctagcaagaacacaggccaatgatgcttttcctctcctctttcctgtactaacaaccacgagcagattgattaggttattgcaaaattaccagcacatgatcaggcaatggtgggattaatgattaattacagcagaaatcaccatcactcgctgtgatgatacacaccatcagagaaagaaaggatggctcttttacgttagatatccgcatgatgtctgaattctggatgcaatgcaactaactgaacgtagtacgtttatcttcagaacaatcattcagaaagcaaaagccacaccacatctcctcgtcgttgttgacgcccacattagcagagagacaccgagagatatctgaattctgaattctgaaatgggagtgaccactgaccaccaccaccagcagcagcaaaagtgaccgaatccaacgaagttgcagtgcagtgcagtgcagcgcaggcgacgcaaacgctggcacgagcaggcaggcaggcaggcatgtacacgcgacgtcgctttgcctgaatcaatcagcgcccaaagcagcaacttttcctttttgcactcgcaaagaaagaacacaagcaggcagcccatggcgatcattgcaaaccgctttgccgttgcctctctagctactgcctaggttacagttttcaggctgccttgcgttgcaattctgttcctcatcgcaaaatctctcatgcagcaagcagctctctctactctctagaagtatgaaatcatgaacgggatggtcaatgatgcatcggttgaaaaaacagacagtgatcctgaatccatggggcttgaccagcaagtctctgatagcactcctttttgcaggcccctccaaaacgaagaactgaagaacagtatgatgatggatttttttttcagcaaaaaaaaaggttttcagtgatcttttatctttgctcttttgctgcactgctcatatgcgctcaagaaccgagttgcctgaactagactgaactctgaagccctgaatggatgagaaatggagttgcacttgcacaggcacatacttcgataaggcttccatttttctggcacgaccaccactgtatttatttttccttttcttttctctctcttttgaagcacacgaccgtgataattgcacagggccgtgataatcgtggtagtagtatatgtgaatcgctagtgttttctcatcagcttaagcttttgagttgaactaactagttttatccgtgtatataactgaatatggtatcagagtaatgtccatctttcaatgaacagccagccagccagtcagtttgttctgacttctgaattctgatgcagatcgggttcagctttcagtctccgtggtgaggcgtcgaaacggagagaaatctctatactttgctcggcaaatgaacagtgggccggccttctcgttctcctggtccaaagtaggctgttagattaaaagcccattcaggctcggcccaataaaggtgcagacagacaaatcaggattcagggctttgcctgtgcagctgtggttgcgttcaatctgtgccagattttccatcagcagagtattcattcagttcatctgagttgatcagcctacaccatccgccccaaaataaatttacttgtgggtttttaaatccaacgtttgaccgtccatcttatttaatttttttaatgaaaaaagtaaaaaaagaatacgcgtaaagtattattcatgttttatcatctaataacaacaaaaatactaataacaaaaatattaaaaaaaacggatgatcaaatgttgaataacaccagagtaatgaatgaaactcttctctgcaaatggatctataaattagaatctggtaacaccagcccctgctgtgaattgctaaggaaaaaatacttctcagctgggggaggtttctttcagtcttctactgatgggggatcacaattttggaaaggacttcatgaagtaaaaaggtggatgaagtttggtagtgcatacaaaattggctgtggggattctgtacagttttgggacgacatctggttaggggagtctcctttgaaaatccaatgtccttacattcacagtgtttgcagtgaccctgacaaaaccgtgaaacaaatgttgtctggaggggagtgggaaattaatctcaggagatctttaggtcaagacgaattacctgattggctaaggttgtaggacttacttggtacagtccaactgacgacaaagagagatattatgatttggaaattgaatccatccgggagatttacaacaaaatctctttacaaggaaattttacaacaaaatctctttacaaggaaattgtttttgggggagtcaaagacattctgcttcaggaactctggaaagcccctacccccctaaaaacgagagtgttcatgtggttgatgttacaaggaagaattcaagtagctaagaagctcaaaaaaatgaattggtcaggtagccctctttgcaagctgtgtggcttggaataggatacagatcacctaatgtttatatgccctccggcacgttttctttggtgctgctacagagatgcttttgggtggaattcgatccctacttctagaaacgatcttctaaacctttttcagaatatgaggcgatcagatatgagagtgttgtggtgttgttttgttgcaggagcttgggctatttggcgcgtgaggaatgattgggtttttaacaatattcttttgcgaaatgttgtttctctgcctcacaaagccatgtccttcatgttacagtggaaagctttggcatcatctcaactaaggggcgagctggagaaggcacacggattactgcttgccaatatccgagcggcaggagactcaagcgcctaatgtcaccgtaatggtgaccccccctcagtagtgttcttctcttttagactcccagcgcctttttgttctatccctgacttgttatggctgtgccagcagcatttctgtcctacttaaactcctgtgcatctcgagctggcagtcccagcggttgtaagactctgttatgctttgctataaaagctgggctttggcctttgtccaaaaaaaaataaacttattttgggacggaggatataccattatagaatttggaaaaaaaaaacagtgcagtagcagatgttagcagaggagtcgaatgcatgtgtttgcttggccatactttgcctgcgagcactgcattgtgtattgtgtagcctgccaacgtttgcattacgattataaaaagggcagagatctgttactatcgctatgcagatgtagccatactgatactgctgcctctactctaccgatcggccatcaatggatcgatcgatcaccatcgatgcctgcctgctgcaagtctggatggacgacctttttctctgaattgaagctaaagttcagtaccgagtactgtagtgggactgtgtagtagtaaaagttatggcgctcgcagagctgcagatccgggaaagtacagttcttgttcatacattactgtagtactcgtaggttaacccttcaaaaataaattattactccctccataatatgatgtatgcagccaataggagagcacacgcaatatatacttatatcgtattaaatttctgatagttccctaattttttttcccaataacatcacatcaaatctttgaacacatgcatagagcattaaatatagattttaaaaactactaattacacagttaggagggaaattgcgaaacgaatcttttgagcctaattagtccatgattagccataagtgctacaataacccacatgtgctaatgacggattaattaggctccaaagattcgtctcgcggtttccaggcgagttatgaaattagtttttttcattcgtgtccaaaaacccttttcgacattcgatcaaacatccaatgtgacacctaaaaattttcttttcgcgaactaaataggcccttagatatataggtccactttgaattgcatgattggaaaaacggataaatagaaaaaaaaatcaagattctgacaagttcaaatgtaaagcagattaatacaaaacacatgaatgattgtattattgaactgcgggaaaaccgtatgaatcggataagagagatagcataaaagcaaattttccaaaaggttggagctcttactaagttcctctaaaatctatatgcaatgagtcatttcataggatttgaaaagcataaatctgtttaatcaaatagccgcatacaaaagtttctataggatttgaatcctatgaaatttctacataaatcctttgattcaaaaaggccttaagaggagagaccgagatagagtagctaagaccggtgttacacactgcacatcttttctccatcccaaaatattattatcttgtactatgaatttggacaagggtatcgcggatatgccccatataacactatgtagcatcacttttggatgaacgtgtaacgcaaaggacatgtctttatacgagagaggatataccatggcctaacatcatgagatattcgggtagagagaagagttgtggttattttactaagaagggcctcatcatagctagtttaaacatttgtgagcagttttcaaccgagtgcattctcacatgaaccttggactatacattacagataatcttaaatttggatatagcgcatgtttagatttacagtactacgttatgttcaagctaatattgatactagattaatatattttgggacgaaagaaatataagtaaaaataacgtaggtcactctgagtttttacaaaatgtgccctaccaatccatcgataacttcaatattacttctacattaatagagtttggtttgaagctaaattttcacaggtcaactcaatgtgatgtccatggccaataatttgataaggtaaaggtccaaaatgatcctttattgcttttaatccctttgtaaaaaaatttgtaaggaaaaatttgaacacagtggacatagtgctcgtcgagatttattcttatgattggatttttttagatgaaaagagtatgtgacatcacagatgtatgaatgtgcaggc

SEQ ID NO: 26144 - DNA, 1147 bp, Oryza sativa
ccccaaaatgtggcatatccctatttagatttgttttattatgatatatcatatttagttctaatttttttttaagaggggagtataccatttgacaatgcacacggcgaatgtaccgtgtacgtgttgatggccggtgctggattagctcttgcttgcgtgctttgctcccttgtatacaagggaaatactaacactaatcaagtgcggcgggagcaaccgaatctggaagctctgctacgtacatacaggtatacagctagtagcatttctccttggccattgtttaaatccaaactttttctttaaacttctaacttttctatcacatcaaaattcctacacacataaaggctgtgtttagatccaaattttcaactttttttatcacatcaacgtgtcatacacacacaacttttcagtcacatcgtaccaattttaacccaaacttccaactttggaaagaactaaacataactaaacttttaacttttccatcacatcgttccaatttcaatcaaacttctaattttcgcgtgaactaaacacacccttaggctctatcccgacgagacgacgtttctttctgttcacagtccctccctctaaaccaaagccaaccaagggaacctgacaccgacacgagcaagccaccatttatcatccaagaaaaaaaaaactagaatattagagaaggacctaatatcaaataattaggaggggtgaggctttgaacccaggtcatctagcccaccaccttgtggagctagccggaagacccctggacatttctcatttatcatccaagaagaaaacaaacaaaattacaaaagaaaaaaaagatgaagaattaagagtaaagtccatcaccggtctctaaacttataccgttgtatcattccggtccctaaactcgtaaatcgactgttcagttcctcaaacttgttcgactgtgtcatcccggtccctaaacttgcagatcactcgtttaggtctttcaacttgttcagttatgtcaccccggtctctaaacttggatttgaatatcatctgggtcaaataggacggtctaaaaactttatatctaaaaataattcatagctttttcatgtgaactctaatgaagacaaactttatatcaaacttg

SEQ ID NO: 26145 - DNA, 3746 bp, Oryza sativa
  unsure (1)..(3746): unsure at all n locations
cgtaggcggggggagggcacgtatatgtaaccacccaccaccgtcggatgcggagagtatggcgacggcgcggcgcggcgcgtcgtgccgcgcatccgtccgtgccgaggcgtcaggcgtgacgccacgtggcgccgcgtgggaccgggggccccccctcgccgcgtagtggtggtagcgcgcttcgggaaggcgcgggttttttggccgctaggaggagatgagaagggaaaggggaaagagaaaaggcggttgactcgttgactgaccaggtctcacgctcgggctcgggtcgtggtcgtggtccggttcgtgtcagtgtgtgtggcttgggcgcttgggttgggtgggtgggggtgtggtttgcttgtggcggaagcgaggcgcgtcgtgtagcacaaggcgcgcgccgctgttgcgagagaaaagtgcgtgacgttgggggcagtaaaaaaagcaggggtttcggcgttgtttgtttctgccgatatattggagtatacagtagatcgtactactacgtcgttcctgtcccgaggcacaccgtgaccggagctgtagggcttgttctgattgtcgtctaattttagtgtcacattttgataaggttggaagcatttggtttgatgccttgctaataccttgtttcgttcatatttttttttctaaaaacgtcacgtcgaatctttgacacaagcatagagcattaaatatagattttaaaaaaaaaactaattacacagtttgtatggaaatcgcgagatgaactttttgagcctaattagtccataattagctacaaagtgctacagtaacctacatttgatttgctaataacagattaatcgggcttaataaattcgtctcgcggtttctaggcgagttataaaattagtttctttatttgtgtcctaaaacctctttcgataccggtcaaacgtccgatgtgacacccaaaaattttcttttcgcaagctaaacgaggcctaagtttcgatagttttttaatagtagaagtttctgaaattactaaatgttggtaagaaaatattggctaaagtatgtttgatttgataccctatccaattataacattgacgaaagtttgcgccgagtttagttttctatttttttttaaacttttaacttttccatcatatcaaaacttacctgcatacataaactttcaacttttttctttgaacttctaattttagttaaacttctaattttgatgtggaactaaacacagcttgatagtgttaaatgtggcaacaatctgaacaatgctcgtagtttcttctggtacaccgatatatgcgctccacgtcacgtatacggcatacaaaaaaccaaaaaacaggttgtttccttctttcattccttgtctctacggtaccgagagtagctgggccgctggcctgatcaacaccaatcacaaaccttcgcctacacaaggcctcttacccccaataccatttgggcctgtctacaaaccatgaataagcccatatggtcaggacgaaacacgcagttacgattttcttcacttcatgattttttgttttcagataatgagtttcttcattgcatgacacggtagttacaacttagcatgaaacttcgataaggtcggaaatggcttgcaccgatacagcagacaagtacaggtatctcacgtttacaaccataattactacagtatctctgagaggtgaattgcttatcactcgactagtatgcacgatcagtgttagcaaagacaggtggagtgtctgctgtcaaattacaagtaggctgtcaagaagctagcgtttcgtccttgagagaatcagacacacggccgaggatccctcgttgcggttggtctacggtttggcatctcatctacttcatttctcatctcacacgactgacacaattaattagtggcttcttgtcgattgtgttagagtaaacagcaaagtactccctccgtcccattttaaacgcagtcataaatttctatgtccaactttaatcgtctgttttatttttaaaaacaaacataaatcaggtataaaatattatttatgttttattatttagtaataataaaaatactaattataaaaaattttaaataagatgaatgatcaaagttgtagattgcgtttaaaataaaccggatgaagtacttcggtactgtgcttgctacaacatggcttcttttgtcactttgacgtgttgggaaaagatgcaacccgctttaatgattgtgttgacctttatgttaaggcctcaccaatcccggtaaacaatcgtctcctcactcattaccacaaactatgctccgattcattttcatatattaaaactacatatgagcaattctatgttttgatcattgtttctctaccacagtaccacttatatatgagtagtaccaagaaaatgttaaacatgaaagcaattttcatgataaagctagtgaaatatttgtcatatattaaagcttaattaatgttgttgcatactcatatatctgactgtatgcttgctcagctcaacacctactctatttaagtaccagtactgattagtttacatcaaactcttaattttctagtactacacaattaagcctaacggttgctactacactactgccactgttatgactagtgacccactaattcttcacaagtcacgtaacgcccggaattaaaaatgtcacgcaattcattgcacagctgcagccggcacctccgcatttgtgctctacatttgtgcttgcttcacatgaaaaggctacacatgaatttaatatctcacacctttcccttgcgtacaaaattcagtcaaactcagctactagcatggagcctcaccgacacccctctctctcatctcatttacacattttttaaaaagtaaaaaagtaattcaaagaaagagtatctgggaatattatgttactcgtgcgatgccacattcagataaatttggagtacaaatttactaaaaataacaaatccccaaattgtacttgcactaacaccaagatattacaaaaagtaaaaaaatcaagcctcacactccaaagaagactcctccctcgcatcacttgtcggcgtggtcgcttcttccctccccccagccaaatttcgtcaaattcaaacagaaaccatttttttacagcatccgacggttgattttggtctgaatttctactacactccaacgtaagaagaagaaaaaaanaaagaagtaaagcaccttttctttttgccccccgaaaattttgcaatgcggcccctaggatttgggcgacgtcactagaaggtccacttccagatcttgactcggatcctgacctggcacacgcgcgcgacggtggtcgccggcggcggcgagggggtggtgtcgtcgacggacgcggcgggagacggcgcgtcggagacggagagcttgacgccgcccttcttcttcttcgccggcggcggcggcggcgccggggcggccaccttgatgccctcgcagtggacgagcacgccgattttcttggtcttgaggccgccgaccttgacgccggccttggtctcgaggtcgagggtgatggtgaactcgccggacttcttgatgtcggtggcggcggtggtggggtcgacgccgagggcggaggcggagacggtggccttgatgacggtgatgttgccggcgtcgtggacgaagccagggacggatccctccccgagcgggacggc

SEQ ID NO: 26146 - DNA, 10723 bp, Oryza sativa
tggtatttcgccttcttaaaaaaatggtattgttttgactcttttctaattaaatatttttaagtctgatagagtttataaaaaaaaacagtaacatctgcaacactttcattcaaactaagtagtatgtatgaaaacgaagggagtactttttagtacaaatctagtgcaacctccatacaacgctaaattaagtatgtttagacggtttttggttgtgatactaatgcctttaatcgttttagtttattttcatcagattactgaaatgaatttctttcctccatacttaaaaaaaaaaaaaaacttcgaccgctacatagaccgtataccacctattttaagcaatttgataagattattttcataatatttaatttattactataatgcaaatagatatttcacggtactaataagctcaataatctaaaccaaactacgccttttcatttcctatttttttagttgttgcagagaatagaaatatataattattatactttatttttattaattgaattataggtacgtcacatgctttcttttataaaggataacccagttatatacaatatgatatacaactctcatatcttctctaattgtttcatattttctaaacataatactcccctgctccaaaatacttcctcatattagtaacaaatattattcatatttaaactttaacttcttgtgttttctataagaattttaaaatatttaaaaggataccatattatcatactattaaaaagtgtgttgagccttaaatataattattaagctctcgttcatcgaagtttaatcattcaaattaaaattattactagcagtcaaagtggaaacaatgccagttaatatttaggaatgaataatattatcgaatacaaagatttacacaaaaaaattaccaaacaacaaaaatatataaaaataaactacttcaccaaatgagattatcatatccacagatgcttatttaatttatttagtaatgctttgagcataatcttaccactgatgctattattctacgaattaaacatatttaactagttgcaattagtaatgccctgactcctgagcataaccttaccactcgtagtaaacaatagattagccacttttagtataggagtataggactgcaagttccctgttcctattgacttgcagagtccagactctaaagatcagtagatagccatctactatcttcaaattatctatagttaatgtaataatcaattcatacaatagttgcttactatactattaatacctggtctcatctgtcatacacacattatgtcttagagtctgtgctgcagctggctacatatctgtagcccgctgctcttctctctctttttttctctttaaaatatatttacatctggcttatagcctgctattgtacctgctctgactaatgccaaaactaatggcagtagcattcgtggacgttttgatcaagggaatcgtacagagccttaatgacatgtgattttcgttaataattgcagaaaaatgggatcatgtgatcgatggttgtttaattattcactgtgccgcatgtctcttatatgcaggttttttcagttttaggagctgatgatccatcagaaaggctgttagctgtaggtactaatactcctattcaagttcatgatttgtcgatgtactgttcactgtataattaatgtcgtaactgaagtacgtgaagcttttgtcattattcagcagatttattaggagctgtatgacaagattttgtcgtcaggtacatatatactttactcggtttaatcttctcccttaatttctataacagtagtagttcaccatgtactagctagtagtattattcagagcacggtggttggggctgaatcacttgaatgcagaaacggtgacgagagaaatctcgtgtgcatctcccccatggattttagtggatgcacaagctgtacaaaagctaaggacaaaaccaattcatcatgtgagcaagtactctcttaaaaaaagacatctagtatagtggttgcagtgacctgagtagcgttataagattctgagtttctaatattaaataaatttgaccagcgagagttattagtcatcagaaatctggcttggagagagtgcgagagaaggttgccaaaaccgaaggcgagagagctaggctaactttttctttttcgataataaaattgaatccaacctctatatcaaaacgtgtataataaggccagattgagctaggctagcaaacaccttagggtttgcttcacgattgagtatgttcagtaaacaagaaaaccgttagcatatgattaattaagttttacttatcttaaacttgaaaagtgaatttatctgatattttaaagcaacttttatatagaaagttttcatacgaaatacactgatcaacagtttgaaaacatgccaatgaaaaccaagataaggcccccttcgattcaaagaaaagttgtatgaatttgggaggaattcatttctatagaatttttttttcatagaaagctctttgaatcaaaggaatgagacaaatgaattcattgaaattcctattgaatgcctcttaccatataagttttggagaaaatttaacattaggtaaaacctcatggaaattttattttgagtcttttatctttgttctaattcctatattttgtaattttctgttttatacttttatcctgtcaaaattctacgttttctcaatcatgtgttccaaagaaaccctaaaaatctgtatgttagccagaaaagaatggagcctaaatgtaatgctggccacatgaattatcatagtcttgtggggtcttaattattggcttaataaacgagggggctagattagttaggttatcaccgtgtttagttccaaaatattttttcaaacttccaactttttcatcgcatcaaaacttttctacacacataaacttccaacttttccgtcacatcatttcaattccaaccaaacttttaattttagagtgaactaaacacagcctatatgagtacactgcgtacttgtggctgttgctccagcaatttcctgcgcctgaaaaccacaacgcattcccctgtagctggctgagctggcttggctgctgatgacgctgacgtcgtacgtattacagaaagctagccaagcatagttgttcatccatccgttccttcgttcgttcccgtgggggccgtttgctttctgaattcttctacttgccgctgattcgtcgaccgcgagatgtagggatgtttcataatgatgatgtataaatgtggtatgattaatataggtcgtttatgtttttttttgatctaatgaattatatctgtttgtactgtcaatttgatgaatacgttatgctggtagaacggttacttttattggtagtacagaacttataaattagcagttaaaatcgtctctacgtgatgatgctgacaattgaattagtaaagaccatcgtaaaagtaactaaaagaaatgtaatattcatcaactgatcgatcgtgaaattaaaagattaattaaactaagctttgtggacatatcttgtgcatgttttttctgctaattttacgctactcaaccatgtagtcaataattaacgtgctgcttacaaacaggtgctcagactctcggctgaaattaaattacacgtcacattgccactcattttctaccagttttgattctacaacgatttttatttatttattttttatttgttagagtgcgtgagtgtagctggctatctgctatttacctgagaccaaccaaacacggccccaaccatttatattccctccttttctccataaacaagaaatcgctgtgaaaacgatggactactcgaactgcaccaaacacggccttgtcgattcctacactttacttgtaaaccaaaactttgtgttccagcaatggatatttgtgactaacaagcctcttaatttgcctagtcatatcataaaacatattgatcccatggcgtggccattaaatactgaccaagcaaaatggaagcttgattgggtacttgcaacggcttacagctaggcagccaacagcagcagtggttgggatatggagtataggagatggcagagagataaaatcttgatctcacttatgttttgaaatctcaattggtcgtgtgcatgctgaaatataatttgcacacagttttactctacaacgtacacgaaaaggagcatttgatttttcttttttgttaaacatctctctctctccatccaatccaactacgtggatggaggttgagtgcgccagatgtcatgctcctacttgttggccaaccgtcgacaaggcgccggcgcagtggctgcgtgttgaaggtgtttagttggcagtagctgctgaggctaggaggtgcacttcggcatgggagggtacaaagattacgggcgaaattctagcctgtttgggccgataacggcgacgcttgcgggcgctgcatgggggcgttgtcgcggaatattccctctcctaaatagatttattgcgaaaaccacgtcctcttaggatgggcggcggtggcgctctcgacgttgtattctccctggagacgtcatttgaagttgccattcccttaggggtgtttgtgctcctactttgcttctcaatagtgggtctcggttgtagatgcgagctgtcgctatttttttattttcctggttatagccactatcttctgtgggttgttttagaaaaaatacttataacggtgaagataattttttttaaaaccacattttatttatcttcaccatttttaacatgttttatttttattttatttctttatgacttgaggtagatcacaattgcgaagctcctctaggaatgcactttgaaataaaaatcgctgttaaaattgcctgccgaatttctgttctaaatagacgtaatttgggcttggttagctggaaaagtaaaatagaagccgacccaatacagcctaatagaagcccatcagactcgtctctgcctattctacagcccgtatgatatgtagttcttgcaaacaaaaacaccctattatgatcatcctgaattctacaattacaaccccaattacaaaccgcagtcagtagccctgatgaacgagaactcaacgaaagatcaaattcaaatccaaacttgcagtgtgaaacaacctctctgtgaaagcagaaagggcagagacactactaatttgcactcttctttgcatgtcgttaaatatgaagcctgatgctcgcacaaaacatttgccacttccaatggcttagcaataccaaactaacttgcaggataaagttgatacacatgggaccagtcctcgataaaacaccagttgtgatgaacttaagaccagaaatgaaagaaaacagttttttgtctttgaaggagtagtagcattgatgagctcatgcaaggcccatgccttagctgcaggcatactcttgtcttatatttctactatatttgtaactccattggtattctgccttgtggccataaaacatcaagcagcaggaaccttccttccatcttcaatgaaaaaaatggctgactcaggtacctgaaaggtatgaatgaatgacaataattcaataaatagcatagatacatctttgatgaagatactacgattttaacagctgaggcattcaaatggtggtgataacaacactcccaggtcacaattttccaaatttgtgttatagagaggtatatcaggctctgttggtccataggacttcctccttgcccttgggccttgggactcaactttagaccttcccagttagttaatgaatgggagttaggaactccatgtacaaaccaaaacctccacaggatataacttttcactgaatatgtagtcaccaaatgttaccatggttctctactcctatatacattcaaggaacatcacatacagacggactagagaagtatattattactcgatttttttatttttaaatgtgaaactaaatgttataatccaattgaataggtttctatctattgttatgaaactaaatgaattcacacctggacagaatatcacaaatgataccaaacatgcgagtaaataaaaagagagaaaactttaaaccacaataaattgaagagaagatggatgaattacatcaggccaagtatctgtaatgaactccacgatatcatacgatatatccccttgcacatcaatttgctccttctcagtggggccctaagaaaggcaataaagaacaggtgttaaaaaaatgcttacattgatatcaaaggccattgtactatatgagccctgattactggtataccttaacaacagatgctcctgtagcaaacttcttccccagcttctttgaagcatcactcagcttgacacctaattgtccaggaaacaaagtataattcataaaaatataccatagcttcagtatgaacggggattcaatattgaaaatacatcttcttctatagtgttaacaatacagtcatgttcattttggtcaccttaccggttttagctttcagtttgtaaacagtcatttaattgtttatgaaaacaacacttaccaaataattccagacccttcaccacagtaacacatttgcgcttgttgcggacaatcttctcaatcacaacctcttgtttatcctgtaagacaaaagggtaactcatcataaacgatgttattatcaaccaaaatttcatacacgtggactttgactcgcttggactcaaaccagaaggcaccaatacaatagctcatgtgtattaaaatgaccataccacgcactaaacttccagcaaaaaatatatttcttccagcacactgaactaaccattactgtagtagcacatttaacattttgagtatctcagtacgcgaataatcaccataccacacactaaactaactattatggcttagacatcatatgcaaacgacagtaataactgagttgtaggataaccaagtgagtgtgctgcaggaaccaaccttcttcttgaccttaccaccaggcaagcgcttcacctcttcctgcttcgacgcagaagcatcccctgcacagttgtagcacaaagattagattcaattctctctctctctctctctctctctcgtgcaccatcccatcccagatcggagtctgacatcctactgatacaacagagagaatcatcacgaaagaagtagcgggggggaagaagaaaaaaaaacctgcactggtggagccatcggcggcggagatcccgacgccctgaagccgctccccgaccttgtcgacgtcggcggcggcggaggaggaggaggcgaggagctcgtcggggtagacgcccggggcgttggcgcggagccacggcttgcagcgctcgaagtccgggccgaactcgcagtactccgcggggaggccgcagacgccgcagtacagcaccctcaccggagccggcttctccgccgccatcgcaggcaggcgcaccgcttctgctcgccgcggaggaacgaatgcacgggctcgcctggggaatcgacgacggcgaggggtctcgtctccggcgaattcgctcctccgctccgctggtgctcgaggggaggatttgattcggctcgccggattcggatcggatgcgatttttttcccctttttctgaagtggaactggaaaggaaaaaaaaaaaggaaaagaagatagctgggccttcgtgggttgatgggccaggcctctatttgggccttttgggaggttgattgcttttgttcttttttcacgttcttgtattgcaaatgtgcttatatagttggggccacctacacgtccgattattttttatttttatttttttgcaaaaatctgatgttccaccaaatagatcggaattgtttcattaggtggatcgaaaatgtttcaatcgtttaaaaagttgaaacacaaccaaatcacctcataaaacattttgctataatgtatagaacaatggtttttgaagttgtttcaccatatataaaaacaatgtttcagcaaaatagcgaaaggatattacaattcaatgtaacatttgatttatacatagtgaaacacacacgagtatacttgctaaaatattgttggtggaaaaaaaatgaaaggtattcccttaatagaacatttttgtattatgtgggtgatttgttataacggtgtgtgtggtggggacggcacggaggcgccggaggcacggtgcccatcgggcgcccgacgcagggcatttccgtatacagttatatataattggggatgagttatgcctgtcttgatttcaaatgtattaggagtataatcgagcctatatacacgattttatagagcagagatatgaaagacgaacatatacacgtcgacctatgacgtgcttggtttttttcttcggtacataaaaaaataatattcctgttgttgctattggtaaagagtatttgttcattgtttcaaccgaagataggagaaaaaaattcatatttttcataacacaattgcgttaagcaaggcagtgaactatatatgaatatattattcatccatataaagtcaataatataatgctgctactaactgtacaaatacagatatcagattggcaggagagatcgatttttccaacttgcgttcgatacagacaaaatattttacaacatgctcatatgagtacaagttttttttccttttgcaagctttattaatatcacacaataattgcatcatcccatagattatacccagaaagaaaaaagaaaggataggaggttcatcaaaccaaatacaagacagtgatgattcatagagtttgcttggtcagccgggcgatacgcaaggttgtcagtatcccgattcgtatcctagtatcttacgatactacaatcctaccaagccgaaacgataccgattccacataatatcttaattttcatagtatctcgatcctactattcattactacacgatcctacgaaattttaggtggtatcccgattctacgatccctacgatactataaaatattattttaaataacatggtttgaaaataatgtaactaaatatgctcaaatttatataaaaatcagttaaatatatcaaaaccaacgtggtttctcttgataaatgtctctatttgcatgatatatatcattactatatttttttatacaaaatggctatatataattaatataaatattaattaaagttaaaaaaagaaaatctcttagtatcccgatactacgatacgaccctacgatatgatattactttgaacaaaataatactacctagtatcccgatcctgacaaccttggcgatacgtagggatacaagcggggcgggcaagcggattttttttgtccgcttatctcacttttagtttattttttctttgaaattttgtactaccatatagaaaatgaactagcaagtaggtttttatacgggtagtgagattatccacttgcatccctagcgatacgacggttgtgagtgtgttgataacaccctccgggcatgttcctcttgaaggaatggaaaaatagttcgatgcggcacgctgctaagggtactaaacaggacatttttttttgaaaaaaatggaaatgtatgcaaaactttcaaacgccttgaaacgccgtaaaagatttaaatgaatatattagacttggggaaaattaatatgatgcatcattgtacattagacgaaatataatagttttgaactttgatttttttaagaatagttgtatgtagatttttttttccacttttcttaataagcatgaaaggagattggaaaagttaaaatttgcaaacaaaacccttacattattctaaaattaaaccatacagttcaaaatggatgcgggcacccacttctctgtctagttgaaaaataattgctcctgcaactctcttcatgtactttaaggtgaactccctctgtactcgtaaaggaagtcgtttaggacagcgacatggtcttcaaaacataactttgacttcttatttctccctccgtactcgtaaaggaagtcgtttaggacagcgacatgatcttcaaaacataactttgacttcttatttctataaaaatatgggacaattgcttatttgaccctgttttgaactgtaattgccgatttggccctactttttgaactttgcttatttgaccctctttttttaagtacgaagcttccgtctgaccctcttttgataactccgttagggttcgattttttttaaaaagaaaatgtttcaagagttcctaatgacgaaaataccctccaaaccctattttgactctctctctctctcaatcgtgcgtgactctcacggtctcacctctctctcactcgtgcgtgcagcggcggcggctagctaagggggcggcggtggcggcgagctgagggggcggcggcggcggcgtcaagcactgccccgccggcgcccactcgttgtggtggagggcggcggcggcggcgcttggagggggtccgagtcggcgccgatctgagggggcggcggcaacgatctgtgggggcggcaacggccagctgaggaggccgcggcagcggcgtgatgtacagccccgcccgcgcccgctgtggaggtggagggcggc

SEQ ID NO: 26147 - DNA, 31848 bp, Oryza sativa
  unsure (1)..(31848): unsure at all n locations
ttcctccgcgcgcgcccccccgccgggtcagcaacaatgacgacgacgacgccacggcgaagatcacagggagccgctccctccctccccgcgcgcgtcggcctcaatcttctactgcgcgcgccgccaccagtcggcaacgacgacgacgccgctgtggcgaagagcacagggcgccgctctctccccccagcgcgcgccggcctccgtcttcctctgcgggtgcgccgccgccgccgccgccggggaaagagatttttttttatattatccaaactttaggtcaaacaagcaaacaaacaagatataacagggccaaataagcaagggcaaaatggactatttaccccaaaattaacaccgtcacctcacacaaacggaatagggtcagaccagagcttcgtactcgaaaatgagggtcaaataagcaaagttcaaaaagtagggtcaaatcggtaattacaattcaaaacgaggtcaaataagcaattgcccctaaaaatatttattgaaaagtgatatatgtatacttttatgaaagtatttttcaagacaaatctattcatataatttttacattttcaaactcaataacttgagagtttttcatgatttatattctcaaggtttgacttaaacattgtcctaaacgacttcctttatgagtatggagggaatactagataagaacccacatgccattgatatggaaggtggtaggagattcactgtctcactttgtttttttttcttcagtagtatagatatatggagtatacgtcagtacatcaattattaatcaacatggatagcaggctgcacatatatattggaccatactaaccctatcctattacgaagtattacactctttcttgctcctccacaaatgcgtcaaaccaaaccgatggatcggaattactccgaatttaaaatgctttgcctcgatttgcgaaacgtgcgattatgattagctattgaaatggtagtattgaccaccggggtagttagggtaggtactgttgctatcgatgtgctgcgcatgcagtgcaggcatgtcggcgacggctaccggcggcgcattcacgtacgcgagcggagtgttaattttgacggggacttttctcccattcggcggcggtgtcgaagggacgtcgacacccccgtcttcctggcagccacggcctagcccagcagcctgtggcctacacactacttaaaaaaacagttttcacttatgctatgtttttttgacattgtcaatatttattattgtaaaactaggtaataagatggatctgtgtcagatgataataaataggttgaagatgtattataatatatatacgtagagtgggtagtaagatatgacccatctaaatttttttttcaaacatgtgtaatgccacaattaaaaaaaagacgagatctatatgaagtgctaatacctagtagtaaacttataccctgatagtagttgttaccacctccacaatgtatattacctagtaatagggatgcattcaatgcttatttcccactatttcaccagccacattatggatgccctagacaactatctttttttttaaagccgtttactcctatgttctcaaaataaagcatctagatcgggcttattcagattcactgtaccaggttttgtcttggtttatttttagacggagggagtacgaaataattgagattgtctctgggttatagaacacccgtgaaaacacatatttttacggtcggttcattaaggaaactgtatgtagaaattagtctatttccacgagtggttttcctaaaaaaaaaccgcctgcaaatatcatttttatagccaatttcttaggaaaatatttttacacaatttttaggcaagatttaagtataaatcaaatttttaagggtggttctcataagaaactgtcgttaacaaattgtaaccaagtccaatgtagataaatttttgggaattttgtaaaatccaccccataagtcgcatgaagttcagtatttcacccacaagtcattttattacaaatgcgcccctacctacttagttttcctgaaaaaccactcaagttcgcacgtgcttaaccgaatcgacatgttttcataaattgtgagatgtcagtgtggtctttaccaaaattaaatatttttaggagtacagtcttgacacttttatggagatttcacaaatagaattgctgatgagaggttaaacgttgtcgcactgaattttgctatatgaaaaaaaagtttattgaagcactaagaaaataagtccatactttgaaaagttattttaagtctaattaaggtgaaccaaagttctccgagattctttcagtattttccttacattgtttgggcaatattttcttaaaatatttactataactagaaaaaatgcctgtgcgttgcaacgttgcaatgggtgaggttattttaatcttatcattgttatacggtttaattaaggtgaagtttactatgtgaatttgcttgaatatatatatatatttttagaaaatcataagctgcaattagaagtccgatcatctcaagttaatatgcgagttttttaaagacatttcttatatgactccttttgtattttcaaaagcgaacgaacctaaaaactgactcaaatacggatatgtatttctaaaagcaaacgaagttaaaaaccgactcatacacagatgacgtaacaagctaccggcaaaaacaacttcaatttttataatagtagagatatagtcatttactaatgtcgaaatagataacatgccaactcatattggaggaaacatgacgtaagtgatcaatccttttccaaataatctatagaaatatggacctggccataacaaagaaaacattgtaatgatcatagagatcgattcatctcaattgaacttaaaaatatttttattaactttagttatttcaaagaataatgaaaaaatgtttttcataggtggttcttaaagaacagactctaaaaattgaaacaaacaacatattttaagaaaaaagtttcaaacttcgtatatgaagtcagatgaagacatatttatatgaaagtatagctcttgacgagatctccagctttgtagttattttttttatttgagatcgattagtgttctgtatattcgttacaaggtcctacgtctattttgaaatacaaatatttgagaccttagattaatacaagttctatataaaaattttagagttcgacaagacctatagctttgtagtcgataaactttgtacatatctcgtatggaaaatcatgtaacttatgaaaatatttttgcacccactaaaatgtgaaatgttctattcacatgcacatagtgtatatagagcctctagtaaaatacaaaatattttatcaggcttttgcaaattaacaattattttttgaaaagataaaatttatttttagaggtggcccgtaaaaatggattttcatacaccgatgtacaatccgctcatacaaaccgcctatttctatcaaggttgtcaggatcgggatcctagacagtatcgttttgctcaaagtaatatcgtatcgtatgatcgtatcgtagtaccgggatactatgaaatttttttttaaagtttaattaatatttatattatttacatatggccattctatataaaaatatagtaataatatatgtcatgcaaatagggacatttatcaacaggaatcacgttggttttgatatatttaactgatttttatataaacttgagcatatttatttataatattttgaaaccagcttattttaaataatattttgtagtatcgtagggatcgtagaattgagataacacctaaaatttcgtaggattgttctcttgtcgatcgatctctgaataaattaaagcttcccggctccggccgctagcagttgcttctttttcccacattctctcatggatatcgatccagctagctagccaaccaaattgaccgtggactgatctatcatctatccatcctccattgatatatcttagttagattccgtcattgaccgtggagtatgatactccagactcaggcaattagtttgccactaattaatctactaatggcttatgatagtcatcaggcgcctttagttctctttttccacatgaatctcttaatcaatcactgattccagatactaaatgtacgttacatatatactatatatgtggtagtaatatatatttgctactacaagacaatgtgtttatatatctcccacgtggattaattgctactggttcagttgatcagttgctccatgctacggctgccttcaatggctatatttttgtattcggacacacattcggagttgtgctcttcgtagcttcctcatcttatactttattaattagatactgctagtatataactatatatgtctgcatgttcagcatcaactgtatcatatcgatattgtgccgatcaaacacatagctagatcatcgatcgagctgtagcaaagcaacagaagtggtggttatctgatcatatcatggacagcggcggctggatcgtccatggctacaccaatggcgccaccgccaccggcgccggcaaccacggcttcacctgtggctatgctgccagcaggtagctactccatctctcggatcaggaattcgatcgattgatcgcgacgataatatcgtctctgtaatttgtaaattccactgttcttgcgttgtttggctggtgatcagttacgtatatggttatagctgcggttcttgggagttcgagcaaagggagcagcagttcatcagctcgcagattcagcaccgtctcaatgaggcaagcttaattgctgcagtttaattgtacattgattcactagctagctcgaggcctcgagcgtccgatcgatcaagaacaatgcgtataaaatcaaagaaattgtaggattaatttggtaggcgttggattaattaattatgacgtgcagatcagcatgcacctgagcatggatgatgacgatgatcagtccgcggtgtacggcgtcgccatggtggacgacctcctgacgccttcgccgtcgacgcaccacgccgtcgccgccgccgccggcagcttcccttcctcgtcatcctcctcggcctccttccgctccgcctccgtgtcgtacagcccggacacctcgtcgtcggcggcagcggcggcggcgacgggattctaccnnnnnnnnnnnnnnnnnnnnnnnnnnnnnnnnccaccaccacccttggtgcgcaacgagccccagcccggccgttacaccgccggcctgccgccgccaccgccgccgccggtgaccggtggcgcgttcaggcggtacgcgcggcacctcggcccgaggagggcgcccaagccgggggcgtgcgggcagaggatgttcaagacggccatgtcagcgctggccaagatgcacatggagacgacgtacaggcgccgccagtactactaccagcaagcggcggcggcggccgaggcggcgccgccgccgccgtccggcaacaaccagctgcagcacacgatgtcggagcggaagcggcgggagaagctcaacgacagcttcgtcgccctcaaggccgtcctccctcccggctccaaggtacaattattaatacgtacatttgtacgtattacgaacgtatacacgtgcatattcatgaacattttcttctattgattagtattgatcttgactaatatttgcttaaattatttctcgatcgtttttaatggcagaaagacaagacgtcgatactgatcagagcaagggagtacgtgaagtctctcgagtcaaagctgtcggagctggaggagaagaaccgggagctcgaggcgcggctgtccacccgccccgacgacaccaagaacgacgaagaggaggtggcggcgccaccggaggccggcggcgaggtgaagagagaggatccggtagagatcgaggctttagataatttttttataagatgatacgtaagccacaagaaggagacattttcatcaatcaaaaaggatatcctctcgttttatctatgtcacctaaatagtcattttttttaaaaaaaggaatgatgagatagattaatataaaatgtatcactcaaacatgcaagttatcaactagttatcaacttctacaggttctaaaaaaaaaacaaatataactacgagcgtacgataactattttcagtttaatttgttccttttgttgtaacttgtagaagtctaatttgagcttgtatgtttgtggagtaatatatttcatattaatctatattgtcaactttttttaaaatttttttatattagatgacctataagtaacgaggggatttctctcgatggatgaaaatccatatccttctagaatggataggacctctgtccagatttgtaatacacagataaatttctaggttgtaatattttggaatagaaagagtacttagcgaatcgcaaaaatgtgctaacttgcataggtgtaaacatcggctagaggaaatctcgatgtcctgaagccactatctaagacctttcacaatgctcttaggtggcatccagccccaacctgccaccaaggagattcccttccatgtatgcatatgtcgagtccctcgcaaccaaatggagagagagagagagagagagagagagagagagagagagagagagagagagagagagagagagagagagagagagagaggagatcgcgtcccgccatggaccggaggagctgaccggatctacgccgccgagctccatctccggccttgtcgcctcgcaccaggctagatccggtggtcaaggcatctgtcagcggctttgcaccgatggtgacactgagctcgtcgccgtgggagacgcaaatctaataaattctggatttattagatttgggcggactagaataaaaacagaataaaaacataaggggtgaaatagaaaatttcgtgttagtactgttaggatacatgcattgtagaatgagtttctttaagcagttccatgcaacgtggaagcccccttttcacatggccattcaatttgcgtagcttgtcctgctaatggcctaaccatgtcgatgtcgctgctgtggggcgaggacgtgaagatcttgttggggtagatgcctgacgcatcagcagagccatgtctattactcctccgtcccacaatataagggattttgagattttgcttgtaatatttaaccactcgttttattaaattttttttgcaaatatagaaaaatgaaaagttgtgattaaagtactatagataataagtaagtcacaaataaaataaataataatttcaatttttttttaaataagacgagtggtcaaacgttgcaagcaaaaactcttatattatgggacagagggagtatctcctagcgcttgaattcaatgccgtactctgggaggacatcgcggtacaataccgtcagtagagcccggctccttatccatatataattagttgtgagagttgatgaattagttgtgagagttgatgaatttaattatatatataattgcaaaaatgttattttttttaaaaaaatcacgcatgtacggagcagatatgtataactaaaattgtttccactcgttgcgatgcataggaattttctagtccagtaataaatactccatttattaacctactaattaaagcagtccttatttaattatgtgttcctacttcctaatgatccagttgcatgctgtgggaagaatatgctgtcaatatttgcgatttctaattataaattaaaaacatatatagtgaaatacttttagtatattggggcagcatccagagtatacaactgcggcagcagtgacactgccacatgcagccgtgcctcccactctccctgcaggctccctcgctccctgcattttgcaagcaacgagtgttgtcctttacttctagatgcaaaaccaaaaaaaaaaaaaaaaagaaaagaaaaacaaaaggacaactttccaaaatacacacatatagataatttaaaagatcaaaaaatatctttaaaagatcaaccatatacacatatacatagataatttaggcatactttgggcctgttcagattgtagccaaaataaacattaccaaattttggcattgccaaaattggcaatggtaatatgccaaaattttaacaggatttttttatgtatttaccaaatttggcaacaaactaaacgttactaaaattttagcaactttgcctaaaaaaaaatattatggttgaaattggcatcaaaatcaacagccctttcccatcacattggcataaagtctgatcagatttgatctgaaacagggacctaattaagtgagcaggtcggtgagcagctagccggtcagtggtggagacagcgacataatcgatcgagctcattgacgtcgactcgtcttaaaggaggccaggatatatatcgatcgtccggcacggccacatttaacccctggaaagccgacctgtacatgccccacgcgggccaccgatcgaggccgtacgccgtggtggtggtcgtcgcgtcaccgtcggcgtacgtccgtccggcgcggcatcgccgtcttgacttgttcccgcgtgctgagcgaagtggggtaggggccttcgtgtggtgtgccggtagacgatagatggtggcccgtgggcggtattggtaaggatatactccctccatctctacatgtctgacgccgttgattttttttaaaatatatttaactatttgtcttatttaaaaacttttatgaaatatgtaaaactatatgtatacataaaagtatatttaacaataaatcaaatggtagaaaaagaattgataattatttttatttttttaataagatgaatggttaaacttttaaaaagttaatggtgtcgaatatttagtggagtacgtaggtgggacgcgttgcggttgcccgcagcatccgcgaggtgtattgtggcaaccgccaacccacgtcctgctggcccactgggctatttgcggccaggccactaacatgcaaacaaaccgtaaacacaatttgttactaagcagcacacataagattattgaagctaaaaatcaacaaaatagatatgctgatgtgtgggaaaaaatagtactatcaacgtttatatagccactactgacaaagggggcactgataatctgatagtgatgatataatggaagaataatataaatatatgctgaaggtttcaacagaacttgatcagtgatcacacatcaagacagtcaaacatataccactgtaactcaataataatagtgaccacaaagtatgtttgtgatattaaattagatttaatataactaattaatttggcaaaattttcttgctcaacacaacttgatcgagtttctgatactggttacgcagcaggccaagaatattgcagaggaaatcatcaacttgatcttcatatatacttctcgtagaggacgggcagtgtgtgagcactaacaaatcctgttccagttaatcaaatatgaaatatcagtgacatttgtcgctaatacagtggactgcgtacattcagaaaatagtgacagacatgaaatttctgacgttcagaggttgaatgagagggattttgggaagaagttttgaagtagcagcctcttaccaatgtaaatgacagttaggaaattgcaccaacccccaataacagctgcaaccctgcacgcagtccaacgattgcctgaaaggaagcatagtttgacacaggcataaagtcagtgataaacagttatgatatttccagggtttgattctttaccaatttaatatattcatgatatgtttatgccgcattggtgtgttcgttatgggttctccctcgccggccgccgggacggaggagatcgagagacttgaaggtgtgcaggaccttctgccgccaccgccggagcatgcactcggcggccatgcatgcgctgccgcaccgtcggcgaaggccatgcgttggcgagcgaagtggccgagagcgaggctgtttgatggtagcggcggatctagaaaattgatttgttggtgtcataatgtgtctatcggtgtcatagcatgctaattacacttagactatagtgttaatagtgttatgatatatagataagcagttttaccataggttttatcgaaagtcgtcggtgtcgtccgacaccgatgcttacactgtaaatcctcccttgtttgatgggctgatattgctagcgtgggcggagagaaaggtgcctgttggtgtgccgtgcttgcttgcgtccgtccgatgccgaacgagcggcctagcgacgtcgaacgttcctcttacgtagattgatccattttcacggggaagggactcgggggaaaggaagtccaatgaaaacacattcatgtgcgacacggcgttttctctcaaacggacacagagacggcctcatagaaggtttttctaatataagggtcatggcaccctttatttgttttttatacgtagtttgagtttggatttacatgtttgtatagtgtcttagattattgtaatctattttattaaattttatgaaatttttatataactcaggtgtcatagcattaaggtgtagaaaatactgtcccatcatcctatgcataatcttgagagaaatttccaacaaattcaataagaggtatttaacatgttcctacaccaggtatagaaaatacttttccaattgagatatcatcctatatattttgagaagaatttccaacgagttcaatattgtagggaagtacaagtgcgtgttcatgagttcatcagttcatggcggaggctggccctccggcgctcggccggagttgctgggtcagccgagacaagacggtgccttaattcctccgtaccaattcaagtattagatccgtattatgagaagacttttcacaaacccattgttacggaaaaaaagcactacgtgttgtgcccgtacgtacacgtcctccatccgttacaatttaagcgtaactatgagttttcatgtctaattttaatagtttataggtttttatgattaatatttttgttgttattagatgataaaacatgaataataatttatacgtgacttatgaatttttaatttttttaaaatttttttaaataaaatggacaattaaagttaggcacggagactcatcgcaacacttaaaataggatggaatagtaggaaggctctctctcttgaaaggacgtaacaacactgatcacattgctacgtatccttccgttccaaaataaactaaattaaaataagactttcgtggttagggttttgtgagttgtcttgtatctaaaaaaataacacgttatcacgttaaacatatacttttaaattttttttattaaaaattgatttgggttcgatcgatcgatcctgcgtgcgcgagtaaagggacggcgccgtgaccatcaccgaatgatgttttgggtacctagctcagtcctcaggtggggtgctcgagatacgttgagatgaaaataaagtctaggatacgtagaacgagaaatcattcagtgcttaattacttaagttttaattattataaattttaaaataaatatatttgatatttaaagtaaattttatatagaaaatttttgtaccagatgtacctttagtacttaaaaaaacgtgcaagaaaatgttcaggtaaaatctatatatcttcaatcagaaaagccatgaatgtgcatgcgtggcagcgggacaagcattggcgtaaatattattacaagagacttttcttctttcaacttaaacggcggtctttttgtggcagctgctatacctgacgtacgtggccggtcacgtacggcttggaattttgaataaattagactactgtaggattggaggacggtgccatgcatcaccgtgtgtgtacacagtagtacacacaatgcaggagatggccgggtaaaatagctactgtgtgctagtacatatataccacagtattcctcatcgtactgcaccgatcgagctaaggcgttccattcaaactttcgaaaattccgttacatcaaatgtttgaacatatacataaaatattaattgtgaacgagaaaaaaaaaccaattgcacagtttgcatgtaaattgcgagacgaatcttttgagcctaattacgccatgatttgacaatgtaatgctacaataaacatttactaataacgaactaattaggcttaataaatttatctcgcagtttatatgcggaatctgcaattgttttgttattagtctatgtttaatacgtcaaatgtttgtccgtacattaaaaaaattttagcacggcctaaatttttatttttaagtccaactaggaagtttcttttaagtccaaataggaagttacctagcgcatatgcgcggtcaccttgttttagtgatgaaatctatttcgtgcggacattcgatgttggacttatcgagcgacacatgtgcagatagtccgatcagacgtaccaagaatctcttgtatgaaaaagaacgctattcacgtggctgggttcaataccaaccaattcactagcctttccttaataccaactaattcactagcctttcctttgcactatagctcctttttttttaaagtacagaacatttgatgatttatattttttaaatccatttgaaccatcgtactccactcaaaatatgtgacaaaacaagtccaatactaaatatatttaaacagtcaaaagtaatttacttaaaccctataagtaactaagtttacaatagaagtagctttctgtatcatcgaaagtaaacgtagtagaagatgttgaattaagaaattatgcgaagtaaaatatggagaagattgatgggtaaatacatttattttatatatttttgaagtaatcactatgtttttctttaaaaaaagtaattttcatcattggaagttattctaaaagaatagaagctagtgacccttcacgttattaaaataattacactagggaaaataggtctatttttctcttcacaatattagaagcaagtacattattagagggactagaaaaaatatgtgttgcaaaatatccgtgcattacaatgggtgaagactattttagtcttattattgttatatggtttagtaaaggtgaaattcactgtgttaaattcgcttggatatatattttgttagaaaatcatgagttgcaattaggagtctgatcgtctcaagttagcatgtgagttttttaaacagctatgtcttatatgattccttctatatttccaaaagcgaacgaacttaggccctgtttagttcacgaaaagaaattttttggttgtcacataagatgtttgaccgaatatcggaagggcttttcgaacacgaaaaaaaaattaattttataactcgcctgaaaaccgtgagacgaatctttttagcctaattaatccgtcattagcatatatgggttactgtagcacttatggctaatcatagactagttagactcaaaagattcgtctcgcgatttctcccataactgtgcaattaggatttttatctatatttaatgcttcatgcatgtgtccaaagattcgatgtgatgtttttaggaaaaatttttggggaactaaacggggccttaaaagccgactcaaaatcatatttgtatttctaaaagcgaacaaacttaaaaaccaactcatatgcggatgacgtaccaaagtatcagaaaaaatatttttaatttttataatagtagagaagtgactagaaaaataaaaataactattcacggtattataactgacttttttacatctgtagaagtaacatttcatgatattgtcaaaaaaaataggactaaccgtaccattctagagataccttcgctacaagatgatttaataataagaataaaatttggaagtaaatttgatttatgtagtttaattttaggctttattcaatttactttcataaatacctaagaagtaatttaataaaatctaaaagtaacttacacatatgataaaagtaattttcttatataaaaagataatacacaatatgttaatagtgggctccacacactattcctcctcccaacatggcaccgactcttctccggtgccattgagctcgtcctctaccgattgttgccccttccctggcgccgcctagtttgttcaccttgtcaattactgccccttctccattgaactcgtcctctgcccccctcaagccaaaatctgttgactactgccccttctttgttgctgtcaagctcttccacactgtcccaccgagctccatgtcccctgatatgcgtgaggtaggaagggacggtgaggtcgactcctgatctggcaaagaggggacatacaatagcgttgggagagctcttcacccccttgggctctcacgtggatctggctcacttggcggagacggtactgtcctcccttccctttccctatcctcctgtgccgcctcccgtgcacgcctcgtcagccacctgtgcttgccttgtccgccatcgtcgcttcgtcgctgtcgcctcctaccatcctatgcttgtctcgtccacagcctgctactgagcagtgtggagagagaagatagtggggagggggtgaaactagagggaaagattgggtagtgtaatagagagaaaaagaagtaagactaacatgtgggatctattatcagattggagagtgtaatagatagactattggagggaaagataaatttagttctctaatattttggcaagatggccaataaatttagagagctagatttggagaggccgttggagatgttttaaggagtttattataagttaaattaattgcttttgaaccgcttcgagtttagccgactttatagaaaaacaagtaacattttcaacatagaagaaatgtggtgtatttaatgaaaatggtttgctgttgtagattatcttaacataaaacaacatatgggtacatgtactcttggaattatattaaggaagaagacggagccaagtagaggatatagatatgtagtatctataagggcagtcccaacccatagtatcaataagcagtgtctatggtgccatgtcaataagacatcacaatagaaactacactttacaacccatggtttcttaaagtgggccattaataaatacatcatctctcttctctacaaatcatatttattcttcatctattatgaagacactattatctcccaatgcaaaacttaatagtgtctagtgcataggttctcgtgttgaagctgtgtcttgcatgagacccagtttcttcctctcttcactttctctcttaattaatatagtgccacataagttaaaagtcctacatggcaatgtagttaataccatagacaccatcctatgtggagggttgggactgccctaaagctacaaccaactaaatcctaaaactcaacatgcaaaagtgcaacattatcatccattagcaattattacatcttaaacctcatgtaaacatgctatatcatctatattttgttatatttaaaagttttaaaatacaagcatgttcaatcatcatcccatataatttacataatatttcaatatatatctccctatcgttttctacaatattctatatacatgtaccgttcatctccactagttaatgccttttatcttctctcattaaaccttatcacttcaattgttcctaacctttagattattaatctatagtccaaattatttccctcatttttttctctcatgaagccacatcaccttacttttttacttttggattatcaatctatatactatttaaaatatcataaaccacatcaacttaatggccttttctaatgatcgatcaaaaaataaaaaaaaattctaagcttatgacatctagctatgttacatgttatttctactattattgtataagctcccgcggcaatgcgtttggtttcatctagtttctaaggattctgtgactgaaaatcctaagaaatattatctttcctgtagactccagtgacagaagaaaatcatccactccaacctctttattttattttattttttatggttggtttcatgtgtttttcaattttctatttattatacatgtatttctatattctattattgtgattttcgcattccagtatttatatatgtttttacaatcttgtgttctgaaagagtctaagcctagagataggggtgcctattgtgtaatataagtattgctctatctctctattaatttagttaaacttaaataaattcaaatcattaaagataatgtaaaacaccttttatatatggaaaataggtaggtatgtggccaataatctgatcgatcttggccgttggatgcgatcaagagatcttatgacccatgtctctccaataataacgttgctagcacaaattcagatcctctgtattgaaggtactaatgcaaaggatgaatagtacagcggaataggaatactggaatactgtagaccgtccgatcgagaacggaagtttcggatatcgtactacttaacagtgtgctacaatattttcgatcatgtaaccgcagtaaatcggcactgttcatggtgttaattcattgttctctcacatgaacaatactcctctgctgtagatgatccggatcctgcttgcactactagtcacgtgtttcacattcttttcttttgaaagaaaacagtagtacgtatctcatatgggtttttttgttagaaaatatttcatatgattggttagttggttcgctaattttgtttgctagttatcatgtattacaacttggcacaaactcattattatctgatttgctctctttgtgtcgtcgcccaagcaaacaaatatatatgtagtactgtagattctctccatgcattcatcttaacttctccgaatgaattctaaattaaatgaatgaatcatcaagatgcgtgaatgcgcagattaagctattctaactaggtttacgaattaatcggctaattagcaaccaactggctaatcatcaattaattcttcttcatcatcatcatgatcatcatatttgttttctaaaatttgcgccggaaattcaacctagactggaaatatttctccaatctttcgttagctagctaccacaatgatccaaaagttttgtcaaatatttagaacggggccggatagctatatatagctaggcagtgtcgacgaagatgatgtgagatctctctcattgaatatctgatccgtcgtctaattcaaaagcttcccgtctccggacgctagctgctcaattctctccattttcgcatgcatccagccaaaccaaattgaccgtggactgatcatattacattacatcatccttcattgatacttcgtcccattttaaatgtaatcatagatttttgtccatcttatttaaaaaaagtcatacataaagcactatttatattttatcatctaatgacaataaaaatactaatcataagaaaagtttaaataagatagacggtcaaatatcgaatacagaaacccacaacaacagttaaaatataatggagtgggtacataggagcacttaaaagatcctataatcgattgatgtacatcctacggcagtcaggccactggctggtctcgagatgtgcgtactcgctagcaatttgcccataaaatattttttccctcgaggaatgatttttcttttatgttacctaaatatttatgatttcgtaaagtagaaagtgtagctcaactaattaggttcctattgataaaacctgtatctactgataatgttggtgctcgtatttatgactatttatttttttagtggtaggcaatgtactcttgacaatgagtaacccatgatgacttgtcattatcaagatatatttacccaagttttctagagattctcataaggattagttagaagtaatttgtttattttgttacaacttataaaagttaatttcttttaaaaaataaatatgacttaaatctaggtgacatgcaagaaataggagatatcctctcgctcggcaaaaattcatctcccaatttgtcactaattaatctactcttactcgttagagtcatcagcaagctagcttagctgcatgctgatcgggccggaatttcgaacttaattagcacgtggattaattggttagtacttcctccgtttcatattataagactttttaacattgtccatattcatatagatgttaatgaaactaaacacatatatatacacttataacggagggagtacaagtcattgtgttggtcaattgatcgatcgatctgttgctctcctgttgctgcggcttcgtcgttggctatatatatatacactagctaaagacccgtgcgttacaacagatattataagagataaaaacaaaagtaaaagcaaaagtaaaagcaattacaaatttacagcatatatagttagttgattagatatataatatcatatctaaagcaaaagcattgtatttatagccccacatgttagcttgtggtattagagtcatttaaaatagtttagatagatcagttgcagactcaccctacctagctaccactcgtgcatctctaacttttttcaactctatacaacacatcggtgttgtactagcttcctttaatttcctgatcgatcttaacgtactagctgtactatataaatactactagtatgaatgtatagtgataagcagcgcatcaactgtgcaactcatagctagctggaactaatttaaccagatatagtttgatcaatcgagctagccagagcaactgatctggtgatcatatatagtcatggatagcagcagctggatccatggctacacaaacgccaacgccaccggcgccaacagcggcttcatgtgcggctacgctgccaggtatatatgtgttgaattaaaacatcttgatgagatgatcaccgtgcatgacacgatcgatcaacgacaatatcatctctgtaaatcgtctgttcttgagtggttttggctgatcagttagttacctacttaagttcgtgcttgcggctgcagcccagtagagtttccgcagcagcaacagctggtcagctcgccgattcagcaacacctcaaccaggcaagcttaatttgctctgatcgatcaacaacaatgcataaaatcaatcaaaatgataggattaatctaatttggtaggtatatatggtttgcagatcagcatgcagatgggcatggatgacgagtcggcggtgtacgacggcgcctccatggtgggcgacctcctcatggcttcctcgtcggcgcaccacgccggtgccggcagcttccagtactcctcgtcgacgacgtcctcctccgcctccttccgctccgcctccgtctcgtgcaacccggagagctcggcggcggcggcgccagagttgccggcggcaaccggcggcgcgttcagtcgctacgcgcggcacctccgcccgaggaggccacccaagccgggagcgtgcgggcagaggatgttcaagacggccatgtcggtgctcgccaacatgcacgtggcggcgacgtaccgccgccagtactactaccagcaagcggcggcggcggcggcggccgaggcgggccggcgccgccgtccgacaaccagctgcagcacatgatctcggagcggaagcggcgggagaagctcaacgacagcttcgtcgccctcaaggccgtcctccctaccggctccaaggtaaaattaatacgtactccagtacatctatctattatataattaaaggaatagaaaaaggagcctccacgttcgctctcatggcctagaaattctcacattaatcggagaaaaagaaaaaacagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaattcgaaattaagaaaaaatgggaagaagagtttaatgctaatataggaatacaatttagaagtaactaaaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaagacgagtctagagtccatataggaatatatataatttacaaataactaaaattttatcttaaaaataattaataactaacacatatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagtttgtacgtattacacgtgcatatatatatgtgcaaagcttctttatgaacattttcttcaccaccttgactaatactctctccgggttaataatatttagacagactaaaaatcattcgacagatttttcgtagaaaattagtcggattttcaagccacccccacgtgcggttcaaatgaaaacatatcaacgtacgtcagtcaccggacgttaatcacttcaatgatgctaaaagaaaaggaaaaacaagcaacttacacctatttacatcaacttacatatgtaattttaaaacttacagtgtaaatacattaaaattacatatgtaactttgggtacttgcaatgtaaaacttcttttatgaaaaatacaacggtatatatagtcccaaaaatatcaaatcacacctcaaacaattaagttaactacaatgcaacaaaacaacgatgagtaaatccgtacatgtaaaacaaaaactacacccgcatgtacttaaaaattacattgtatctgtagtgcacttacattttaatcgtggtataacaatggtgtgagtgggtgtagtgtaactgcattgaaagttttaaaaatgttaagtatagacataaagctgttgtccgctgcttgctcagttggtggagtgcatgttgtggcatcccgacgtcatgggtttgattcccttttctagcgacttttttttttcactcaatggcacatgcacgtatctcaaagtaaatcatgcggtcaacaaatcgactgatttttaatagaaaatctgtcgacagatacgtagcaattccataatatgggttattgttttgtaaaaggcacgatcttaaataaacaactttaaccattatttttcattataatatatataaaagtgttaacaaatatataaccttattaaagtactttttaagactactctatatacatatatttactatagttaccatatttaaaaaataaatattttaaaaataattcataattaaatactctaaagtttgatctcacgcttatccaaaacgacaagtattatctgaccgaaaaaaaaaccgtactatttgcttaaaatatttctcttttttaatggcagaaagacaaggcgtcgatactgatcagggcaagagagcacataaagtctctcgagtcaaagctgtcggagctggaggagaagaaccgggagctggaggcgaggctagccagccgccccgccgccaagaacgacaaaggcgagacggcggcggcggaagccggcgacgagacgaagcgagaggacctagtagagatcgaggtgacgacgacgagcggcggcagcggagcggcggctgcggcggcgacaggaggagatcaagagacttgttgcacgctcaacgtggacttgcgcggcggcggcggcggaggcatgagcacgacggacgttgtgctccggacgctgcagtgcctgagagagcagatcggcgacggcgccagcctcgtggcgatgagcaccagcgccggctccggcggccgccctcctagtgcaaacctaacattacagctcaaggtataactaactaactaattaaacattttcttattgaagtcaaacgccaaagctgtctcacacctcgttgatcagaaaaaagaaaaagaaaagaaaagaagaaatttcatgtacattattgacggtatgattgtacacatttttctctctaagataatggaaaaccttatacacatactcatactttttttagataatggaataaaacattccggccttgcaaagtatcactctaacgaagagtgtagttcaaaataaaaataaacacacccaacaaaataaaagaccaaatcaagataaggagtacacatttattcaaatctatttataaatctccatctatattttgcagaaagttacataactgtcgtctcaagcctaagacatgcaaccttcataagctctccatcatcttcatacttttgcagttgtacccaacatcggagccaatatgttgctctgaaaattacctgtaaatatgagatagatggtgatttgtcaaataccatatcatttttactcaaccacagagcccaacatatggcagatgctcctacaagtatgagtttactctttttcttgtcaaccgtcaaaagccaaccatcaaacatattagatatggttctagaaaggtatagatcagatgagaactgaacttgtcaaccctcaaaagccaaccatcaaacatattagatatggttctaagaaggtataaattaactaaataaaaactgaactgctctccaaacaaattgattcgaatacgtgggcatgcaatgttcttgacggcttgaattaattagccttgacacctcaattaattacttcactctgctgacgatcctgcgagccccaaaagtctgcatgatggccgatcgataatgatggagggctaattaacgtggtactttagtaacttcaggtcaacattaagaatcaagcgtgaaagttgactaatactactgtaacgttcgtcgtcagtcatagctagcagacacaaatattataacaagattctctgaaaagtaaaggaccatgatgtcaaactggtaaaggaattctacaccactgtacaaatcacgattgatcgagacgataatgtatatatggtctgtgaattcctctgttctgtcgtgcatattattattgcagctgcagcccccgggagtttcagcaaagggagcagcagcaggagcggctgttcatcagctcctcgcagattcagcgccatttcaaccaggcaagcttatatcacaattttttttattgattaactagctcgatcatgaacaatcaatgcatataagatcaaagaaatatattgtagaattaactttgttgggttttggattatgacatgcagatcagcatgagcttgagcatggatgatgtgacgatgatcagtccgcggtgagccggtgccgcggtgtacggcgccgccatggtggacgacctcctgatgcattcgtcgacgcaccatgcatgctgtcgccgccggtagcttccctaatgagatttactccggtccaataaaaagtatctcgaggtactggtacctcacagtatcaaatcgttttcgatcgttggatctagttaggcaagatagatattcttaaatccaacgatcggaaacgatttgataccgtgaggtactggtacctcgagatactttttgttggactgaagcaaatctcttccctaataggtcatacagcccaaagaccttgtcggcggtggtggcggtgacgggattccagtagctggaggtctcctcgcaggtgccgttaccaccacccttggtgtgcaacgagcgagccccagcacaaccattacaccgctagcctgccaccgccaccgtcaccggcgatggagttgccagcgatcggtggcgcgttcagccaatacgcactactacaacacttctaataattatcggtttataggtgttggttcatttaagagaattttacggtacaatatatatactaatagtatatactaacattataaatgaggacacatttggaattccctgccaaatttaaaggggtatttagtaattcgtgattcatcttcattctaattgtcaaattgatcgtagatgcctaatctatccggagcagagagacgacccatggcattgaccgaacgacaaacatcggcggcggtgtgtaggcaacgacggcacggcggggaggccaagtatagcgggaggcgcagctgcggtggtgggtgtgttggcagcaagcagagcgcataatcatgaggctaagaagctcgcagttgaagccattgcagctacaatctatatcgttctatcatttatactgctagtatatacttgtagtatattgtaacataaaagttctctcatttaaacctctaaccttcacggaataaaaatatataaaactgatatatttaattaactataggtgtcagttttaaagggaaaaccggtatttataatattttatcggttttgctataaatcatttgacagaatttttttccaccgtatcatacgattttttttaccatcagatcccatcttgagatatgtgattctttggcacgttctctgttgattcgttatccgtgagcacactaattactcttgtgtttagctgcaactttctcggttcctcgggccaaggacgcatttggcttactacactatttcaatgtggttgtggagaccaggattgtgtgaagcagggagagatgcacatgtataaacaataagtagaaattatactatagaacaataataaaaattacaatctaaatgctacactatgtaattaactagagtgtaatccacacataattacactataacgagatgcagatgtagacggccggtggtgacatagccagcggcgcgggctgacaaagttggtgtggggcgcctccttcttggaccggttgattcgagctctcgcttggatggccaccgcgccgggggcgggaggtggtcgtactcgtacatggggatggggagaagcccggagaggcacgctaattaataagagactacctatacatttatcgataaattttcttctaaaaatttaatagatataattatagtacaatcgtagtgtaattacactgtaacttatatgtaattatactgtaatttgcatgtaactacagtgtaacttatatgtaagtttcacataattttaaatcattagatctattacaagatttattttggtgagaaagaaaataaatcatagcacacacatatgtgaaagaatttgttcccacgacctccaatttaccgaaataacatattacggatagatttttgaaagttacatacaagttacactatagttacagtgtaattacatgcaagttacagtgtaattatattacgattgtactgtaattacacctgtcaaatttttaggggaaaatttgtcgacaaatatatagcaaaatcgattaataatgagttgaacagtgcaagaagctaggctggcggcgccttctcgggcgtcacggtcagcggcgtcatcttcctgtcggagctccaccagacggcggcgacacatttttttattttaaagattatagctaggtgccagttctatagatagaggccccgtttactttgccaaatgaaaattttgggtggtaatatcggatgtttaaccggatgtcaaaaaaaggtttttgaatatgaatgaaaaaactaatttcataactcgtctggaaaccgcgagacgaatctattgagcctaattaatccgtcattagcatatgtggattactgtagcacttatggctaatcatagactaattagacttaaaagattcgtctcgcaatttccccctaactgtgcaattggtttttcttttaatctatatttaatgtttcatacatgtgtctaaatattcgatgtgatgtttttggcgaaaacttttggggaactaaacagggccagagcgtgtttggttctaaagttttttttttaaacttcaactttttccatcacatcaaaactttcctacacatacaaaattttaacttttccgtcacatcgttttaatttcgattaaacttttaattttagtgtgatctaaacacagccatagaatcggtgctgaccaagatgcacacggcaacaatgtacaggcgtacgccagtgctaataccagcagacagcggccgccgccgtccagcaaccagctgcagcacacgatgtcggagcggaagcggcgggagaagctcaacggcagcttcgtcgccctccagtccaggccgtacgtcctccctcccggctccaagctaggtacaattattaattagagcaagtttaatacagtagtacagtcaactgctggcttcaaattatctataaccaacttaatagccaactaatataatagttaattataaacatatactatataattaatatctggtcccacatgtcatatacacttgcaccttggagtccgtgctgaagttagctacaaatctgtagctcgctaccattctctcttctcttttatctcctcgaaatatgtttatagctggcttatacacgaacgtatacacgtgcatatgcatacatgcatattcatgaacattttcttctactccgtattaattgattagtattgatcttcactaatatttgcttaaattatttctcgatccattttaatggcagaaagacaagacgtcgtcgatactgatcggagcaagggagtacgtgaagtttctcgagtcaaagctgtcggagctggaggagaagaaccgggagctggaggcgcggctagttagcagccccgccgtcgtcgccaagaacgacgaagaggaggcggcggcgccacccgaggctggcggcgaggtgaagagagagaggatcggatcaagtcactagcagagaaaggctttttactaccggtttataaccatctgtagtcttagtttttcgatcgagactacgaatgcaggactaaaaatcgctatctttagtcccggttcaaatacccggtactaaagatcgatttttagtcccggttagtaacaccaaccgagattaaaaataaagtcatttaccaaccgggactaaagatgaagtcagatctgattggtagtttctcttttcttgtattgttttctactttgaatattgatttcaccacatcccccagaatcacataacagaacatcatctctaaatctcaaatcgatcaattacaaatccaccatcttcaaatacaaacatcataaatacatcacatatttacatcgcacacagatcaaatacatcacaaattctcaaaagcaaattcattacaaatccaaaaaataaacaaatcctccactgccgccgtcgcctgcccgccgccctccaccaggccgcagcctagccgccgccacggctgcttcttccgcacgccgctgcctgcgccgccgcggccacagcccagccaccgcctggccgccgccctccaccgggccgccgcctagctgccgcccggccgccgtcgcggcctcttccgctacccggctgctgtcctccgccaggccgcatcccaaccaccgcctggccgctgccgcggccgcttctgtcgcacgccaccgcctgcgccgccgcggccgcatccaccgtccgccgcgcgccgcgcccgcaagggagggggaggagaggtgaaggggaggaagggggaagaggaggagttgagaagggaggagattggagaagataagaagggagacgaggagagatgagaggataaggctgtgcgcgcgagaggacgaggaggcgcggcgcttgctctgcgatttttttttcgttttcattttttctcccggttgttataaggaaccgagattaaaaatggatcaccaaccgggactaaagataatagaagggtctgacacagtctgtcttcttttaaaccgggactaaaaatgatctttagtcccggttgattttaccaaccgggactaaagagtaaaaagtgatgtcagctctttcaaccgggactaaagtcatctttagtcccggttaaaattcaaaccaggattattgtggattttaggcaactgaccaaagatggtttctccagtagtgagtagagattgaggctttagataattaatgtggaatctttctcgttgtttggatgtcacttaaataattatgaaaaataaattaagaagatgtattagcatgtgatatatcaatccataaacatacaagtttaaatttaacttttacatctcgcaacggaaaaaaaataaatttgacatatgaatatatgttaacaagctgtagtttaatatgtttttctcgttgtgaaatgtagaagttaaatataatataacataacatattaatatattttttaaatttttttcataattatttgagtgacgtacaaacaacgagaagtcgtcccctcgggatatcaaaatccactccctagacaacgataatggaagcattattttcgacctctatatcaacaaacaatgcaaacaagcattatttatagaaccttgtcgctgccgttactgaaggaggaggatgcgaggagctccggtgtagaagccggacgcgccggtgcggagccatggcttgtaaccgagctggcttctcttcccatcagggagaaatgcaccagctggtccggggaaacaacaaccagagatctccggcgaattcgttcctctccatttctacacgcaatggatttgattcttcttatcggattcgaattggatgtagtttccccctttcttaggtggataaaaaacaaaaaggaaaataaatattggtgaagaactgtaatggactgggcctagagatgccacattatttttatgatggaataagtccattttgtctccctcatctcttgcgcttgattgaattgcctccctcaaccacaaaaccgggtataatgaatccctcatcttcaaaaaccggtgcaaattatctcctttagtggtttagcaagcagtatttgctgacatggatgctagaccgcggttgactcgctgagttggcaattggggcccacatgtcagcgacttccacctcatatcaactggcgccagtgttggatgaagccggccgaatcggcctccgtgcgtgcggctgcaagaagaaggtagaaaggaggaagaagataagaaaaaaatggggctgacagggggccccgttttgttttagcatttgtcacttacatgtgggacccacttctatcttcaatccctttaatgacatggctgccacatcagcacattcggaccaagtcaacctgccatatcagcataaaccgctttcaaaaccaccggaggagtcgatttgcaccggtttacggagatgggggaggtattatagccggttttgcggttgagggatgttattcggcgaagtgaaagagatgagtgaggtaagatggacttattccttttatgattgatgggtcgggttgggccttcacgaagtttttcactatatggagacatgtctgatctgttggagatcaggaggatatttcgtaagacctcaaatcctagaggacatctttcggtgacctcttaggatcttgaaccgttttcccttcttctctgttagagcatctccaacagcatctctaaattagactctttaaatactcttatagccaactctctaactgatttgggcagtcaaactaggtattcactccaatagtctctctatttacatctccaaaataaaaaagggacccatgtcaacctccattgccttcttcttcctcctctttctctttctcttctcccgcatcagcccatcgactgcggcggcgacggatccccccgcacgccaggcaggcggcggcggcttcccctcgcgcgggcggcgacgaggtgagcagcaacggctgtagcggctccccgcgcgtgcgagcagcgacggctgcggtggctcccccgtgtgcgagaggcggggggcgacggcggcggcggcttcgcgcgcgcgcgggcggtgacagcggcgacgcgcgggcggcgaagcaactgtggctccccacgcgtgaggcaggcgacagatcccacgcacacaaggcgagagctgacggcggcgaacgacaaggaagcctactgtaacaccaccactgccatggtcctctgctatttgggcagagagagatggtaggagtggtggagcccatggatggccagccgaaatgactctccaagtttggccagtgagtgctgtgatttggctagccatacggcttagccaaccgaatagagaggctgttggagggcatttttctttatacttgccaaattttagcttggagagccatttggccattctctttgagatgctcttacacttaccgaagatgcacatatagtgttattcctgatggggaaagtatatggtggaaatcacatcctaggtggaaacttgaattttttttttataaaagttcttaaaaattctttaaaaaatcacacatgtaggtaatatgtaaatgaacgaccctacaaagttgcatgaacaaaatcaacttcattaatgatatataaattaacaaataacaatattcctatttttgtctttttctactatgtttctcaaattttatatctcaaaaataaagttaagtttattcatggaactttgcatggttgtcaaagtactattaccttagctatctatgagattttattttttattttttttaaaaaatatcattatttcttctatgtttctcatttttacatttcaaacaaagatataaaagttttcaaaagatttggaaaaaaaaatctcacaaattgaacaaccatgtaaagttttaaggataaactgaacttcatctgtgaaaaattgagaaacatagcagaaaaagaaaaaaatgaatagtgttatttgttaattttgtaactcattagtgaagttaaatttgttcatgcaactttgtaaggttatttatttacgtattaccaacatgtctgatttttttaaagacttatttaaaaacttttacataaaaggtttttaagttttcatttaagatatagttattaacatatactttcccttgggaggctggaatgtggcatgcttgattttgctctgaaattttacattttggtcctttttgaa

SEQ ID NO: 26148 - DNA, 366 bp, Oryza sativa
ttctcgctgcccgccgcgaagttgagcacgacggggaccgtgccgttcttgtttctgaaaaacttatcggttgtcgcgtagtccctctcgaagctgaagcttttagcctccatcaacacggcgtggctgcaccaggtgtaattgtccggcgaccagctgttattaaataataatggcccgctgaattcaagccggtaggatttgagtcccacggggatggccatctcgcagcatcccgcgccagagcagtagccgttcctgatgttgctcccgttgccgaagcatgtggacatgcagacgttcaggatcgggtcgactgacgcctcctctccggatagcaagacgagcacgttgcagccgacggtg

SEQ ID NO: 26149 - DNA, 836 bp, Oryza sativa
gagtaatctaggtcgagagaagattatcttttcactggaaggtctcaggggctactgtggagattatgggtaccccatacccacacggcatggttatccgactagttataggggataacttatatttatggaatatgtaacagttcatgacttgggtattacgtttccttgtatattacagaacggcctaaagtcctagtttggtaatattgtaaagtagatttaggaaactgataccgtgttggttaaggtttttatcttgtaatcctgcctcccatcctatataaggtgggcaggaggccctctagggggcatgagacaacctgatcgtcagataaataaacacccggtggattcaaatccccaaacaggagtagggtattacctctcattgagagggcctgaacctgtctaaatccctgtatctgcatccatccacttttaggtctcgtacgctacccccttttcatattaccgaaaatttgtttcgacacgttggggaggtggttgtgatgttggcgccgccgtcatctgggtcgctgccgccaactaatcggacaccactgccgagcgcctcttcaccgagcttgtcgtcctcccgctggctcaggcacatgcatcggcgcacttgcaccctagccccccgagggcgccggtggcattgtagctccgaccacgccaatcgaggccgtcacgaacagcgacggcgcagccgccgccgctccccgcgcgagaaagggagaggtgaggaacattgtgcacatctgcgcgtaaaccccttcctggtggtggccacgaccaccagctcgtagaaggagagctcggtgcgaacctct

SEQ ID NO: 26150 - DNA, 3692 bp, Oryza sativa
tcatggcacagctcgtaaacaccacaagattgaggcaaccgagcccagccatcatccagaagaagcgatcaggtgcccctcgttgaggtcgtcggggatccaccccggccggccgccggtcgccgtcgcccacgacacggccgtcacgacgagcgagctcaggtactcccccgccgcgacggagatgaacccgagcgccgtgcacaccgtcttcatggccggcggcgcctggctgtagaagaagtccagctgccccacggtggcgagcagctcgccgacgcccaccagcacgtactgcggcgcctgccacaggatgctcgtcggctccatcccggcgtgcgccgcgcgggcgcgcctcgtctcgaccagcgccgccgcggccatggcgagcgcggccatggcgaggccgccgccgatcctgagaaggtcggagatgcccttctctctccccgtcagcctcctcgccgccggcacgaacgcgcggtcgtacagcgggatcaacacgatcgtggtgatgatctggaaggtggccagggatgccggcgggacgtggaaggagccgacgcgcgtgtccatcgccatgccctgctcgacgaacgtcgaattggcctgcgccgtcgcggtgtagtagaaggcgacgcacgcccacaggggcagcatcctgacgagaatcttgagctcctccacctgcgtcaccacgcaaagcctccatggattgggcggggcggggccctccgccttcttgtccgaagccgtcacgaccgcgcccttgtcgaagaatctgatcgagcagttgcatctcaagaattagccaattacattacacctacagcatcacaaacaccagatgcaacgagagacatgaactgaccggagatcggcggtgtgctcgatcctctgaactcccttcatggaggaggcatcctccgataggtcgtagagaagggccatgtcggccggcggcgcgacgttgaacttgcggacggcggcgacgacgacctggcagactctggtgagcgggctaccgcgggttgtctgaaacctgtacgcccgagacgcggcgacaaggcaggagagcccgacggcgaggaccatcgccggaatccccaaccccaatgcccacccgtagtggtcttgcacccacaccatggcggtggtggatatcacggacgcgcagttcatggtgaagatgtaccagttgaagtaggagcccttgctgatgcgctccgacgtgtcgccgtcgtcgaactggtcggcgccgaaggacatcaggcacggccggagaccacccaccccaaatgcgatcatgtacaggccaagaaacaggatgatcacttgagctgaagccatggacgacgtgtccttgatcagcagcggcagaagcgccgacagagccgccatgagcatgccctgcaccacagattaggtacgtacagccatgaagctgattggatttgcattcatgccaccccacagtggggaaagtgatttcatccctccaggaaatatccctcgtttcatccatgccacttaattagtcataaaaaaaattaaaaaaaatggacaacataaattaattaaaatataaaattaaatgacaacataaattaacataaattaatattaatataaaattaaatgttctctcaagggataaaaatccacatcccacacagtgactgattacttgccatcagccataaattcacggcaggaaggacacagtgactaattctaattaaggctgtgtttagattggtataaagtttagattttggttgaaattgaagacgacgtgactgaaaaaaattgtgtgtatgaaaaatttaatgtgatggaaagttagaagtttgaaaaaaaaaatttggaactaaacacaacccggatcgaatgaaatggaggggactaacagcgacgccgatgcagcagctgacgaccatggtgcggtaccttccccagtaggaatcggcggcgacggctccggccagcggcgtgaggaagcaggtggcctgccacgtcgacacgttgttggcggcggcgacgttgctctggtgcagctcggcggtgaggtaggtgacgaggttgaacgtgatgccgtagtaggccaggcagtagcagaactcggtgcctatccacaatcacaaagcaagcagaataagcatctctcctcagtgttgtcatagctcagataaccacatcaacaaagaagttcctcatttattttttttttcatttttttcttttttggaacaagaacacacaaagtgagagacacattaatcatcaaaaaattggcaagtaaaaaaggttaggaaataattaatagagctgcagggatatctaatgaagtttattaccaagaatcgggcggcatgccatccatccgcctgtgcgatgcttcagcgccgggttgccatcgacgccaagagacccatcagtggtgtatgcttcttcaacctgcagcaaccaaaatccccagcctagttagcactgaacgtatccatgagcggctgcttcaaattaactaggagtagctagttcaggcaaggctcaatcaatatttttctgcagggaaactgatgagaaattaaacaaactgcatcgtggaaatcggcataaggctagcagtaaggagattatgaacagcgattaattaattacctcgggttgtagcagcgccactgcgtgttcctgctgctcagtgtccgtggacgccattgccggagccggtcgagagctcgaggacaaactgtacaagctaatcaagacctcgagaggatatacaggacaaccttatcccgtaccaactctatcagagacccaaaaggaaaataaagcgaataaagattagtatacaagttaatttagatacgaaggagtatattattaattacctcggcatgcataattaattgtggtttctgcgacattgaagcctcggaaattattgttgctggctgtactagcgtctatttcttgaacaagactgagaaatcccttgttccttttgatttctttagtcagtagtgtcactatccgcaccgatttattcttggacgtttccttttgtttcttgtatgcgagaagcagatatttctgacctacacagtgccgtgatactacctccgttcccttgtccttagcgttgacccgtgtggtttcatttctatcaaccactaaaaacatctaaattttatcgtgtaatttgatagatgcaagtagtatataaacttatattaagcatataaggtacttcgatgactttaaatatgaaactgttgctaatgaatggttaaaatttgtatatgaatggtatctggtgacaatggatggacggccgatgttgcatgcagttgctaagttgcagttactactgcaactgcacctgatccgaattacactatgggttcgtctagttgcctgttactttttgtcacactgaaatatattctggtgactaacttagatagtttggctctatatggttataacaagattatcttccaacaaaataaatctcatacatcaataacttggaaatttttgctaagattttcttgaacttgctaaggtgtggtgaaagtatttcaggcgtggcaatgatgttaagcacacaacctttgacaagtttggtaagggcctgtttagttcacgagaaattttttagcgtgtcacatcggatacacggtcac

SEQ ID NO: 26151 - DNA, 3216 bp, Oryza sativa
aatcatttcgttgacctcaccttatgctcccaagaacaaatacccagtattccttttgaatattttccatgacttctccttgagtttcccttgatacatccctaaacccttgagttcgaatatcaaatttgaatttgaatccactcctaatcagtcttctctacaaaagtctattttacctccctcgggtgttgtgggccgtattccccctcagcccacctccctccctcaaccgtttctcctccctcagcctcgcacgtgcgttgcacgtgccaagccgagccgagctctctctgtttctccttctctctcggctctctctctctctctctttctttctctctgtttctctctctccctcgtcgaactccctctccccggcgtcgatttcccgtcgtcgctgtttgaatccggccgcgccctcacgtccgcgcgcgcgcgctcgcgcgtggccgaccgcccggtcgccgccgcgtcggccctgccgcgcctgccgcgcctgcgccgcccggccccgctgccctgccgcgctgcaccacgcagccgcacggccccgcgcgcatgcccgagccgctccacgcgcgtcctgccaaaacccggaggccgagctctccctctccctcatactcctttcccgaatcggcttggagcgagcctctctttttcccccttctttttccctttccccgaccaccgccggcgtcatcacctgtcgccgcctttgctgcacgcgtcgatgaccgccagctcgctctccttgaccgccaatgtcggttcttcctctctaaatcgacattgccatctattaaaccaagccgccccatctccctctcgttcattccctcgccaccaccgtgcccttgccgccttgctaccgccgtcctcgcctccctcctccattgcgcgtgctggtgaatccggcgtgtgcgcgaggagctgacgcgggactccaggcgccgtctccttccccttccccggcccgaggccggagaactcgctcccgcgtcggcggccgctcgtcacagcgtccgtctcggctcggtagtgcctctcccgttctccctcctcgctccctctcctctccttagctctgggcagtagtgcgagtagccttccagtagtaagctggcgccgccccgaccgccgccgctgctcgccgtaggctcgccgccgtcgccgcccaaactcggtagtagccgctcgtcgtcggccttcctcggtgtagctccacccaatccgactctagaaatgaactcaggaggtcgcgtagatgctcaagtccctaggaatcgagctctcgtcgcatcgtcgtcgtttccctcttttgccgccgccggcaagcgtcgccgcgattcgtcgtcgccggcctccctccggcgaatccgatccggtggctcactccctctcgtccgtcctatcgttcaaatgtactccctctctctcgaatcgtcgcgacgagctccggtgaactcggccgccgtccgccgtccatctcgggcgcctcctcctcctcctcccctttcgcccctgcccgcgtggccgaccacgtggcagcaacctcagccccgggcccgcttgaccgggtcaagcacctagtcagccgcccccaccgccctttcttctgtgcgcgcggtccacggagagcccttaggctgcgcatgggccctccacctcttggtccacccgcgtgccgcgccgtgagccgcgaccgtaaaaccctagcgccccgcgccgcatgaacccttccccgtgtgccgagtcgctgactcgtgggcccgtcccgggacccggcacgatggatccggtccacccggacccatccccctctctcttcatgcgcgccccgcccgcttgggccgcgccttgcccggccattggccgccttctcgcgcccgcgcccggcccattggctcgaccacgccgcgcttatcccttgggccgtacccgagccgccaaaggaagtctaaatctcatccctccttccttttcttatccatagggattaataaatccttttccctttttcataaatcaattccttattcccaaaattccgtaaatcatttccttggtcccgcacgtcagtgacggtcaataatattcttgagaatattatttctataaatttcacaaatcaatttccccttgttccacaaatatcttcctttgcccagaaattccaattaaacttccaaaattcatatctctcaatccgtagctctgattgactccgttttacttccagtatttccataaaattgagatctatttaatggcactactaattagtctaaataggatctttcttttggtctttgtttaggttttcgattgtttgcgtatagttgcggttaccggatttccgtcgatcgcgggttttcttgaagattcgtgaagcttcgtgaagaccttgagcaaggcaagtcaccctttgatcaattgctcctataattgaaaaatcaatattattttgtttgcaacttgcattattagaatcactcctataacatgcttggcctcggtttgcatgtcaaaccgacggacctacctagtagtcgcactaattcctgtaggctgtactaccctaattccttgtcgctccacccttgtggtacctcggtatccgtgctctctgagcgtgtataccaaatatcccacatacaccgttgattgtcgaaaatttgggaaatgggtttgagaagccttgaaaacccgacatgtggcgtcggtgggtttgaaaataaaatgagctgcgaaaactcgcgatgcgggggttgtgcctacgtggcactgtcccgtattcgcatataaggaccgattcctgtaggaaactcatcgaacataatcaaagtgcaaccacaaggtggaatgggacaccctggctaagtaactagtcggttcagggaaacctcgcatgccaatagttgggaaagccggggcggggtcggttggagccaaaccgggttcctggtaaggcaaggaagagaagcttgccagattaccgatcgagatggttggagtttgatttgtgaaaactaaaatgacctatatttatgtgatgatttgatccttctatgtggcatgaggtatccctgggtcggcttgggaaaggctttgttgcgagcctccgataccgacgggtgttcggaataagttcgtatcttgtgggtaaagtgtgcccctctgcagaggattaactaactgttcgaacagccg

SEQ ID NO: 26152 - DNA, 1999 bp, Oryza sativa
aactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatttaaagggcactacgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagtagaccatcttacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgtataatagtggaaacctgtccattgtgatcggagatcccgtgaatttggatggtgaaacaaactattgtgtgactgagagaagagacccttgaaaggggctcattttcatgatgtgcttatcttctttcctgcatggtaggatggcttatgtattaatgtgatccgagtggcttttccaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatacgaacggcagtccagtaccagtcaaggttctgagtgaaatctgatcacacaaaactcacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggcccataataagtgttgaggataataataccacctcaggatttaagcgagaaatatctcaacctaaatagggagttattggaggctccctgttgaccagttgaggcaggggtcggaatgccacacgcgcgcgcgcgctccgggccgtgggcgtgggcgagggcgagggcgagggcgtgggcgtgggcgtgggcgtggctggtgtcacaccctgaagttctcctcctaagcctaaaattgaattaataagagactctaagaaaacaccggtgcaaagcaagagtaaaccctgctaaatcaatgcaaataataatcggaattggcatgtggaatttttcttgagttatacatgtcgaaattcactaacaagatttttagtggaattttcagagctctcaaaataattttaaccatttaaaatcgagcttgcaatattttaaatcccagggaaattcttttcctccttttcttttgttttcctttcccctccttttcctcttcttgggccgtcggcccaatccacctgtagcgcccgttccgtcgtggcgcctaacgggaaaattatctcttaaaaaacctaattgcgaaatttgtttctttgcttgttgtctagtgtccgtgccatctcaagatctcaatccccgatctatcgtcgagttcaaatccaaatccaaatccttccaaatcaaattcctccgcaaaagtctattttgcctcccccgggggtcgatgggc

SEQ ID NO: 26153 - DNA, 4027 bp, Oryza sativa
  unsure (1)..(4027): unsure at all n locations
ctctcccccggcgcgctcccgctctctctccctctctctcgctctctctcgccccctccccttcccggcgcgctccctctcccctctccctcagctccgctccgctccgcccgcgcgccgcgcgcgcgtgcgtgggagccgcgccgagcgctcctcctcctccgctctgtccgcgcgcgtgcgcgtgagtcaccgcgccgagcgcctcctcccctcgctttccttctcctctccctggcgagctcccggctcgcaaagccggcccccgcgcgctgttgttcgcgcgcgcgcccacgtggtcctcgcccgcaccgcgtggtcgccgcccggccccgntgccctgccgcgcntgcagccgctcggccccgcagccagcgcgcgtgctcgagccgcgcctctccatccgntgcgccctcccattcaagccgcgcgcgcgtgccgagtacgccccaatctggtcgcggcccccgtcaccctctaccgcgccagcccgcgcctatcgcccgtgtcgtcgcgccgctccaaaccgccccgccgtcatcgccgtcgtcatcgcctcggccccgccactccgcgcgcaagccgccaagggacggaggccgagccctcctccctctgcctcgacgcccccgctccccttccccttttcccaaagaagaaaggggcgagcccccctttctctccctcctttttccccttttcctcccgccggcgtcatcctccctccctcctgtcgccgttttggccgctagccggagcgacagctcgtgccttgaccgccaaagtcggtttccaaaccgacattgccgccccctataaacccaagcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttaaccggcccgatgccggagagatccctcccgcgccgtcggcctctcgtcacagcgcccctcctcacctcgtgatgcctccctccgttcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagccttgctcggtgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgaaccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgacnccggtcagtccctcnccgtgcgcgcgttccaccgcgagccgtgaggctgcgcgtgggcccgctgcatccgcgtccaccgcgaaccgcgcgcgtgcaccgggtccctcccccggttgggggcatgaagcgggtactccctccgcacggtgaaccgaaccgctgacaagcgggtcccacccggggccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttcaaaaaaaaaggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagccccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacataccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagcgtaccccctcttcagaggtcattaaactgttcgaacagccgtgcccacggtcacgggcggatgtgaggtgattcctagcgtagttttgtttgactactgcttgtgaaattgctgtgtgaaaaggggttcggtgtttgaaaaatctgcagctgatgggatcagctaggcccgggtggccgtttgaaaagttgttggcctgggtggccgtttgaaaagttgttagccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcagaaacatcagcctttccttgaagcctgcattaaacacttacttcccatggcttgctgagtactcccgtactcacccttgcactatataaataatccccccctagttgctgaagaagatgaagcgggtcctgctgatgaggagttcttccaggagcaagccggctacaatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaccaccccgccgcgcgcgcccttctccttgtgggccggcccaagccgccctccctctctccccgggacgccgacaggtgggccccacctgttgggcccgtctccttcctccagtcggcgccgccgcgcccgcaaccgccgccgcgtccacgcctccgcctcctccgggccacgtcagccacgcccgcgcgtgcgcctcatctcccgcacccactt

SEQ ID NO: 26154 - DNA, 8449 bp, Oryza sativa
aattaaaataaatcacatggtgggctgtgggtgcatggtttcgctggtcgcacccatggcagttaaggaccggttcgcgggatgccctggaagaacttatcgtacttaccacaagctagcgtgggcaacggctgggcttgtagtgtagccttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggcctctttccgatgtgtcgtggtggcatgtcggcgcacggaaacgtgttgtggggctgtgtcttgtgggtacagttgtatacctctgatcagagtaaaactattcgaatagccgtgcccgcggttatgggcggtcaaccagattcaccgtgattagtctcaccctagtgtaatcttttgaatttggatggtttaggtggatggttgggcctgttgcaacgtgggatagcgttggacagcggatgatcaatattaattaattattacaactgcttaaatcttttaacttctgtttataaatgctcgctttatgcaaatgaaccactctagctcttctttgataattccctgcatcatacccctattccggtatgacttgctgagtacagtgggtagtactcagtcttgctctatttttcccaacccccccagagttcgagtatgtgtcagatggaggtttctccgaggagtaggcttcgtccgtgccgtcgaggatgcctgtggagtggtgttcccgctgcagttctagtcaaggcttagctcctgtggtctttcgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtaacaaatggcggctgcgtgctgcgtcacgtcgctatccttttgcaggcactaacccacgttcccacgattccctccgcaacagcgcgtccacgttctttctcctgatagataaggaggccgcgagtccgatccgttttcttagcttctttcccggtgttagtttcttcttctccgcgcctgaattgctctcgcttcctcgcttctgatctcttgcgcgcacgagagaatggaaggagcagtgcctccgaaaccacaccttcgcctgagatctgcaccgggtaggcgggtgatcaggtttttggggagtgcctcccgcacgactgctcgactgctcatcgccatgtctggagttgccgccgccactgctggcggtggtggtacgccgccgacaggagctggatccggagctggtgcgccaggaggtgccgtgaacgacaacaacaacggaggcaattctgcctcaccatccagcggagggccattctcggggtatactcttctcctcctgctactgttgttagcgctattcctgttcccattgttagcgctatcgctatactatgtgcgctatgtttttgttcctgttctacatgatgcctctagcatgttatcgcgttactggtatattcctgttcctgacattcatgatgcgcatagtatgctactggttatgttaagatcaccctatactgcttatgccatgatcattgctttaactttttggattaaaatatgtcgattaatgactatatttccaacattgagtgttcagtgttcttgatcagtgatgaaatttaatgcaaatgatgccgtgcgatgcatctagaattctagcatagccgacttcatttttttgttcaatctggccgatcaattgggcttagtggacgtagatgatcgaactatcgaagagccgacctttgacgtggtcgttttcaattttgaacggccctcgccctccatgaccatgcacgcataatcggctcgatcgtgtccagtcttggttgactcctgataaaaaaaagacttaacgcgacgcggcttttaacgcatcgaagatggcaaaagaaacgctagtaaacgcctgtgagtagcttcttccgctgttcgtgctatcggccttaatgcattgatgcacattggcaactgaaccaggttggggttccagttttctaggcattaggcaccaacaaccaaccattgagggcccaaattaaaataaggcaaattaacccataggcccccaaattaaaagaaatgagaaaatcaataagttatcttaagaacaaactaaataccgctaccttttaaccaccttgcaactaaaaaataataaacccaaatttgaacgttaaaatcacattcataactaattgtttacacaaattcctcatttcaattaaaatatcacatattcaaagatatcttgttaataaaatactactctctccttcccaaattgataatcatataatgaaatccaaaatttcttaaattgatcatcattatgaaagaatgtatgtatagtatcttgattgatgtgatttaaattatccttaacgttggtacataaatatatatcatatcattttgggatggagggagtatcatacttttattgaaaagaagacatactatgataagggtgggttctaaactctcgatgggatatttctcatgtactttttttttctttcgaactgaatacaaatactccctccatttcaaaatataagtcacaaccacccttaacccaaagaccaagaaatagttattatcaccttgtagtttagatcatcctaataaatgtaatgcatccatccaatagagttagagaatgtgagtgaaggatttaaaaaaatagtaatttaatggagaattgttatagttaatggcatacatacatgtatgccttatattatggaatatcttaaaaaaagtggttgtgccttatattatggaatggagggagtaattgtttaacaattttttttatcttttttatatatcgacatgtgagttgagtttggacctaagatttcatgaaattgtacatatagacatgtcatgagtgctttaaatttttttttagaaatttttaaaacagtttggatggtttttaaacaaacgagaagacatcccctcgagaagtttccaatacactgcaggggagtaacaagaagaacatcggtgatcttgctgaaattacgtaccaacctaaaagacataaaattatcgaacgcattcacttagatttccacgataatccgatacataacagagatttggagaaagtagactgccttacagactcgataatacattatttagaagccaccattcatgggccataatcgcgaattctgatcgattagcagcctaacttttggagcgctccaaaacctctacttgccatcgccatggaggccctggaagtagccctgcgggttggactcgaagccggagcgggagatgtacgatccgtcgccgccgggagccttcatgctgtcgcccccaccgccgccgtggtagccgccggacttgcctgcgccaccgccgccaccagcgtgcccgccgctgtatccgccgccgtacttgcctgaacctccttcgccacctccctttcctcctcctcctcctccgccaccgccgctcctgcccccacctccgctgccgcctccacctcctttgccgcctccacctcctccaccaccacccttgccgcctccgcctccgccgccacccttgccgcccatgtctctaccttgcttgatcagtcgaagaataagcttgcagaagtagagtactcttgcgattgaacttgcgaactgcgttatgctgtatcgagctggagtgctttgttttatagaggacgacgtccaccgggataagcgcgagcaatcaaagccgcgttcatggcgacgcctcgcatatcacgtctgagccatgcatatgcccattaccaacgcgaagaatgaatcagaatttactactccggccaaactcccgagagttttaatccgtgaaaattcaaaggtcgagttggaccctgaccgttcggctgaatcatcatcagcaacggcgttgcgagaagccgagaaacaggccgtatttgtagagcccaagactatagactgatctgggccattacgagcaacagcacacagcccagctccttctatgggctgtggcccatagatcacctgggccagtatcctcctcacaggcttccagccaataatcgtagcttgtaaggtaacaacagtacaactgtacaagaaaggatggaagtgtcacatgcatttctgtcatgttgaaccagctaattgcagcaggccaacttaccgtaacacacacgtacgcacgtcgcaacacggctccgcaacagaaaaaaaagaaaaaaaaaagaaacaggatcgattaattatcatacaaaaacgttgccgccttgcgcaaccaccaaaattaattaaactacatcatcatctaccactgtaattaattaattaatgaactccatcttctgctgtaattaatcctgtgtacgtgtgttctgtatgcatgatcgcctcaccggagtatatatatatcgatcgccggcgatcaccggaggaggtggagggccttgaggaggacggggcggaagcggcggacgtcgaggcggacgtcctgctgccgaggtagatgtccttgacgagcgaccagctctgcttgtggatggggagcgggtcgaggaacaccgggtgcgcccgcgggtacacctccgacagcgtgctctcctccgccgtgatgttgtactgcaggtacctcatgttcatgtcgcgcggcggcacgccgtactcgtccatggcgagcccctccatcctccccagcggcaccacctggatcaccaccgcgttcatggggaggaacaccaggttggtcagccccgacccgtgcaccgccaccatcgcgtcgtacgagttcaccgccgacgccgccgccgggatgtgggcgtccagctccgccgccgccacctcgaacccgaccccctccgccgccgccacgatctcgtccaggttcacgaaccggcggcgggagcgccggttgatcaccagcagccgcggcttcttgctcttgtcctcctcctccatccggatcgcgtgctcccgcggcagcgcgtaccgccacatcaagaaccgcttgaagtccaccatggagtagttgttcggagctcgccgcgggtcgatgctgaggtccttgtggctgtggagcccgacggtggcgcggcggtagcagcggacgcgctgctcggcgtcgaggtcgacgggctcgtacttggtcaggccctccacgatctccctgtacttgccgaaccaccaccgctgcttctgcgtcaccagcagctggacctcgccggcgaggtggcgcgacgtgatgaacagcgggatgatgttgtcgttgaagtcgtggtagtagttgccgcagtagccgccgttggagtacacgatcgccgggacgtcgtgccactcgtcgcacggcggcgcctcgtcggcggtcaccagccgcaccgtcacctccgtgatgccgggcatcacgcgggactcgcccttgcgggtgtacggctggatcttccacctcgtcgcgttcgcgtccacgcccgtcgcgttcacgccgccgccgccgccggagatggaggcgaggctcggcgccaccaggaacacctccgacgtgcggccgaggatgcggatggcgccctccatctcgcacacgtcggatctattgtctctgaagtcgcatcgcaggtgaggctccgggatgaactcatctgcatcaagaatttcatcgagcaaattaaaacaaaatcagaatcttttctccaagataaactcagaatcaacaacgtcagaaattaatcacattgtggggtttgaaattcccaagattatgtgacacatacctacttgtttgaagctcctcctaccatcaatcaacattgatgggaaaccaggcttgcctgcagggacaacccatcaatgtcagttaacccatttcgatcacaagaacatgggaataacaacagatgctgatatcctaacgtgagcagtagcctatcatgaatccatgatggacattgtcaacgaactaatcaattcatcattcagcaactgttaccattttatcccaacaaataaaggaacttgttttcttgaaaggattcagcaactgtttccaaatatgcacaggaatggagtatcgacaagacaaacagcatatgcttctctgacagtactactaatcaacatacaaactgaagaatacaaaacgattatgattacggcgtacctgtggttagcatcaccatgtactgatcaagggttggtgagtaaatcaccaagaactggattgccacgatgagcaggagcagaggagggtggcagaaagagcccttgctcttcttgctcctcacagctgccttcatctctgaaacagcaactacccacacaccagggacaagaacagaacagcagctttacaactatatacaaaacatagagcttagctccctctctgatgcaggtatccataaatgcatcacatttgcatgtattagtacattgctaggcaagttgattagttaagtccaggggaattaacaaaccagattattaatcgatggacccagcgaagcagcagcgagcaatagtgaccgtgaagaacagtactgctacatgatttggaagtgatcaattaattaatcaggccttggtcggttgaaccagctgggcagttcatggaaaccacgtttattcgcgtccttttcctttttgttcttttttttttcgtcacgagaactgacgttgcttcttcgtctttatgctgttatttcttttctctgaaacagctagaattcagaagcaagatttcaagaaaactccagtttgtggtggcgatttcgactgttttaatctcaagtggcaaatctgcccgatataatttgtgaagtcaatgtgtgacatgtgccatctaatggtgttttgcacttgaaaacccgggatgagttcagaggccagatccgttacactgcaaggctacatctgaaaaagaataaaaagcgtgataagtacccctcagatctatcagtttggcatttcatgattctgctctagcaaaagggaattgtttgatagcacaggagcacatggggggtaagggaatcgcggagcaaacgcaacgaaatggtaggggagattgctcagattgcaagtttgtactttatatgtatttatattttggatgaactttgtgcactttatataaagtgggagattatttgttcataagtgaaacacttgctaatcctgcattttgcataatcataatggctgaggcttttgcatcctgtgcttctgcatatacaatgactcaaaactgcgtcttttgctgtctggtcatgacaaaagaaaacaattgcagacaccaataaaaactgcaagctggatatcctggattaacactctggcatgagcaatatacaaggatcaagaagtaaacgccaggatccatgaacaaatgagcatctagctaacatgtacacagcgcgagatcatctcgcgaatagcatggggaattttctttaattctgatccacgttggttctgatgtatggatcatacatttatcttaggatggttgaccaatccttaaaataggatgattgactatgattagagtcagttagctgcaatttcatatttgcccaattgacactcgtcagttgccaccatgtctgaccttgcctgcttaccagatgacagtgaaaacgttgctatccatgtccacagagattctgcagtgatgtacttaggaaatcaatatgcagtggggcgattacacgtttctttaatcctttccatccaaatttgctgacacctctctgaagttcttcttacttaaccctgaattcttttcgaagcactatctgaactataacagtccatacaatcccgtccaaattcatcaaacatatatcgaccagctggagtgctggaccattacacttgtttggattaaaacaatttcttatctctttggatgattttagttagcccatacaatcccgtccaaattcatgaaacgtatatcaaaccagctggagggctggaccaatacacttgtttggattagaaaatttcttatctctttggatgattttaattcaatttttcctgctaatccagatggataaggcattatttctatccatccgtacgagattcctgtgtttaacttatcaagaactcttgctacttgctctgagtttttttttcagagagaggaagagaagacctgagttaattaatagcccgaggcagggtttggctgtgttgtttggggctgggaaccctttcccgacgcttaaaaaca

SEQ ID NO: 26155 - DNA, 2689 bp, Oryza sativa
gctggtggcgtgtagccttctgcagtacagcttgcaggtggtctccgtcatgttcgccggacatctcggcgagctctccctctccggcgcctccgtcgcctcctccttcgccaacgtcaccggcttcagcgtcctggtaacacttaaaccataattacatatactttaacttcgggttggtaaattcttttagtatgaatagttactcctttgttcggcaaaaaaatttgggaagtgaaaatcagtacaaagtacggcgcgtttgctttatggtaggacatcatatccaaaaattagttcaagttctacaaaaatacaatccatccaatgatctaaagaggccttgtatatgcttgtagttgtattgtgcttatggaattatggtgactggcatttctttataaaatgtatggaatctcgtttgtttttcttaaagaatatgtatggattctcctttgttctactatatgatgcctgatcttttacttgcaagaaaatttcaatgaaaactgcatatctgtttattccatgacaagctgggaatgggaagcgcgctggatacattctgtggacaatcatatggagcaaaacaatatgatatgcttgggacacatgcgcaaagggctatctttgttcttatgcttatgggtgtcccgctggcttttgttttggcattcgctggccaaattcttatcgctcttggtcaaaatcctgagatatcatctgaagctggactatatgccgtgtggttgattcctggtctttttgcatacggtttgcttcagtgccttaccaagtttctgcaaactcaaaacattgtccatccactggtagtttgttctggggccaccttggtaattcacattttgctgtgctgggttatggttcattgttttgaccttggcaacagaggtgcagctttgtcaatatcattatcttactggttcaatgtgatattgctagcaatatatgtaaaagtctccgaagttggcagaaggagttggcctggatggtcaagggaggcacttaagttaaaggatgttaatatgtatctaaggctagccattccatctacttttatgacttggtaagcagcctgacatggagcaaccctgttcaacaatagatactctctttttatgatttaacagataagttacatgaaataccttgttctttctgcatggaaataattatttgacttgtgacataactcagcttggagtattgggcatttgagatggtggttctccttgcaggctttctacctaatccgaaactggaaacttcgattttgtcaataaggtgagcaaacagaatgtctgcattcctttcagtatagtttctagcaaatgagtttagttccaaagttgttccaaaacataaataataggctgtacatttcaaattcatggtattacatgcatttgctttttaaattttctgtgataaccatgaaatacacagctagcaacttagcatgttcaatggattatgctttcagacacttgataatgtgaagtaatgaatggtttgtttccagcctgaatacaatgtggatggtttatacaattccaagtggcctcagcagtgcaataaggtcagcagagcagaaatttgggatgacttttcctttcattttatgagatttgacacctcaaagcttatctaattttggcccatggctcatgtctctttgcagtataagagtttccaacgaactaggtgctaggaatccgcaagcagcacgcctatcagtctttgtttcaggaatcatgtgcctaaccgaaggcatacttgtagctatcatcacagttttggtacgggatatctggggttacttgtacagcaatgaagaagaagttgtgaaatatgtcgcagcaatgatgccaattcttgctttatctgacttcatggatggaatacaatgcacactatcaggtttgggataaaacacacatccaaatatgacaattctgcatttatcacgtagtgcctacactccctgtttttaatcatacatgtaaccagaataccagattgcatatctttttacattgttgccaatcttgcagttggccgttttgccccattacagtgccacttctaataataataaagcccttgaattgtttatatgttgcatgtcacggcctgtttaagagctttactgacgtgccttggacaatccaattagactcagtaccactaccattccaacgcccaacgatttcactatgcaatttaccagccaccccagcattaagagagatagtatagaagtttaagtgtgtgattacgagaaattattctactgtagaaggatggtaatgtaagtattatgtaggagttttactatgcaagctaccagcaatgcttgtgttaaagaaggctgaccatataagtactgtgtagagaactgtgcctagctcggttggtatgggttgattgctttcacccagcagacccaggttcgaccccttgacctgctcatattccactggattaaatgaagggatggaaaaatatgtggcttctcctatcttaataccattggagtgctagtttttttttgttctgtttttttttttaaagaccaaagagtgtagttcatatgccattttctggggggtgatgtaatcttttgatattttagacttgttattgttcatgatatttctacataatt

SEQ ID NO: 26156 - DNA, 1586 bp, Oryza sativa
actaacttggtccttgatgcgtttacttttggtttctttataggctgaaaaggcccgggctagagttcagggttcagatggaagaatcacattggcctgaacatggatttcaccagttttgagtcatgattataccaccacaaaagcagttattgataccatagtactatatatagagtaattgatactgttgattatttgaaacttgtttgctgtacattcaataattgtaactgattgggcatgtgacttcttttcttttgtatagttgatatggtgtgctgtgaatgaaattctgcatagttcgccctgcaacacaggataaaggtaactcctaaccatcttttccaacacaattctatttccgtgtttgaaaagctttttcgaacatttttctacaattagtgcccaagtggaattattggagtagatgaaactaaaccatcagaaactgaaattgaagtcaccaaagcataactagggcagggtactgcaaatttatttttatttccccctccataccagatcagattgctattgttaatcttttgaagacaaagaggagtaatcattaaattactattatgagacactggcctacctaattcgatgttcttttcctgaggaaggtaccaagctagtctagcttcgatctgagagtcgacgagtaccatattacattcctacatgctttagttgttgctactcctctctcagttatagtagatgtataatgcgaaaaagaaacaaagttcaggaatttcctccttttaatgcaaagacatggaaagcttttgtgcattcctaaaaacaaggttcatgaagaaaatacagcataaaccacaccgttataatttgtcaacatccttgaaaattaaggcacgccctcttatgttaaaacaaacagttctggttttacaactcatggataataataacccacccgttcttccctatgtctcctggtagatggcacagcacaaaaaagtctgcagagattctggaacttcctctctggtcttcccattcaaaaattgttctttaaaacacatgcttttacgttagctggtgctgtagtggtgtttctataggcacaatggtacttagatcatcatcctgggtcttggtcttagtttatgatttatcactgttcttgcttattctctatcgcctctgtcttcatttttctttggagtactatatacatatatatatatatatatagctgctctaatatgatatttcgtggttaaaattcctggctccatcttgtttttcactcactttccgccactcagcatcctcagatgttatcatttatcatacatgtgtccctgtattgttggaccagaagtcttcggcacgtaaagctttagataaagcagcacctgacctgagtcagagcttctggacgcatatcataattgcttccctgcttggctagcttaatatacaaggccaattaagaatgcatttatcagaagaacgtgcacaaaccacccttattgatggcatccaaaagctacatttcctctgccaattaggtctgtgaggtcaaaggtctgatgaacctggcaaaagcagag

SEQ ID NO: 26157 - DNA, 749 bp, Oryza sativa
cccatgagcactttgcaccgatagaacacaatgatcaaacgcctgaggaaaatcctggaggaggacaacattgtagatactcgcaagcgtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaaacttaggcctgatggtacaatcgaaaagtacaaggcaagacttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacaggtatgtactagaaggtcaggagggaatggtgtgtaaactattgaaatccttgtatggcctcaagcaagcaccaaagcaatggcatgagaagtttgacaccacgcttacatctgcaggctttgttgtgaacgaagctgacaaatgtctatactatcgctatggtgggggaaaaagggtgatcttgggcttatatgtcga

SEQ ID NO: 26158 - DNA, 3679 bp, Oryza sativa
  unsure (1)..(3679): unsure at all n locations
ttgcagtaattttcccggcggacacaactgctcgtgtccagaaggagagcacaagagcaacaagagtggagtactcatctgcgagccggacctgaaacgatctttgccggacctgaaatttaaacgatcttaccggctcccggtctcagcgatcatagctatcggtacgtaacaaaaatgcaattgagcaaatttttttttcagagaagggtatattttttacccagcctctatattcaaccgaatatatgcagtcatttaaattaggaatttagcctatcgaatataaaacttagcccttaaataaaaatttgctcccatagagatttgactcagaatcttagggtgctactcatgtcactgtaaccattaggctacatgcactntcacaaatgcaattgagcttgccctgtcatcatctactctaatatatgcacgcacagctagcacgcatggactntaataagttcgataatttttatatgcttaattcaatatagaatatattgtggtcaaatttgtattttgaaaagcgcaaaaaaaagtcaacatgatgtatatacatataaagtatttcaagcgtaacttagagcaagtttaataatatagccaaccactaactttaaatcatctatagtcaatttaatagcccactcatacacatagttaccaataaatatatatcgcattagtaatatgtgggcccacctatcataaacatattgtgtcttgtagtttgtgatacagctgactataaatctgtaacccgctactcttctcttcttatttcttttctcgatatatacttgctcttagactatcatatttttccctcgtaaacaggcgtcaccgggggcatcgctatcatcgtgatgagcttctgagctcatacctagtacaccagcgaagagcgcttgccgacatcaagcgcagctacttcaagcgacatggcggcctgcttctgtacgaggagctgaacgcgaggaagagcaacgcgttcaccatatacaccgaggagcagctcgagcaggcgaccaacggcttcgacgagagcaacgtcctcggccgcggcggccacggcaccgtgtacaagggctgggtggctgcagcctccgacgacctcgttgtcgccatcaagcggtgcaagctaatggacgagaggaacaagaaggaattcgggaaggagatgctgatcctctcccaggtcaaccacaagaacatcgtcaagctactcggctgctgcctcgaggtcgacgtccccatgttggtctacgagtacgtccccaatggcaccttgtaccagctcatccatggcggatctgccggcgccatctccttcgcttcccgtctccggatcgcccacgagtcggcggagtcactcgcgtacctgcactccttcgcgtcgccgccgatcctccatggcgatgtcaagtcctccaacatcctcctcgacgagagcatcatggccaaggtgtccgacttcggcgcctccatcttggctcccactgacgaagcccaaatgatgaccatggtgcaggtgagaaatgcccagaggttttccggctagctccacaaggtagtgggttagacgacctgagtttaaagcctcaccctttctaattactccctccgttcaaaatatttgacaccgttgactttttagcatatgtttgaccgttcgtcttattcaaaaaattttgtgaaatatgtaaaacccattgtgtacatgaaagtatatttaacaataaatcaaatgatatgaaaagaataaataattacttaatttttttaatattaggtcatttcctaatatcgtgtctttttttaccatggtgcaggggacgtgcggttacctcgacccagaatacatgcagacatgccagctcacggagaagagcgacgtgtacagcttcggcgttgtcctgctcgagctgctcaccggcaagaagccgctctgcctcgacgggccggatgaggggcggagcttgtcggcgaggttcttggccgccatgagggagaacagagccgatttgatactggatgagcaggtgaagagcgaggcgagcggtgagttgctggaggagatcacgctgctggctctggagtgcctgcagatgtgcggcggcgacaggccggcgatgaaggaggtcgccgagaggctgggcggactgcggaagctgcaccagcatccatggacgcaggacgtcgtcgagctcgacgaggtgcggtgtttgctcagcgactcgccggaaagtatcagttttgaagtggacgccaccagtagtagcggatactgaaatttgaattagagaatagtgttgcgtcagtttgaaatttgagtcatgtctcttcttctctcggtttgataaaatgtactacctccggtcccataataattgtatttctagaatttgaatttgccccaaaataattatcacaatagagtactaatagtctcattaatcacttctcatttaaatttctttctattttaccctcgattacctttccactcttatatagtatacactacttcctccgtttcacaatgtattctatctagatttattaacatcaatataaatgtgagaaatgctagaatgacttacattatgaaacggaaggagtatttaataagggacacattatagtctttcttcttaaaccttaatatttgctaaacaaactagaattacaagttatacgagaggaaggtagtatgacttgtagacttgtagtcactatggtaacgctgtagccaaattaatttcctgctcaatacgaacagagcgaagatattagggtctcatcttttcgcttatatttatacttatcagctaaaatttgaatttttaactttaaatttgaagctgattttaaggtttttttcatcgaagtttatttttcagcctttacttttgcttttagatcactaagaatacgcatataaaaattttattcacatatttcttttcgtttgtaaataagatgttttgcttattccgcgaataagcgaaacgattccatttattacaacaatcctgctattttttcctctctaattacttaactgcagttctcaaaaaataatatttactcaaatgctgtacagtttagactaataactttgttgatggtctaataaaatgcctttctttgtaccgagctggcctagtacctatgccgatgctcagatgccttgtttgagaggcccgtaatcaattcccataacccacatacataaggaataagtctattttggctccctcatttcttgcccttggtcgaattgcatccctcaactgcaaaatcggatataacacctcccacatctccgaaaaccgttgcaaatagactcctcaagtggtttggaaggtggttttgagctgacgtgggtagttgactagttgaattagcaagtaggacccgcatgtcatcctaatcttatctttcttcctcacctctcccccctcaccccctcaccaggagccgccggcgacagcccgtcccacggtaacagcagattggccacctgcaacgtcggcatcgcgtgcgcatgcgcgcccgcttccacgcgccgcctctgctgtccttccccattcctctttcatatcttcctctctctcccctcgcaactagcaacggaagcggcggtcatggcgtgttgtcgtcttcatcg

SEQ ID NO: 26159 - DNA, 2131 bp, Oryza sativa
atccgactagttttaggggataacttatttttatgggatatgtaacagatcatgacttgggtattacatttccttgtatattacagaatggcgtaaagtcctagtttggtaatattgtaaagtagatttaggaaattgataccgtgttggttaaaatttttatcttgtaatcctgcctctcatcctatataaggtgggcaggaggccctctagggggcatgagacaatctgattgtcagatcaataaacacccggtggattcaaatccccaaacaggagtagggtattacctctcattgagagggtctgaacctgtctagatccctgtctctgcatccatccacttttagctctcgtgcgctacccccttttcatattgccgaaaatttgtttcgacagttggcgcgccagggaggggtgcgtcgagtttcccgtcggtaaagtgcgttggaatcaatcaccaacatgaccggatcgtacacgcgcgtcattcaccgccgcaagaagcacggagggcgcgtctcatcagagcgttgagcgcctgccagatcgagagatcgcgccgatcggtcgtgtgctgtttggacttccggatcggcgagcagctacgcgtgaccggcagcaaccagccgccggggcatgatctccgtcgacgtcgcttggtctaattcaatccggccgaccacctcgatcgatctacatccatgcggctgtatagtccacgcgtcagatcgatccgcatgtgcatcacatgacgagggtcaagcagggagcaagactatggcatatgcatctaatcttcttcctgctaattagattgattattaaatcagattgattgatggtctttttcctctttgctctttcttctggtgtatgcatgttgccggcgaccaaggtgttcaattaggcacggtatgattaagccgtcgctacgcaaggcgaagccgtccactctctgagcgaatccaactcgtgggctggacaggcatgcacgaaagttcacatgacgagatcgctggagatgtacaggatgtgtcgattcaaccgccatgcatggattaattaatccagccatacatgcattcaatcgctgagatttatacatttaatttgctgatattaatcagatttattttatttgtttccatgtgaatctcggagcatcaccgatggacgtcctgcgggctatggccaccacgggccacacatgggaacagccagcctatggctaatcaggagagaacacgtgcagaaagttgatcttaccgatcaacaagcaccattaatttacttaatcatgcctatatatttttatcattaaccaagttggtttgttgtcttgttctgtaagcacgccgagccatggatcgcttgattagtcctagcgacagagtgcaacaccagcaaccaattttctccgtctcggagtcagtccggtcgagaaaatcaatctcggcgagttcaacaatttaaatctccgactccgccgggttttttcccttccaacttattgttgtttattagattgatctctaaatatcagattaatctcttggtatttcctgttgtttacatgtaatgctgtggcactgctgttgccgattggtgtttccgcctgcacggctggcctattataccgtcgttgttgggcatctacgacttcactgtcggcctgcctccgtcgccgccgactggtgtcctcgcctatacggctggcctattatgccgccgttggtgggcatcttcgctttcaccatcgaccgccttctttcgccgccgactggtgttttcattgccattaataggcgactttgttcccacatcagccacctctgccgtcattaagagagatattacaaagctaagtcatcatttttccttatatgatatttttcttttcctctgcctcactacatcaactggttcgtcgttgactagtgagtcaggggctacagatgttatatcatattttttaaataactttcataatatttatcttgattgctcgtgacataatctgagtacaaaagtgcctatcgagttatggatttccatcttcctatgctttccgtttggtttgccaatggatagttgcctttgggccgattcctagcacccgagggcttgt

SEQ ID NO: 26160 - DNA, 2817 bp, Oryza sativa
gcctgcacggctggcctattatgccgtcgttgttgggcgtctacgtcttcaccgaccggccgcctcgtctgccgtcggctggtgtctccgcctgcacggctggcctattatgctgccgttgttgggcgtctacgtcttcaccgaccggccatctgccgccgactggtgtctccgcctgcacggctggcctattatgccgccgttgttgggtgtctacgtcttcaccgaccggccgcctcgtctgccgccgactggtgtctccgcctgcacggctggcctattatgccgccgttgttggacgtctatatcttcaccgaccggccgcctcgtatgacgccaactggtgttatcatcttcacggctggcctcgtcgccgtcaccgctaatcggcgtcatcatcttcaatgcaagctgtctacgtctgctgccgactggtttcttcacttccatggctgcatgattctgccaatgttgattggccttatcgtcttcactgccggtcgtctcttctgctgttgactagtgccgtcgcctctactgctggtttatattgctaccactactgatggacgttattgttttcattgttggccgacttgtctgacgccgactggcttgttcacctccacggctgcgcgtcttcatcatcattgactggcgtcatcgtcatcgccggtttgccttcggcgctgcccatgatgtcttcacgttcatggctggcctattttgcgctgttaaaaaacgtcttcgttttcatcatcattctacttcttccgttgccgactggttatgccgccgccaactggtgtttttatcttcatgactgcgcatcttcgccaccggtttgcttctgttgccgccaactcctgttcacgtcatcacggctatgcaactttgtcgccatggtggagcgacttcatatttattatctttggcactagcaaacactattgcctctacttcgcaagttttgctacttcaccagccacgacgtctacaagagcttgggcatctcggtatgcgtcaccaaatatgatgccgtgtcattttactactacaagtggttctacaattttcaagattcctactcggacatcctcaacacatatctttactcaagcaatgactactcgatgacaagaagctacagttctcgactctatgttcaattgctttccaactaaccaaagagtcaggggatacacaaatacaagactcaaaattcgacaagttttatgtcaagatgaagcaatcaatcaatcgacaagtcaactctgggagttattattttcgtcttcgcttcagagccgacattttatttcagcgactccaattattacactgattcaatgagttggacaacagcatctactttcctccaagtgaagcatctacaacatctataacactaagttctgcagtcatcttcgtaaatcaagaagcgttgcatcagccttctttatgcacacgctcgcatcaaggaaactactcgagctttgatatcttgtcaacagtttgatggattattgtcactaacatcatcaccagcacctctgcttcatcggccctgacatctccgttgttgctaatggatgattatgtcttcgccgacttattatttcacattcacggttgacctactacgcaaacactgatgagcgtcttcatcattattaccgactattttcttcatcttcatgattggtggatttcgccatcaccgttgatgcgtgtctacgtcttcgtcgtcgacttgctttcgttgccaccgactgctctatcggtgttgttgggcgtcttcatcttcactgctagctgatttgattgctgccgactggtttcttcgtctccacggctatgcgacttcatcacctttaattggcgtcactgtttttaccaccaccaacatcttcgtcagctttgatggatgatattatcttcatgttggtcatttcgtctccatgccgactacgtcagctaccatcaatggacaattgtgactataacagaaggataagctacatgcttaggggctcatcgacacaagcgcgagggttatatcttcaatttggacttgttccggatacatgcaacatgaatttgatgatcatgggtctattttctacgctcaaagactggactatttattattccctgtaagggttatcaaccgaatacttgcgccagtcagaattcaattattatatctattttggagtatcccataaaggataatcattcagatcagaagctattcatatgagctgcacttggtctatataacccgaaagatttattactcgggaatatgttacatgcgtcatcctttaaagggtgtcgaaggcatattttttggcctaggcctaatatgtctgcagcccatattttcaggtgtagcctgtcacgttttttagggacttaggcatctttttgcttaggcaaaagtgcgcgtgattatgtgcccaataccttaaaatccttttataccgcagttattcaactttttaggagttggtacaatgcaatttaaaaggtgccaaacagtaatgctttatatggctccccgctgacttttttatataagtcaaggcgctgtttgggttcataaagcaattgattggatacaatatcattgcgttttgccacgtaagtgtgcacttttattgaccaatattatggtttaggctgattatatattttggtcattttccaggcggttggtaaatcctttatgagtttatttactcggactttataccacatatgccatatatttccaggtgtggtggaaccatgtgtcttctagggacttaagca

SEQ ID NO: 26161 - DNA, 469 bp, Oryza sativa
atcctcctatgtcaccaagtctgcagccaagccaccatcctccttttcccttagctgagctcctcacatttcctgcgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggtggcggcgatggacggcggcggcggcggcagcaagctagggttagggctctgataccataaagttcagttttggggattttttctggtgtgttgttcacagccacacacacacactatttcacttagctacatatgcaagaaggtccccaatacaagtgcatattacatcaacagatagcgtagatggacaagtttcgagaagttacgcaacatattctccatatcataagatgcattaaacatcaaga

SEQ ID NO: 26162 - DNA, 2263 bp, Oryza sativa
tgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataggcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttggccatcgcgaggctcactcttgctgcgccaatggaccaagacgacctcgtcgactggtggtccagtgctcgatgatcagtggacaaatgcaccttgcctagcctcgactctctcatgctactttgtgtcctggtgcctgtggaaggagaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcactgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgcggtatccccttctggccagtct

SEQ ID NO: 26163 - DNA, 2683 bp, Oryza sativa
tatatggctatattactagtgaaataacaaagtacatatgtttaaaatggaaaatttaccagacagggtggtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagcaacttacatgaaaaaaagaaagttaatgcaggagcaaactatccagctaaggatgccatagtacttctgaaactgttgagattagttaaatcactcctgctgacaaacaagtggaagttgttcgctgtcagaggctgagggaaataatgaagatcgtatttcatatgattcaaaaagaatgtctgtttctactgtgaagttttaactgaatgtctgaatacattgcaccaccttgatgaactaaagaagaagaaaaactagcatggcatgctgataagttttaacccgtttctcgaactaggcttacacagtgttattagttccagttcatcagacagctattttgtgcatcgaatctcatggtgtcaaattcaatgatcaaactaactagtaaaattgcagtgaaaggcaacagttttctcaaagctaataattctattaaaacctggaaccggttaaagatctgatgaacttgtatggtatcatcaaccagctttgtgtatgtttttcaaaacaacaacaacaacaacatcttttgtgtacagacgaaggaagaagcacaatccaacactaccacacctatcaacataaaaaaaaggttgtgcatggatgcaaagaaaagaagagattctgagagggataaaataggagtaccttggattagtactctctatctttgatgatcggaattgttcctcttagcttgcggcactgccttttgagctcctcgttctcacaacgacagacatctagttcttgcaatgaactcggaaggccacccttgggcagtgaacagatggctggacaccagtcgatctctaatatcttgaggccgacgagtctgtgtaacccagtggggagggactgcagcttccggcaggagtaaaactcgaggtcctggagggaggagaggagcagaagggcctcactctgctccttggtgatgcgctccacctcatgattaaaaccaatggttagcttggtgagtgatgaaaaaatgaagctgcaaattgtggtgcaaggacccttgcaatgtcatccgtttgaagctgctgcagccgccaagggtcagacctgacgaaaaatttgggggtcatttggatgcgaaagtctgtgaattggccatggtcgagcagagaaaacaagccctcaccacttaagtccatacatttccatatggttaatctggtgagagagctgaggtttgagaggggagcaagagtctccatgcctctcacatcactcagatacatcttttgaagggaggatggaaacgggaaacaagacaaggaggtcgagtagtaggaggagaggaaagtggggcaaccccaaatagagaatgctcgtagggagtgcaggccttgtaatcctcctcctatgcctcttaagcctccttccatgccatctacaagagaatggatctgcaggatcagctctgggatttcgctgatgttcaactcctgaagttggtgaggcaagagcaatagtcctgcttcagctgacactttctcatcctctcctcttggttgttgctgctccagtccgaaacgagcatcctccaacttattaccacaaggtgatgatgacgatgccaacattgttgtcatctgcttccccagcacaccaagccctcttatcttattacatctccttgaaataaacatggagagtttggggaaatgagatagaaacaacgtcaattccttcccgctacaaccacactcaaagatctccaatttctcgattggaaactggtagctgacagtgttctcagattcaagatgtgacatgacattgcttgagtcagatatagtgagtctcctcaaacatgatagcattaggaggtattccagcggcaaaggagggcatttcttcaaatccaactctttcagatcagttagattaccaaaaaccaatctcctccagaatgcaccatctagatgttcatcctttcccttgactagcatgcataattcatattgcttattttttgagtaatccaactgctgaaaatccaatccaactccttcaatcagcgcacggcatggagagcctctccaaggaatgggagggaatgatgacagctttggacaattaacaatctcaagctcctttagtgtacggagttgggtcaagttcatctcttgctccgatcgagggcatgtggaatgtgaaaatggcaactccgtgagttctggacaatctcttatgatgagcacctttagcagagagaacacaaagcaagaatcatttccaacccattttgctagtctctgtatgccaacaagctctaacctttttaaattcggaaagctcctctctgttgtacaaaccagggattcttcaccatgctcattaatcaacaacaacttccctagaggaggaaatttgttccagtctacaccatcaagacgaagagtttgcaagcctttgatggacaagttaacacccaaccatgaagggcaag

SEQ ID NO: 26164 - DNA, 3613 bp, Oryza sativa
acaagtgtgatttagattggtataaatttgagtacttcaagtgctgaaaatctgatctcacttcttcaatcagagcacggcatggagagtttgtccaaggaacgggaggcaatgatgatagcgttgggcattttacaatctcaagctcctttagtgtagggaattgagtgctgtccatctttgaatatggcaactctataagttctgggcaatctcttactatgaacacttctagctgagagaacacacgggaagcatcatttccggtccatttttctagtcgcggtatgccaactagctctaacctttttaaattccaaaagctttggccttctatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcttgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacattttttttgaaaaatccataatcaaccaaatcattcaaataactcaacccaatatcttcagttgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcaccattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaaggtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcagagaggtaccttctcttgatgtttctggcagtgtggtgagcgttgagcacaaggccaaggagacagccgctggcatgctcatcggcggcctcgtaggtgccatcgagctcgtcctggatgcggaagtagtcgagctcgtcgagcacgtcgtcggcatcataggcgaggccacggagctccaggagcagctgctgcagcgcggggttgctggtttctctgccacgggtgttgtgcagcatcccctgcgcgtagagcagctccatcttgatggcgccgacgtttggcccgagctccgtgctggccgcccacgcctccacgaaccctcccgacagcgggctcagcgccttgccaaccacccaccgcgccgcgttcacggccgccgactccattgatctgtctggtctctactccgctagctaagctgaggagagtgggagggatggaagagctgtggactgcgagagaacaaagcagtccaggagtagtagagaagggaatggtgaatagcgagcagacagtgaagtgaaggactaccaaaccacggcagaagtattgtttgttttctgaaccctctgttcgaactttaccaaatggtgttctcaaaaatggatttaaaaaaaccaaagtcgtcctgctcttcttgaatctgatgccattccgtgccatttggaagataagaaaaaaactaaacgtctaatcagcccccaaaaccataattagaacgcaatagtaaaggacaggcggtacagccaatggatttacttaaatctgttgcgattgcaaaggtgcataatgccagattcgccactgttcattcagtaaactaccgggatagagcaatttgcctgcatgtgggatgtggc

SEQ ID NO: 26165 - DNA, 1204 bp, Oryza sativa
aatttaatggtgcaatcggatcatgatttggataagtaatttaagagaaaaaacagtttaaagtaattttgcacgtaaattggacgctgacgtcatgctgacattagcgcccgatttcaccccctcccgattgggcgcctgaccaggagtcgtcccatttcaggtcccttaacttacaccgaatcctattttcatcccggaaccgaaaaaccagatacaacaagtctctcaacttataaaaccggtacaaacaagatccctcaataatattatccctaattttaactcacatacacctacgtggctaatttgactaggtcttcgtcctacgtggcattgattgacatggcgcttacgtggtagtttaattcgggaaaaaaaatgaaaggagcaaaattgaaaactaaataattaaaacaaaatatggggtccccatgtcagtcaaataagataaaaatagtgggactcacatgtcgatgggtcccacttcctccacctcactctatctcctcaatctcttcaccgaggcagtgccgctatcgacgacaacacaccgaaaaggcagaggagatgcgaggggatagggtgggagccctgcccatggcgagaacgcagtcgaggtcatctccgtcgcccccaccgacgcctagctccttgtctcctctagcgacagggcgggaatggagcggcgtgctattaacaccaaaatttggtaagcccgaagtcatcatcggcatagagtcactatcggcttcagagtcttggaatcggccgatgggagttgtcaagtcgccagcaattgtgttctatatgaagtcggatcaattaaagaaaatttatccaaaagagtccgagttcaaggaggatgcggcatgacaagtatatctattaattaagaatagtatgttagttttcttttatctctagaaaagtgtgtttatgtttttcgatacctaatttataagcaatccccgttcatcatctaaaaatccaatcatattcaaaaccactttgccaataatctttaaatttaaaaactaataatctcactagtgaagtgaagtggagcggagagtaaacatactattgagtgagctgatatcgtcatatcatgcgcctgaaaaggtaaagaaaaactattgcaaagttaagaacctcttcctgatcaacaagtaatagctatttgctctcagaggctgagggc

SEQ ID NO: 26166 - DNA, 2300 bp, Oryza sativa
  unsure (1)..(2300): unsure at all n locations
catattgttcatctagaaatatttttttagaaaggtggaacaaaatgggttaatcttatccaaaaagaaaatggaaatatgccaggagaaaatcagtttccttggtcatgaaataggagaaggcaaaatacacctacaagaacatattgctaagaaatttttacaatttcctgatgctatgaatgataaaaaggaattacaacaattcttaggaattgtaaattatgctagaaaccacattcaaaatttagcaaagttagcaggaccattatatgctatattaagaaaaaatggtcagagatattntaattctaaagacattannatagtaaggttaataaaagaaaaggtgaaagaactaaaacctctagaattacctttagaagaaaactattntattattgaaacagatgcatcgcagcagggttggttcctgtattaaaacaaagacctgctaaatactcatctaaatcagaggaaaagatatataggtatgcctctggaagaccatacagatcgagaaacctagaaatatcaacgcgataatgcttttaggttatatctagggtttaaagagtttacggttagaacggactgtgaggtgatacgtagatattataatcagcttaatagcaagaagaattctactaggaggtggatcttatttgaacaaatcattactggaaatgactataaagttgtatttgagcatattaaggggaaagataacaatttgcctgatctactttctcgtttacctattttgcaggtatgaagaaatctatgaattataatggagttgaattcttcacttttggggaagataataaactcagaatattcccaccaaactcttataaatttaaaccaaaggaccatataatcatatatgaagtgcaagaatgtattctggacaatttttggtatcaatataataatatgaagggctatatcctatcaatattaaatagtcttgctgaatattttcatttgataaatgaattaatgccagttgcaaaaaatattgaagccatacagcaaaagcccatttatgtggtttttgaaggaagagtaccaggcgtctatatatcctttgaagagataatatctcaaaaaatagacgcaaagctaacagtaggaatatcatggaagaaatataaagacattgaagaaccattaggacaagctaggaaaatattgggaataaattattatctagagccagcggcaaaggaatatattcaaaagtgcaagaggctagaaacaagaaaaatccagagcccccacattatacaaatataaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttattnnnnnnnnnnnnnnnnnnnnnnnnnnnnnnnnnnnnnnnnnnnnnnnnnnnnnnnnnnnnnnnnnnnnnnnn

SEQ ID NO: 26167 - DNA, 1941 bp, Oryza sativa
cctttccttttcttttaattataatgagttaggacttgtcgcaagatatgcatttttctctcaactataggtcattattgcccatgtctgttgttctgttaagataacatcataacacttcgtacggtatgaccttatgatacctgatatctcacttaatatgtaaagcacacgtccatttctgcaattgtaagctaattatatagaattacggcgatgctaaatttttccggtgcaaagaaagtagcatttgtcagaataaggtacttgagtccggagtatgcccctctcattttcaacagctgaagcggagaccagttcttttgataaaaacaatggttttgttgcaacgatatgcattgcaatagatttcccaactctcttaagagcatcaaggggagcattgctgtcttctgcctctagtgtgatcaagccagcaagacgacccaacccttatttcagaaaaaaaaaaactcattcattcagtgaatgagaaattgcaccatttaccatatatcaaatagaacttcataattctgacgaacataaaatatggattgctggtaggaatcaaattaataacgcgagcaagcttagccagctcagtgtaagaggcaagtatcactaaaatcatattactaccaatggttttacaaaagtaaactatgagcttgcatcctactaaataaattttttaaaaagctaaaattcatcactggacaatctaagagaatagattaactacaatttagattaaggaacataatgtccagaaagtccaacaaatttggatttctgaaaaatgaacccaaaagcaccacaactcattcactattgccaaatactagtaaggtgcccattgcaacagcttggtggagggcctcgtctgcacaagtaataggatcacttctagctatgttaattaggagcaaggccaactctgcccccaactgatttgtcgtcagtgagcccccctgatccgagtgttaaaccaaataattcatccaactattgtaatcataaattatgcatgcaaaataattgtacatgccaatcaaggaccagccagcaaagtaccgattggatggaaaagcagagtttcctttgtcctcccctcccacccattctgtgcagtgagacccatccttcccggtagaaaatctagtataaaaaatcaaaatagcagacccagccccaatgcaacactgaggtgttaaccatgcaaccgccatcgccatcttggctgtcgtgtctagggatgtaatgctgaggatcgaatactaacacacacacacacacacagagaggattgcccatttggtctttttctgaaccagttttctaatggaagagttgggtctcgcgctgtgcacgatcggtgggagacaatagtccactttttagagtagtagagatgcaatgtaattaaataaatgtagatctaatgctgttataaatccaaaatcattatctctattccactgatcttattcataggaaatgaagaaaatgtagtaataattagatcagcaagcagtaacttactaccaaaacagaagacaccacccaggcaccagaggtagaagtaccaattcccatctccccttgagcacagcacttgtgccttcaaatccaacataagaatttgattaaatgacaggaccaaaatctcatatagagatgaaatagtcagggaatttaccatatttatgttgaaacaagccacaatgtcctcctacaaatttgaagttacataaaaaaaattgagatgcaaatcaatacaaaaagaacattgaatagttgacaggaaatacactcaaattgacaagaaagattggttctatcgacaggcaaaatatcacacaagctactacttcagtaaataaagctgattgatacttgagcgttgttgatgcttttacacaaaaaaaagagtattgt

SEQ ID NO: 26168 - DNA, 14612 bp, Oryza sativa
tacatgtacctgttgaaaagatgcgccatattcttgttctcttactgatgaacaaaagtgaagtgatgagtggatataagtggaaatttacaaaacatcaggtatattcaaacattcctctcaactggtttcccttgaatagaaatacatttaggcccatgggcagtggtcacacaaaataaaacaatgccagggtaaagttctgctggatgtcatatcctgtggagcacagacaagttaaagggcagacaatgatgaaagtggacctgaagaaccatcgttgatatccgttgggcacccaacaggtgtatctcattgtcaggacacaagttgaaaacttcaggtataaatgataattatgtgagaaaattttaactaaaaagaaatggactgataacagaatgaagataaactgataaagatgtcgttgcaagaactctactaataaatgaaatggcgttacagcaaaacaattacaggcataccacaccttgcagatccttctaatttttggtccgtgctatccccaccactggaaacctcttcaggtttaatggttatctgccagttagtctgtcaaacattctcaaagaacaagtctgtagcaagcgtgatattatgtgcaaaaccactggtcaaaaggcataaacagcacttaagctgttagtcttagatcggtctaaaaatatttgccatttaggttctcactcaaagttgcagtcagtaaaagacactctggcaaatgaaatctgtgtagaagccttaacaagtagattactagattaaccagtctcacacaacagagtatggtcagaagtatcaggaacataacccaaatttttaattagactcgtcagctcatccagtactgaatatatcagttctgcctctgggtgttctctccctctcacaatgaacgtgtgaacttcctttgtcacttcaatccagctacatcctgtttccttcactgtgccagaactatccatctgctgtcttaagttgtgcacatcagcccagagtcctttagaggcataaatatttgacagtaaaacataagggccactgtctgttggatctgccaagagtgccatttcagcggcatacctcccaatttcagcgttgccaaaaagatggcaagcgctcagcaaacttctccaaacagctgcagctggtttgattggcatcctttcaataaactccttggcagcatgcagtttcccagaacgaccaaaaagattgactacagaagcgtaatgctcaatgcctggttcaatatcataatttgatttcatagagttaaaatggtttaatccttcacccacaaaacctgcatgcgcacatgctgataacacaccgacaaaggtcacatagttaggttctacctcagcttctcccatcagccggaaaacctgaagagcttcttcagcatgaccgtgctgtgcataagtcgtaatcattgagttccaacaaatgacatcctccccacatgttgattcaaacagcatcctcccttccttaatgaagccacacttagcatacatgtcaataagagcatttgaaacatgcggatcattgtcaacacctgctttgatgatccaagcatgaaactgctggccgtggaacatgcttgctagtgtacttgccacagttactagtgcgacaaacgtgaactcattaggtgccatacccgataaaagaagctggttgaagagttttatggcctcttccccttgctcattctgtgcatggccaaaaatcattgaattccagatgaccatgtccttgtagtgcaacatattgaatacagtcttggcatcattcacaagggaacactttgagtacacatcaattagagcactcgcagcataaaggtccaatgaagttcctgattttataataaggccatgaatctgcttgctcaattcaatggctaactgagatgatgacaccccaaggagtgaaacaaaggtcaatagacttggtcttagtgagaaaaatctcattctttggaatatgttcactgcttctgcaagatcacgattttttgagtatccttcaatcatagcattgtatgaaattgcatcatcttcagccaaggcatcaaatactgctcttgcttcagttagatgctcacatttagcatacatgtcgatgagagcattcttgacatactcatcagcctccagatcagcctttatgacatgcgcatgtatctgccttccttgccatattgctgccaaagagccacatgagttcaagatacttgtacaagcaaaaccatctggctgccagccagcctgagtcatattccagaacatggttatcgcttcagcattgaatgagttctgcatataaccagaaatcatggttgtccaagacacaagattacggtactccatgcaatcaaacagtttccgagctgctgacagtctggagcacttgcaatatagatcaatcaacacattgatcactgatgtatctgtctctgtggcactacgatacgcgtaaccatgtatttgcctaccaccctctagaaagccaagtgcagagcaagcactgacagcacttgctagtacaaacctatcaggacggacaccctcaatccccatcctgtcaaacaactctagggctactcccccacacccaatctgagcgtatcctgtgataactgtgttccaagtaactggggttcttacagggagtgcatgaaacaccaacattgcctcatccatgcagccaagctttgcatataagttgataagcgcagtcccaacataaacattagcatccaggtccaacttgacggcaatcccatgcacttgctcgccaagcgaaacagccttagattgtgtacacgcacgtaggacactggcaagcaagaactcattgggcacctcacaagaggccttctggaaggccacgaagagggaaattgcacaatcgtcgcggccgtgctgtgtgtacatggagatgaccgagccccaggagacaaggttccggtggggcattcgatcgaacaggtggcgggcgtcacggaggcggccaagattggagtagccacgcaggagcaggttggtgaggaagaggtcgtcgagtcttcctgcgacggtggcacgggcatggatggccgggttcaaacgccggaggcggtcgccgccggtggggaggcatgagagtaggacacgagctaagctgcggatgtgggtggaaggcgcgcggcttagaggattcaagagtggcatgctccaccatctcctgttacactggagaggattgtgtgcctaggtaccggagctcaccggcggaggaagcagcaggtcgccggggaccctgctcgcgcggggacgggatggaggtcgccggcggcgcaggcgcaggcggcgggcgaagtggcgaggcgaggaggccagggaaaggtgggtcgcactccccaactgggccagaaaggacgatcgagcccatgtgcgttcagcccgcaaagcgttgaagttcgacccaaaattaacccacgtactactgtttccacttattcggcccacaaacgcgaatgcagaacatttatgcctgggaaaaagtacaccagaggtccctcatcttgtcaccgagttacaaaatcatccttgaactgcaaaaccggatacaacgcatcccctaacttataaaaacagtgcaaattaggtccctcagcagtattgttcctagttttggctgacgtggcgtctatgtggcttctttgactaggtgtttttgttacatgtggcaatgacgtggggcttacgtggcagtccgattaaaaaataaattaaaaacagtggggcccacatgtcatactcgttttcttctccctcttctcccccttcctctcttcacatttcttctctctcctgctacacggcgttgggcggagcaggccagctcctcggcctgcccgtccccctcgtcagccccgcctcctccctctccgtctctcgccgccggcctccccgccgccctcgacagtcgcacgtggccgagcagcacggccgggacccacgtctcctccccaatctctcggtcttcttcttttcttacccaatccagcgacatggcggtgtgatccattcggcgcccgtggccgccgccgccgaaggtactcaccaagcaccaccgccccagtgatgttgcagcgtagcctcctcgttgtcaatcggcgcggcctcctcgccgatgtccatctccagcgtctgctccggcattgcccgtgttagcgttctttaatcatgtgcagccgaagattatattttcgtttttgcatgttgcatgagcgcgtttgcatgttgcagcgtgagcgtcgtgtgttttggccaggagcacgtctcatggagtattggcacacatgacggaggccactatggcactcccagtttttcagttgattttagtttgcatgtaatttgctttatagaagtgaagtaaaccccaaaaaaacgctgcaacgttctacgcggcaccaaaaattcctgcatcaaacagctggtgttttcactgttcatcatcttccacctccgatcaagtgtgagtttgagtgatttgaagggttgccactggcagcccgcacagcttgagtggcccacctgccgttcctccataaccggcgaggcaacccgcatgagttgagtgagaccacggtgagggagcggatggagaggaggttcttgggaaggaacccgttgcggtgcaggcagacggcaagctcggaaaggccgcggtcggcggtggcgtcgaggagtcgggagaaggcggaggaggacacccgcggtgctggaatgcgaaggcgaggcggcggatgaaggacggcctcgccgggagcgacgggagcaggtcggggaaggtcgccagagtcaatgcggccgaactgggacgggtcacgagaggacgcggaagtggcgggagagggcagagagcgtgacggcctagcgggatggagagggatgcgctctcgtgggacatcaccgctgagcacatgcaggaagaggtggtccaccgtgccgccgtcgccgccgcaggggtcgacggcagcggcaaagatcaacggctcctgcaacggcgtttctcttggaatcatcggctgctccaccaccatctctctcgcctcgcgtcccgcttcgctgcgccgctccccaccctcgttgttgtgtcgacggctgctccctctccgcctcatggacatggacagcttccccgactcgccggcctcgtccactaacccccaactcccaagccgcgcgagaagaaaaagcgcccctctgcctaggagccagaggaggagcggcgtgaagaccggcggcgtgagcgggtgccccactgcccccgccagccgttccgcaagtcccgcgctccctcctggacgccgcatgcaactgacatgtgggccccagtttttttaatttatttttggatcagattgccacataagcgccacgtcattgccacatggaactaagacctagtgaaaggagcaacgtaggcgccacgtcagccaaaaccggagacaataccgccgagggacctagtttgcactggttttgtgagttgggggatgcgttgtatccggttttgtggttcagggacgattttgtaattcggtgacaaaatgagggacctctgatgtactttttccttatgcctgcattttgggttgtttggtgaagtggagcggaacaagtgtgtttcgtcaccctcgactctagcccgatatcgattcacatctttcagggccccgttgaatcacagaaatgaaaaaatggaggaataggaaaaacataggattctgacaggaatgcaagtgtaaaacagaggattgcaaaacacaggaaaaacataggaatgactatttgattgggccgcaagaaaaacacaggaatttgaggagagataaagactcaaaggattctttccatgagattctacctcatgttaaatttcctccaaaacttgcatgggaaaagacaatccataggaatttcataggattctataggatccattcctttgattcaaagggctatataggaaaaaatcttataggaatgaaatcctctaaaattcctatgaatttcctttgaataaaaggggccctcaaccgtaatatcggatgtaaagcatcccccggttatcgaaggaaacgctaaaggagaaaaactaggaaacgggatactgtctaaacaatgggataagttatgagtgaaccgttctttttcatgtttagatatgttctgagagcatgcgaaggcgggccaggcgtgacgtgagaaaaacttagggcccctttgaatcacaggaatgaaaaatggaggaataggaaaaacatagaattctgacaggaatgtaagtgtaaaacagaggattgcaaaacacaggaaaaacatagaaatgaccgtttgattggactacaggaaaaacacaggaatttgagaagagataaagactcaaaggatttcttccatgaggttctacctcttgttaaaattccttcaaaacttgtatggtaagaggcattccataggaattttataggattccataggattcattcctttgattcaaagagctttgtgggaaaaattcatataggaatgaaatcctctaaaattcctatgaatttcttttgaatcaaagggggccttagcattgctaagttggtcagaggctagagttgcctccggatttctgtatgtatgctgttgtactaatagtactactatatactagacttatgtactaaagtactactagcttttctttggtaaacatttttatgcagccaaagatcacactagagacctgctctgacactcttctagtatatagagttaatagcttgaacagatgtgtagaagacatgatacccacaaatcatacatgtcacccatatggtacttgatgcctgggtatcaagtccctgatactaggtatcaagtagtaagccaaagtattcagtttagttccatatgtactaggcctgatacctgatacctcaggtatcgattacatggtaccttgatacttgatacttggtattgggtatcggatacctaggtatcaggtacttggtatctagatcggtctgatatccttagataccagacctgatactaggtatcaagtatttaggttgtcaatttcgttttgcacggaaattttaataaaccttcaccaaattcgtaaaatttggaaaaaaaaaaagccctggaaaattcggctaacatatttgcttgccgatagggaaccgaaattgacatcactgctcgtgggggcgatgagagtgagggatcgatggcgacgacgggagtatggggccgggaggcgatgggagggccgtaacagctgaggcatattagtgatcaaagtaaaaattcagtggtacaaaaggaccaagcaaatatgaaagatatgaaagggattagatgagttttaagggacacataaggaattttttaaagttagatcaagaaattgccgttagctttcatctcagcatatgttagagagttcggcggtgagagttacaactctcctccctcgttttctgcgcgcgcgcttttcaaactatgtttttttgcataaaatttctataggaaagttgctttaaaaaattatattgatccattttcaagtttattttactaatacttaattaattagtattaattaatcacatgttaatgaactgctctgattttcgtgcttgagatgaacgttcccaactccagggaacgaacgcaggtgtcaacggtatgaatgtagtatgtgttggtggttcttccatatctatatacctacttaaaaaatacgtagggctttcgatcacccgttttgtccgtagtcgtcgtttgagtccgagtccgtcttttattttaaaaaaaaaccctgagtagatcagctgattgctccccacccctttgccaccaattcccaaaatacatgaatcacaaaatcactcaattgcaatcccaaatcaaaatcaagaatccccacaaaatcaactcccaattcaaaaggtaaaatctaaaccgagaacactccggtttagccttaacgagagacacccatacataagagtactctaggttgctaatagtacacccaatagtatatatctttttttcttcttatagaattttctcttaaactatttatttgatttataatccgattacaccatggtgtttgttgcaattaaatctttataacaagatcttacatgattatattatgatggaaaaaatatttatgttgtaaattacttttattatatatgtaaattgcttttattatatgcaataattacttctatatttgattaaattactttttagacattcaatgaacactttactttattggttagttctacaatatgtttattaaatataatttctagattgatatatttctttaccccacaatagatttactcttattgttgtgataagttactttctttttcttttaagttattcttaaattatttttatgatttattgaatttactttatatgtctaagaagtaatttattgaaatctaaaagtaatttagatatattataaaattaatttatcattttttattaaaatataattatgtgagatcttgttttaaagatttaattgttatgaacacagcggtgcaatcagatcgtaattcgaatgagtaaatcaaaagaaaattctataagaagaaataaagaaaggcactattaggtgtactaatagcaacgagtgaggtaagctggttacgacaatccagctaccgtctcgtcgtagtcatgtccaattcaaaagtaaaatccaaaccctaagcctagccgcctcccgcagccgccttccttgtggtcaccgccgtcgtcgccgtagtcgtcttccgccgtgactggctcccgagcccgccgccgctcctgagcccatcaccactcccggccacgtcgccacacctgagaggaggagcagcagccgctgggtccgccgccgtgccgaaccaccgccagatgcacatgcggtagccgccgaggccaccaccgctgttaaatctgctatgggagggaggcgagaggggtcggagggagcctccgccgccggacccatccttggccgccaccaccgcggccagatccacccacggtcgccgccgacaccgccgttgccgaatccgtcgcgcgagggaggcaagagaaggggggaaggacggtcaggaagaagagggagagatagagcggcgccgccggtgggggaggtagagagagagcggcgccgccggggagggcgaggaggagcgctggaggaggagaggcggcaccactgagagagagaggaaggggaaatgatttagggttagggtttggaccttttgaacttatatataggtcgcaatgaattaggaccgtccatcagatcgcacgactccagcttctcctgcgtcgggccgggtgccgttcccaggccgcccacactattgggctgcttgtaatctcctcatagaataagttcactttttgtccctaaagttatccccgaatatgttttcaggccgcccacactataggccgcctcatgggccgcgtgtacgctccacacgaaataagttcacttgaggtctcttaagttgaactttttttatttcattagtaatggattttctttttttatttcattagtaatagattttcttaaaatgctcatatcatgtaaaactaaaccctaatcatctaggggaatgctccggtacaatatacttgaagtattctactccgagtagaattaatctggaccctttattttaaagggtaggtaagtaatcttctaatatcctttaggggtaaatttggtatgggatgttttcttctgttcgcatcggttcgcatcgcaggtgtggattccgtcgcgccattcctcccccggcctcgccgccttgcccgcctccgttgctgtccgtatcgctcgccgtcgccgccttctccgcctcctcaatcgccgtctgtctcctccgcccgcgtcgccttctccgcccccctccgtcgccgtccgcctcccccgccctcgccgccgtcttcgctccatccgtcaccttcgtcttcgcttcctctgttgccgccgtcttcgccccctccgtcgccgtacatctccccgccctcttcaccctcccccttcggttcgcatttggtcggaggcaggcaccggcaggcggctacgcgcccggtggctattcctccaggcaggcggcgtcgcggccggtggcgccacgcgtcgcatctgtccgacgcaggcggcggcgcggccagcggctgggcacggcgaaatcatcaggtatccactcctcccatccccaccccccccccccaacctggctttctgttccccttcatatcctcagtggtgaacttgtctgaattgctcctctattaatgcatatacttgcttgttaatgtctgtgtaaactagcttgtaaatcgaataggagatttattaaattgattttgtatgttgagttgtaagtatgaacgatgaaactgacgaacaatatttttttgaaagaaatatgaacaataacttttgaaagaaatatttttttgaaggaaatatgaacaatattaaattgattttgctgtgcatgtatggcttgctgccctggcgaactgaccattgatatttagatatgatttagcatgacatcttctggtaggataagacaaatgcgatatattttgacaaaaatagacaggggctgcattaacattggacttggcttcttttgctagtttgtcagctaacttgattatgtccataggaatccacatgacctgcaaaacagattcaggaattgtggcaacgatctgactacaaataggtcttaataagctgcaatgacctggctccgtttcgaatcttccttttataagggtttcaacaatggtagaattatcagagaggagcatgtaaccgaagtcattgtgaaatacacaaatgcatacattctccagaggtgctgaaaaaagaaacagattactgaaactactggatgatgtgcaacacaaaatttgactgtacagctgaaatgaaaacagaaaaattatctctgaacaaccattttcagaaaatgtattttagtataacaatttatagtacgtacaaaatttgcagccattgtgggggaactgtagtaattgctcaatagtttagaatggcatgtatttatgcagttgatggttgttcttttttttatatacttatgaggtataaaggacgtaagcttatatatttgggtgcttgatctgtttgttttttttacttttccgtaggtgaggtctgagacttcgagctatgtgattctagaggatcaggaagagtataaaatgatgggtactgtggttttttcaagcaaggaggaatgttacaaattctatttagactatgcaaaggggaagggtttcagtgtgaggaaaaacaacttgaaacggaaggacggtgagattatatggaggcaattcgtatgctcatgtgaagggtacagggagttaaagcactttgagaggacagagcggaaaagggagccacgggcactgacccgctgcggttgcttagctaagcttgagattgagcggaacgaggagaagggggtgtggtttgttaaggagtttgataaccaacatacgcacgaacttgcaaatcctgaccatgttgcttttttaggagttcatcatgtgatgagtgattttaagaaagcccaagcggtcgagcttcgcatgagtggccttaggccctttcaaatcatggaggttatggagaataaccatgatgagttagatgaggttggttttgtgatgaaggacctttataatttctttacacggtacgagatgaagaatatcaagggtcatgatgctgaagatgtgttgaaatatcgggcgtcttaggaatgtgttttgggcagattctgaatcacgtttagactatgctgcttttggtggtgttgttattttcgatagcacttaccatgtgaacaagtacaatcttcctttcattcctttcataggagttaactaccacataagtacaacaatttttgggtgcggaattctatcaaatgagtatgtcaactcttactgttggctccttgagacttttttggaggcaatgcgtcaagtgcatccaaaatcattgattaccgatggcgacctagcaatggcgaaggctatcagtaaggtaatgccgggtgcttaccatagattgtgtacttggcatatagaggagaatatgagtcgtcaccttcgtaagccaaaactcgacgagctaagaaaattaatttatgagaatatggatgaggacaagttcgagagacgttgggctgattttaaggagaatggaggcacgggaaatggacaatggatcgctctgatgtaccgactaagggagaagtgggcagctgcctatacatattggaaatacttgttgggtatgcacagcaaccaatgtagtgagtcactgaactcaaagcttcacacccttctaaagagaaacatgtcactaatgtgcttagtcaaacatgttaagttgtgcatacaacgcctgcataagaaggaggctcagttggacgctaagtctaccaattcggtccctttttgtagaatagacgccgacccattggagaaagacgttgcccgtatatacactgcagtcgtgttcaagacaatccgtgcacagatacggctaattgcaggacttgaagtcatcagtgggactaatcaagatggttcgtcattgtatgctgttggtttgaaggacgataatgaggtgtgggatgaagtgagggttacttttaaaggccaggctttggaaggtgtggaatgtcattgtcggaagatggagtgcgaagacatcccttgctcacatatttttgttgtactcaagttccttggttttgacaccatctctcgttgttgtgtcgtggataggtggacaatgggagcaaaggcgacatttaggtcagacaggaatgccgatcctaatgtgtggtctgaacacatggttcgttaccgtagcctccgaaatctgggtagtgatgctttcttcgaggccgctaggaactctagcagacagaaaaggcgatggatttcttaaaggggattttggataaaggatcgtcatccgatgagaacatcgtggctggagattttggtcctatgccaactcacttttcatctagtaaccagccattagagaagagagtacttgatcctgaagagattagggcaaaatgagctccatctaagagacgaaggccattccgtgagacattgcacacaaataaccaattaggtaattgtggctcacaaactttgtatcttttgtattattggcattgtttttgttttggattagtttaatcttttctcaagatgtgcatattaagtgtttcccctgtgcatgcttttggattagtttaatcctttctaatattctgaacttctgatgacaacaagttaagttactaggttacaggctagtccaatggatggtagatcttttagaaaacaattattttcggttgggcgtgcgatagaatacagcggaacggattatttcgaacaaaataattattacgtccgggacggtcgattttttataaaacaattattccggtcgattttttagaaaacaaataaatatgaattcctacaacaacgggattacaatcttgtcggaaattatcgaacttcgtgcgttatattaacgctctcctattattccgtttttaacacacgaggtttttaaaactaacagtaccgatatccgaaaacatggttttcacgtacgtactcgagttggtccgggccgagtcgatttgtaagaaaacaatttccggtcgatcatgttgcccaccgggccggtttttgaaaatcataaatttccagtcgatcgctcgtatattacaggggaacggattattttggacaaatacaaaattaagttgccgaccaggtcattttttaaaaatcataaatttccggccgatcgctcgtatattatagcggaacagattattttggacaaataaaaaattaagtcgccgaccaggtcggttttttaaaaagaatggatttctggccgatcgctcttatattacagcggaacggattattttggacgaataagaaatcatgtcaccgaccgtccggatcgggcctgtttttgaaaatcataaattttcagttgatcgcttgtatattacagcgtaacggattatggattattttggacgaataaaaaatcatgtcgccgaccgtccggaccgggcctgtttttgaaaatcataaatttctggtcgatcgctcatatattacagcggaacggattattttggacgaataaaaaatcatgttgccgaccgtctggaccgggcctgtttttgaaattcataaattttcggtcgatcgctcgtatattatagcgaaacggattattttggacgaataaaaaatcatatcgccgaccatccagatcgcatggaatatatcggatccgattgttttggacaaatacaatcttgtcggaacttatcgaacttcctgcgttttaaa

SEQ ID NO: 26169 - DNA, 2040 bp, Oryza sativa
ctgacaatggcactggcgacgccctgcagtagcaaagattcatgtgtgctgatgtattgggatatatattattgattagtgagaattagttaggatttctgagaatcataacgaagcaattatcatacaagtaattatcatagccatattatgatgagaatttatatagattgcataacaaaaacaaagtgtaagattcgtgtcgaagatctggcattaacaaataggggtcatcgctgacttaagtataaaataatttatctacaaccaattaaggaaatcaggatttcttatatttttatccaaactcatggtgttctccacaaatctaaagaggtaaaacttagatgtagcatattcagagaggctcaatgttttcatatgtgtttccgttggtgacctagtttagttttagactgtctaaaaatgaagatctaatcctggtcactgtcagggtatacacagatgtctgaaagcacaggttccatgatatgtaatctcctacaacaaagaaaatgatttactctgtaatataagaaaccaactttcagatactggttataatgggttgcatgcctgttcttccaagattacaagtttaaatttcagccaacaatgtgcggagatgatgtaaactcaatggcactacagcacttcattagcacctactgtttgttaattttgttaatactacaacaattcaaactcttagaaacggttatactgctttctgagcctatcttttttactgtctgaaatatggtgctggcctcatgagcaatgaaataggaaacatgcagtgcatatttatgttgaatccggaaatgttggcctcatgattaaagaagtaaaatagcagggctacgccacacacagacacactgtgaccatctaccttagaaacacaatcatgcatgatattccatccagacaatcttaattatatttgttgaatcttcaacccaattgagatcttatgaattatactgaatatatgttagaattgattggaaatttcaatataattaccacgcctcgacgaccgatctatattagccactatatgttcagaatttcacactttcaaactttcaaaccaaagtgagggatgtggtcatgggtgaaggtggcacaaacctgacagtactatgttgccctcgaagacctcactcatgttgctcccctcaaactcctcaacctcactgaatcctgcacataagaatgaacattgaacaaattatagagagggccatatagactgccagaacagtgatggaggacatcacttcaacatgtcagacgagtaacatgccagagcaggattaattatttcctttgatttctaattgatttctagcaggattaattgatctctaggtttggtaatgtgcaatcatatatatgagcacttgcataaattttcacatggactaaactcttattatcttttctgttaattagggaactctagtttgctctccacatgccatgtacgaggtaatactccatctaagtctacgtcaaaaggaagctatcgagggttcaggtcttggcaacttgctaaagattgacaacatacatattgaccgaaacttgtgcaatgagattgcaagaagctatgacaaggagaagaaagcattcaatattaatggtactttcgtaacgatgacactcgatgatgttgattgtttgcttggactgccatcaaaaagagatgacatatttgaggcaccaaaaatcaataaaccagaattgttcaacctgtaaaaaaggaaggccaaacaacaattactttacaagcattacgggaagcaataatcaactccttgagctacgatgaccacttcattcaaagatttattcttttctcaattggatccttcatatgtcctacaactcaaagatatgtgcgctcagaatatctcaatctcgtcgacgacgttgacaacatgagggaactaaactggtctagtctaacactaaatcagttactgaaaggcatattaaaatttagagagaagacaacaaacagggctgcag

SEQ ID NO: 26170 - DNA, 6259 bp, Oryza sativa
  unsure (1)..(6259): unsure at all n locations
tacaagaaagcatccaaactttacaagataatttcaacgatttcacaaaggatttttggccacgtatgcgatcattgatactagattgcatggaaaatgattcaaaatgcccagagcgaaaagatagtacgcatgtgtttgaggtaaagatcatatgctagactgttaatcattattacttacgtaacaccgctaaaaaaaaggttgacgctattgcaggatgttgaacaagaacaaattgatcccagggagcatgtatcaaatcataacgaagagtcctatataaatcaaaatgtaaacatgacttgtgaaacgaaggtaaactgaattttatttctctcactaacgttactacaacttatcataatactaacgtgcactttattacctaacaggacaatagtaactagagcaatcaaagcaggaagatgcttacaggtcctacaggaagaacatacaaaccaactaatcggactgacttcatctacgaaacaagaggtaaaaagaaggacataatcaaaacccaagcacagacaaagaaaacaataggtactatgctatttcatagttgcatatgctcatgtcaatggtactaactttactccttttcaagcgcaaacgaataaagaagcttacatgccagacacaggcgaattacggggtgaaaagaagaggaaacaagacaaccaaacactgaatgaaatatccgaatgtatgaactctctacatcatccataattttttacttatattctatgtttgtgtgttactgatttgacttacccttttctagtgtacatagagaaggaatatcttacgcaaaaaaacatagacaacggaccaccaaagaacgccttacgaggtcaaaagaagaaaaaaaaacgaatggccaaacaatgttaaaaaattcagaaggtaatgactaaccatttaacatttctatagatctattactaatttgtccaaccttcgtagagttgactaaaaaagaagacccgttcattacctacattaataacacggaggataacaaagtgatggtgcatattgaagaagtggaggttaaacggataagaatgaaagtactaacacaaccagaattcttgaatgatgatgtaagttcgcctatttaacaagcctactattcttttataactatatttgttatataactgaactaacctcaaattcaggtcatggatgcatacatcctatgcctccgctataaagagaaaggaatcaggggagatggcaaggccttcctagagatggccatgaaaacaggtctactaaatgtagagggagcgcatgtcgaagcaagcaaacctcgagataaacgatggattagagatatggcacgcgactatctagcatttgacatggtaatacttattcaagctatctatgtaatggctaattcaatttatgactctatctatgtaatggctaattcaatttatgactctatcttagtgttgaacaatgaacatatgcagattttcctcccaattaatattaaagatacacactggtacctagccgttcttaacgccaagcgatgtgaggtgcaaatactagattcgctcgcaaagccaatcagtaaagatcgacctgatctaaggcgtgtggtaagcaatacacttccacttgtataattcaaattggttttgctatgttttaaccgtaccaacgttgcacaaaactttccagctgctagctattgagaggggattacacgggacagagaatcagcacccacagttaaaacacgattggcctgatttcaatattaccgaatgggagtacaacaaagtccaaaacttgccaaagcaaggagacgggtgggtgactcaaactcttccacatgatattcacattattcaattacgcaaacatgttagcctaacgactaaattcttgtagcttctcgtgtggcctgtacacccttaagttcatggagcattggagcggatcttatctcccagaaattcaactacaggcaactacaacaacctctattcatattttgcaccagtgcttcccaatacaaaaaaccatttaaaatgcactccctttgcattatgcagaaggaagtgaaaacatttcgacaggacttagccggaattttgatcaactccgaactgaacaacattaaagatcgtccactgctaccaaccacgacataaatggattatctgtcaaacatttaccacaattaccttactatgctctcttacccttattaaataatttagatactacttgggtatttgatggatcccaaacattgatgcctttttgagataatattcataattcatatttcaatccatttgagaaggagcggtatatgaaaccttacgcttcgggatgactcagcgcagtcagctatcgacgtcaccgacgtgcgtatgctacaatgtcgcacctgaacaccgataaccccttcgccggcatacggatccccttcgcgcatgccaccgtcttgcaaactgaccctgctcccaaccattcaatcaaataatcaatatacaatacaatggattcaagaacaaacaacctttatctgcaaaatcataacagtagtggttggtatattaagatgctgcttaggtgagcactataatgaaggctgaagcaacagagtaaatgagtaatctcgcattagaagatgatactctttaccaacttctcttcgttgtctttctgataccgtataactgaatattggtaagaaaagtatggtaagattggaggattcagaatgtacctgaagctcggctgtctcctctcgattcctcgcatagtatctgaacactaaagatggaaaattgtaaattaaccaaaaaaaactgcaattcaagacaatagaattggtgaattgtgattaatatgacacagttagtagtactcctattaactaatagagtatcgcttacactgggttaaatcggttgccaagggcatgttcacacttcagagaagggggcggctaggtcgatggcgacagaggtggagtggagaagggtgcgtcggtccatggggaggagaacgtggcggtggtggcgcggggaggcgacgcggcgaagaggactcatcgcgcgccggcggaggcgggtggaggggcggctacgtcacgcgactcgctagacaagagggcgggggaggaggacagcgacggtgggggctcacaagccggcgcggagacgcgggcggaggcgaaggcggcgagggcgacaaggaagggcttcgacggagggaagccgccaatatcgggggaggcggacgtcgacagaggggcgctggcggtggagaaggcggcgaggaagggcgagtgcggcgagggagcagagaaggcgacggcgctggagggggaggagacgccaggacaggcgacggaggcggcgagggagatggacggcggcggaagcggggatgggggggaatggcgacgggaagtggtgaaatggcgacgatgcgagaggaatcggatagggatagggtgggtaagagactgaaaaatacgataatacccctacgcgatttttttcccttgacgaaaacacccttccatatttctacttccactaatactaatactggtgggagtagaactagatctcagccctacaattaaatacgaccaatggcccaaattactttctactccgagtagaaagcaccggagtgggactcaatcatctaatatttttatatttggtataattttagtttacccgttgtaacgcacgggtattttagtttacccgttgcaacgtacgggtataatttggagtagtaatgaaaaaaaatacagtgatattatgtttcctgatataatcttggagtatatctagaggacactgtaataattcgccatgatcaaaaagatcaatgaagcacggcttcctcttcaaaaaattttcctactaattattacgacaaacctaagcaaaatcgaattccaatctaactcgacatggccgcaccttcgccgtcgtccggcgatcgggcgcccacccgggagacggcgtcgacgcagcgcctcaccatcacgccgtactcctccttctccggcctcagctccggcaagcccgtcatctccggtctcttcagcctcggcggccacctctgggacatcctcttcttccccggcggctactacagtggcagcccctacgccgccgtcttcctccgcctcgtctccagcgaccacagggagcaggtccgcgtgctcgtcgacttcaccctcgtctaccgccgcggcgggatgaccggcggcggcgaggacgacggctcgtacacgcgctgcgggtaccatgtgttcggcccgggtccagccaccgtaggccgcggctgcttcggcttcccggagttcatcctgcagcacgacctcgccgcgtcgggggtgttgctccgcggcgaccgcctcgtggtcgagtgcgccgtgctcctcgccgccgacgccgacgaggtgctgcggcggggcccgcggccgctcgacgacgagctgcggcgcggcctccgccgcatgctggaggacggcacgggcgccgacgtcacgttcgtcgtccgcggggagcggttccgcgcgcaccgctgcgtgctccccgcgcgttcgcccgtgttgctggcggagctccacgggccggcggcgcgcgccatgggggagacacaggacaccgacgatgccaccaccaccatcaccatcgatgacatggagcccgacgcgttcgccgccatgctgcgcttcgcctacgacgataccctgccggagctgcccgggaacagcgagagggacgccaccggcgtgcacatggcgcagcacctgctcgccgcggcggacctgtacaggatggacgcgctgagccaggcgtgccaggacaggctggcccggtgcgtcacgccggccacggcggccgacacgtacgcgctggccgacaggctcggcctccggctgctcaaggcggccgtcgtccgggacgtcgccgccaccggcgcgcgcggcatcgaggccgtcaagaacagcgaggggttccggcggctcgcggcggccgacgcggcgaccgcagaggagatggtgaggaaggtgatggccgccgcgtcggcgcatgtcaagagggaggaggtgtccacggtgagctccatggagatgatcttggggtcccttggtgtggccgtgttcgctgggattgctttggctgcacttaattttgggccattcagaccaataaaatgaaggaaagattgtcgatttttcatatcccttctttttattaagctactaattaagcacctaaaacataacatgcaagcattgtatttattcgtactcctaaaacctacatgcaagcatgctacattaacccattaagcacacaaaactcaatatgcaagcatatagtaattatatctacaatctattttattataaaactaaacatacacatgctaattcattattgacaaatcattttcataatatttcaaactaaatcatttcatcatttctccaatatctaacatatatcccgcagaaaagcacgaggatcatctagtatatatgtatggagttaggatatatgatccgcgggcatcatatagtatatatgtatggagttgggatgatccaataaacaattgtttgtgttttcgaatgaacagtagaaatttttgtagaggtggagggatttgaatggcaaatttggagtgtgaatttgggaacacgattttcattcgagaaacgattgatctgacgttgcaattggattttaaggcctgatttttttattgcttatatttgaatagaggactactccctctgttccaaaaaaaaggcaaaccatgggtttctgtgtccaactttgactgtccgtcttatatgattttttttataattcgtattttcattgctgttagatgataaaacatgattaatattttatgcgtgacttgtctttttaattttttttataattttttcaaataagacggacagtcaaacgtttggcacggaaactagggtttgtcttttttttggatggagggagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26171 - DNA, 6501 bp, Oryza sativa
aatccggcccattttcgaggcgcgccagggcggtaaacgccggggacaggcggccacgtgggagggggacgcgggaacggcgcggcgtgggcgcgggaagagcggaggaggcggcgacgtggcgaattcggcggcggttgccgtcggaggcgggtggctggaggaaggggacgacctgacaggtgggccccacctgtcagcgtcccggagagaggaggaaggagaacgggccggcccacaaggggaggccgagcgcgggcgacgggtggagtggactgggccgacggcccaatagagaaaaaggaaggaaaaaaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaacggtgccatctgcagactagcttggtaactgttgttgtacgagaactcagcatacggcaagcttttgtcccatgctccaccaaagtcaagcgcacatgctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccaggtagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtctttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctttacccatgcaacattgcagtagctcttcctgctcaaggcatccgcaaccacattagccttgccgggatgataatgtattcccatatcataatctttgatcagctccaaccatcttcgctgtctgagattcaaatcaggttgagtaaagatgtactttagacttttgtgatctgtatatacctcacaacggttactgatgagatagtgccgccaaatctttaaagcatgaacgactgcggccaattccaggtcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccatgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccaaaggtctatcttagagaacacagtagctcctttcagctgatcgaacagatcatcaatccttggcaaagggtacttgttcttaatagtgacctcattgagtgcgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtccggaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggaggttgaactcatgcaaatactctataactgttctggttccttgttgcagggaacggaactctctcttcttttgtgccacaattccctcgggaacctgtgctttattgaaactatgacgaaactctgtccaagtaaactctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctagcagtttggactgaggaggtggagaaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattggtcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggtggcgactctgaagcttggagcggcgcttgcgaacgagggataggactgacatctaaagtagacaagggataggaaccaatttatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataaacccccaataaattcccgactgactgtcgaataaactccaactaaaatttttctaaagccctaggctgagctaattttttttttttttttaaaaaaaaaatccgacccgaaagaacgaccaagatttttcccgcaaaccaaagaggcaaaactccaaattttcccgaaacaattccaggtgcaaaaagggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataacccaaggaggctagaggttcttttgcataaagctagcatttaaaagcagtagttggaagcagtaaaacagctgtagtaattaaatcaatattaaccaaacactgtccaacgctacaccacgttgcaacagggcccaaccaacct

SEQ ID NO: 26172 - DNA, 15748 bp, Oryza sativa
  unsure (1)..(15748): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattcttgccttaccaggaacccggtttggctccaaccgaccccgccccggcgttcccaactattggcatgtgaggtttccctgaaccgactagttaacttagccagggtgtcccattccaccttgtggttgcactttgattatgctcgatgagtttcccacaggaatcggtccttatatgcgaatacgggacagcgccacgtagccacagctcccgcatcgtgagttttcacaattcattttatttttcaaacacaccgacatcacatgtcgggttttcaaggcttcacaaacccatttcccaagttttcgacaatcaacggtgtatgtgggatatttggtatgcgcgctcagagagcacggatactgatgtaccacaagggtggagcaacaaggaatcagggtagtacaacctacaggagttagtgcgactactgggtaggtccgtcggtttggcacgcaaaccgaggccaagcaaattaagtgtgtgattctaataatgcaagttgcaaacaaagtaataatgattttccaattataggagcaattgatcaaagggtgacttgccttgctcaaggtcttcactgagcttcacgaatcttcgagaaatccacgatcgacgaaaatccggtaaccgcaactatacgcaaacaattaaaaacctacacaagacccaaaagatcctatttagactaattaatagtgccattagatagatctcaattttacggaattgctggaagttgaacggagtcaatcggagttacggatagagagatattgattttctaatcaaaggaaaaaggatttaatagtttattaaaccctttttggaaagaaattgaaggagggatgtgatttagacttcctcgggcggcttgggcgcggcccgagaggagaggcgcagctcggtcgaactaatgggccggccggcccgaagaggcggcccaaggggcacggggagagtgaggaagatggagggccggtgggccgagtccaccttgcagggtcccgagtagggcccgcttgtcagtggcgcggctcaccgtgggagcggtgcatgcggcgcgcgctagggttcgggtaggagtggcgcacggtctggtgcaccgggtggaccgaagggtggcaggcccacgcgcagccgttaggctctccgtggaccgtgcacatgggaaggaagacggagggagggggtggctgaccggcttggcccggtcaaagccgaggtggcgccgacgtggcgcctacgtggcagccacgtgggtcggtgggaggaggaagaaggggaggccgagatggacggcagacggcggccgagttcaccggagctcgtcgcgacgattcgagagagagggagtacaccagaacgatgggacggatgagagggagtgagccaccggatcggattcgctggagggaggccagcgacgacggatcgcggcggcgcacgccagcggcgagaaaagggggaaacttcaccggagcaacgggggttcgattcaaaggggtgggagcatctccggggttcaaggaatccgtttccggcgccggatgggacgaaggagtaccaaggagggccggcgacgagcagcggcctccgggagcggacggcaatggcggcgaggccatgccgggcggcggaggggctcggggcagcgtacacgcgcgttcggtagtgctacgggtgctagctcaaaagctaagggcacgagagagagagagagagagagagagagagagagagcagggagggagaacggaggaggcactgctgagccaggcgcagtgatgggcggccgacggcgcggggcgagctctccggcctcgggccggggaaggggaaggagaagggtgcccggagtccccatccgctcctatcctcctttgctaatctatttgctaagctcacagaagagcatatgtatgcaattgggtagtgtcgcagtgacactataatacatgcaagaaatgcatcagccatgctctaggggatgtgcagatagtatgtgcatctagaatgcaagccatcatctattataactagcaacttttagattcccagcgtgacgattcagtttgataagactaacatgatacacttgatttctatgcatagcgatatttcctctatcaaaatttggtaaaaagaatttaacaaggctgttaattcactcatcactatggtggaagcaaagcagaagatctgtccgcaagatttcctactggacaagatatattcatagtagatacctacaagacttcgggtttagatattagtatttgatcttaatttctaagttcatgagctctgattagtagagtttaacattgatgattgtagatttgtagctgtcatgggtggatgtaagaagtaaaatgggtggaacgaagagtttattacttaggtagaataagaaaataaaaattgataaggggcatttgcccccgcttggtgtagaactgactaggggccaatgccccccgtctatatctacctgccagttgcccctaacattattagttggcctgactgccatttcctattaactgcacaaatatcatgtattattcatatatttggaaaaaaaatgcctaatagatgttacaaactgctaacactattgtatattctaaattattctattgctcctacattttgtttttaggacaaactacaccaagctcactactcttgttttgaaggaattgaaaagagtagcaactacgcagcccgcaagtagtagtgaaatagtaagtatttgagaaatatttcatagttctagcatcctgtaccttgattatgtgctaaaatttcttaatacattatttttcaaagatccttaatgttacattgttgactcctatcgacggaagaacatactccattgcagcctacgagtgcctctctcccttctattaatgagttataactcatgtttttttttatttttgcaaattgcaaattgtgctacttattctaaccgttatatatgaaatttcgaatctaccttttgcattacaggcttttacgtctctggtaaaggccactaaagctatatagggtgagttagagctcgagtgtcattatttctatccactaaagaaacattgacaagaaggtgagttagagctcgagtgtcattatttcttttttttcaatcttagaggaattgaaattgtagttcctataacaatttcactcttcattgttccaagctctagtacctcgttcagaccactatctatgaagtcgtgcaaaattccgaaaatctcagaatgagtaagggacaaatggtacgtgtcgacgggacccgacaaccgtatttgtagagtatgagatttgttggtactaaagtatgcacgagattgtagtaaatagatggacaagccggtgttgctattatataatcaatctctcacaggtataattgcgaggagaacttaatctagtctctctagcagcgtaaagcttgaatatgtggtcgacggttagcagttgtaagcttcttcgaacaaaaactcgacgagattggaggtggctatagatccctctttgctgtcttttgtggtgctagttggatcgtacagacctcgtttaggcttgtctcctctcctcctgggggtcttgtatttacgctctcaaataccctttgtcaaaatagaattaggaagcaagtataccttgtttaggcttgtctcctttcctcctaggggtcttgtatttacgctctcacataccatttgtcaaaatagaattagggagcaagtatggatctgatccgagtagaccttgtggtgtcaagtaggactttgcttatctttccttatgtggaacaccttccatatgaggcttgattatgtataggatttggtatatagtgggccaaccgatccttagtacacaaatactctctccatccacaaaagttagacatatttcacatttgagtttttccaaataagttgttcctatttgtagtctttatgcattcaagacttaaatgaagagataaattaaatgtttgattagaacccaaggagtaatctaaatactcattggttgtatgtttgcttttactccttgattttgtaacatccaagatgatttaatttcttcttggtcttggtgacaaaagtaataggtgtaacttttgtggatggagggagtataaggacactaacaatattttctgagacaaaaaactcttaaaatactttattgcttgtatactcatctatcttttacttttgtaaggttcatgagatacattcaaagaattcctggaacaaggaaatgcggttgagtacctactcgaccgccttggactccactctgaagacgtgctcccgatttatatcggtgatgacacggcagacgagaaagccttaaagatattaatactttaactaataaacttgtgttgtgatcacattttaatttctttccccatttaaaaaaataggcaaaattggctctagagcatcgaaaattcatgttttttgttttatagaaccaaaagttaccggtttactctaaatctctaatagcatctaaaagcttcctccattccaatttctagcactaccatcatttttttacttctttatcgtcaactctgaacagaatttgacccaacattgagtagccgctgcagcccgacatttctcgctgccggtggtgcccgtctatgcgccagcccaccccatcgtctagagttgcgcccgtcccacggcatgtactgacgtcttccttgccttcttgctactcgcgcaggtgaaagccctttatcctctttgtgcaatcttaccccttccctgacattgacgggcagctctggctcattggcaataatctacacaatcttgagctgtggcggctggaggtggcatctcatgacctccatgtggttaagtacctgctcgacctccttggacttaactatgaagacgtgctcccaatttatattggggatgacacgaccgatgagaatgccttcaaggtattagattccggtaagtacataatgtatgggctagtagattgcacaccagagttgacacatttagagtgtcaattttgttttgggttctcgtctttacaaggtccaatttatatcggggatgacacgaccgatgagaatgccttcaaggtattagattctagtaagtacataatgtatgggctagtagattgcacaccagagttgacacatttaaagtgtcaattttgttttgggttctcgtctttacaaggttttgataggtttatgggtgagagaagcagtgatctggtgtagttgtcgataccaaccatactctttgtttattggtcccaacgctgaatctttccacagactagtctacactcaaaactaaaggtaagagaggaaacctaaatattgttggtaagaagatttagtttaataagactaacatgctacatttaattattattcatagcaatatttcctttatcaaaattcaataacaagagtttgacatgggctgctggagagatattcatagtagatacctacaaaactttatgttcagctattaatatttaatcttaatttctaagttcattagttgtcattagtagagtttaacattaatgattgtagatttacaactgccatgggtgaaaccgagagatactcgggaagaataagaaagtaaagactaataagggggcatttgccccccggtttggtgataaatgtctatatctaccggccagctaccgctaacatcattagttggcatggctatcatttcctattaactgcacaaatatcatgtattattcatgtatttggaagaaaaatggcttatagatgttacaactattaacacttctatatattctaaattgttctactactcctgcattttgtttttaggaaaagttacagcaagctcatgacatcttttacttttataaggttcacgagatacatttaaaggattcccgaaacaagggaaatgtagttaagtacatgctcgaccgccttggactcaactctgaagacgtgctcccgatttatatcggggatgacacgaccgacgagaatgcgttcaaagtatttatactttaacttaaaaaacttctgttgtgatcacattttaacttaatatcttttttccatttaaagaacaatccctcttttatgttgctttgttaggttatccatcaacatgcaacatgattcgagattctcgtctcctaagtgcctaagaagattaacaagaccgcaacaacctatattttcattcctatcttttccaggttgtaatgttacatgtgttctaaattttatttgttatttaggtgatggaattcctctgtttgttggctagttggagggagctttcacaaagctaaagaaatgtaagttcaatagctcatataagttcaactatgagtgtagcctttaactctaatttgcgtataaactatatttgggaaacacaaagataaatttcgaaccgagtacacccaagttgttcaaatatgtgaattagaagaaaactgctatgtgcaaaattataacatgtgactagaacttcagcataaatgtttgtgtggttttgtttgaggagtcttcagtggttgttaaatagaaaactagagttctatgtaaaatattttttaatggctttaaaggctaaacaatcagttttggcaagctacaaaagttttcttatagggggtgttaagtagtagtattttaaagaagataatttgactcatagggggatgaaaatgatcagaactatctatgtttttgtggtattcatgattagtggattgacttacgatgcttgtccaatggaaaaatatgatattagatttaattttgctttcagaccatcaccaagtgggatggatgatctatgcggtagatggattaaccaatttgtggcccaaaatagataaatgaggttgattgggatagctgcaaccgtatgaaacgttgctgatgcgagtcttcactgtgtcatcggagagatctacaccaatattgtcaacattagtgctcaacaaaagtttttattatgataaatcctactgataacattggacaatgtaacccagggctatatccacgtcgtgtcttcatctcctgtgtacttatacgcatgataagcacgagcatagagcggttgaattggacaacacacgaaatcctcaatgatctcgtatcccatcagaccacgatcttgaaagtatttgatctttgttacaaaaggtcctaaggattcggtgattggaggactcgaaatctagaactttttttagattgctttgaagtcagggagggaaaggcaaggggaggcagtcactgtgtggagataaaaccatctattcctccattctttcctagaggtggggcaattaaaggggatgtacttgtccctgttgacgtaaaacacgacgactcgggagattcgcttcactccagtgtaggtctaaggcttgcctctaatgctaagagcgtgccagctagtttgatctacaactaacaagagaaaacagaaaaacgtaattagatgaacgatagccaattggccaatcgagccgacgacatatcgtcaggacccagcaaatacgggtaaacctaatcggctgtggctttatgatagtcaatgaaagcaaaaccctaaatatgccctatcggctgtaatactgcctctttagcttttatgaattattttaagacaatattacggaaatagctgatagatcaatatttagagcaaagatagataatatactggctaatactccaatataaacttatgtgagtaaattaatctatataaacatatcaaataggaattgatcaccagatatgaagtttgggcaatatcaatctaacttgatgcgtctatatagaacaatctaatcatataagtagcaaatatacgtagatagaccatgaaacatatgctatcatgcatattaggtaagatcagttgaaaccccgatattatccttaattatgattaactccaggttagtttttacaattctaaatacggctaggggtgatgcatcacaaagtatacaaagaagcataaagtctaaacaatcaaggagttaaacacttttcaggatggtagataccttagttaatctaatctagtaagacgatttagccgataccagcataaaccctaaaacaagtgtcagtcgatagaactaaatcgagatactaagactagattaactaagatatatgatatcaataaccacgataaaaggactaatacatctaaaacgacataatagccccgatagcgcaagccatcgagacaagttaccttttgtcgagaaattgcagccgatgcctcgacttgaagcaagaacttgtcgaaaagtaaaacaaaaagggtggcgctgcaccgaaagttgtattgattgatttcgatcccttattacaatgccctggggttcatatttatacctcgagtacaaaacttgtccattacggacacgactcacactttcctaaagataaaatacaagcaactcttaccataactctaatttaaatcgacaaaaatatcctaattaatagatacaattgccttaaatgagctcaatctctatacggcaatatcatttattccaatctaggcccaacccaagcccaagttaaaccatatcggttgcttgccatatcggtagtctgtctccaactttgtttccagccgatgcaatgcctagttgatgcacagttcgattcttaatccaactcgattctgcaccaaatccgcctcgagtatgatgcaaaattccgttgttaacagtcctgcatcccatctctaaggcgaagaccatagcagcctgtgatccttgattgctccatgaatataacctcgtaaaattatctaaatagatctagaaagggtcgcgctccgaggtacacctcacataggtgggtgatgatggtaagaaaggcgatcgaatttggattcaagtgaaggaggtgtaggtcacagtaatcaaggaagagaatccacatttgacgaaagaagaaatgattatgatttttccaatagtaggataaggatcggtaccaccttttgtgcgctcaatcgcccgagcatttggaagcgccccatcgcactggagcttgtccatggccgccttgttgacattggactgtaggagatcgatggcgaacttggtggtggaagggaaagttttggttagggtttttctgtgcgttgtggtggattgggagcggaaaggaggaagaacaacaatacttgcaaatggaacccaaatgaatctcagaagcgagttttataaaccacaggtgatgattcatattttgagaaaggttgtcggtgatatgggcctgggggtaccgggagtaccgaacttaaaaggcaggagccgcccttggcatccatgtggcgctcaccccggggggtcgcgcccgtggacaagtggaagccgcccgtacctaacccgaggggtcaggctgccccgacccctcggggtggtccccacatgaccaccatgcaaagatgattcgtggacgccgctccgcgcccacctaaccacatttaatgcgggcggagcgggcgttcctcgccacattaaatgtggcgtgccgctcgcctgaccgaatcttgaccgaacgtgaccggttgaaacaacggacgagacagcaacaggccacgcgtggtctgccctagtgtcatgcggagtgcggtaggtgcgccctgtcccatcaagatgacgagagacacagcgcccgggacagcgttcccgacacatccaagcctcaagtctacaaccattaaatgaagaatgacagggatcctcctccatatcggcttgtgtcagccggcatgatttgatggggcccgctcgacagccgatgatcgaaatttccaagctgtagtgcaagacacgcgtttaatctagagaatatttgccctttttactggatggcacatccgatgcgtgtaacaaccccttggagtataaaaggatgtggacgtccagtgagagggggaggagagaggagaataggaacacttgactctagtctgtacaccagagattcagagactttcaaagctcagaaaaatcatcatacacatgagtagggtattacgcttcttagcggcccgatcctgtataatctttcctgtctcgcccgctaggtcgcagccccgaccccccttgtttctttctaatacgcccagttcctcaatctacattcactgcccccggccgaactgaagaaggagggatcccctgctcgaggagtttatcctccaacaaaggccaagaaatatttggcagaagtttagtggttgtccttctgtggtggtggtgttctgacttcactccaaattcaaaattcagtaattttctagcctagtgctgggaaagatgacttgttcaaggactatttacctactcgttttctcgagttcgttttcaagggctactaccagtgatacgaattagatatacctcctatacttagattcgtgaccaccaaaagtattgcatacctaacattatgcagaaaggtatataagaacaagaactccttccacgggaatagaagatattggattctaacatgaggaaggcaaagtcttatatgcccgtatcctacgagggctctttgaattctacttggataagaagttgtctacttatataaatacaacgcctctctaggaggggagggcatcgaaaaatcaaaagccatagccacaagccacattgcaaaatcaaccaataggaagacaatagctagccgtcgacttcaagtagtcggattagttcacggcgaatactactccctctatcccatatataaagtgtgatcaaagttagcacggtctccaaaactaatatttagtttataatttcttatatactataaaatttttatcaacaaaattataaccatataaaagtaaatttaaatcacaatctaatgatatagtttttaacaaataaaattcatttcatattatactaagtgttggtcaaatgttttaaaggttgaatcttgaaatacgtgcacaccttatattatgggatggagggagtagttggtagctagtttgcttccctattataataaagtgatacaacctagagctatatataaagtgaactagagttattatctatcctgaggtccaaaccagtataaaaatccattctcccacctactttacctcaatctcatacaaccttagtatcaacgttttctatactatacagatatcatggtcgggaatagccccttgatatatattattctggggctgaaagttttttatgccaaaattttgtattaccaactaatttgtcttgtagctggtctgaatcaaactatgacgctggagaagtatggtttgctttcgccttctctggttaatctagttggctgaaagcactgtagcacatggttcagaattccaaccgcagaaaatgtcctgcaggtcttcaggggcagtcacagaagtcacaaaccatctgccgcctatagccaaatggttcgacaacatgcacgtagacgtacgcgtgaactacattcgaaaccaagatgagcactcgcagaaacgtgcccggatatttgaaaatataatcgaaaagatgattcatgcctttgctaggacagtaggaattttatcagattttcgacacaaggtaaatatgtatagctcacgcacttttaaatttagttgttgcaaagaaaagaagaccgagaaatcaatcagatttctgtagagaaaaatcaagtaaaatgtaaattagaccattgccacggcccatggcccattggtatcattgaatggaccacagtacaagttgctgatatttgagaaaaaaaaccctatataactatattgccttaaaaaataacacaacttagtgttccattggaagaacacaacaaaatttgaacttctgaattaatctagaggctgtttcttcgctttctatttttcatccttgatttctacgcccctcagagtagacatacaaatttatactattatctcattattgtatactccctccgtttcacaatgtaagttattctaacatttcctacatttatattaatgttaatgaatctagacatcattaacatcaatatgtctagatttattaacatcaatatgaatgtgagaaatgttagaataacttacattgtgaaacggatgaagtagttatttgtttgttacgtttaaataaacacagatattaaaaaacaaaaagtaggagggggtaaaacggaaaaaatgcaaatagggttaaagcagggttttggagctcgctgtcacgctcatcagtctaatcccacccatttcggctgcgctggctgccaccatgtggagcctcgccgtcgcgagcccgcaccccgccgccgccttcgccgcggcccgtccccgccgcggccctcgccccgccgccgccccctcccacaggtcgtcccctctcctcccatctcgcgcgcctctcgcgtcccctgcggacgtctcgtcggtttctcctcgttggtttaccctgggcgaatccccagagtttttttatttgttttttttgggtggatttgttcgtgtcgaggatgcgcgatttcatttccttgaccgtggtttttttttccagtttgtcgattttctcccctctggtgatgcggtttgttggtttcctgactggtgattatttatatatgcagaggtgtgaatccgcagcggtggcgatgtgagaagactcaggcatggtcgttttggagctctctgtggttggtgttcttcatcgtgaacggttttctgtgcatggattgaatcccttcttgactgaaattgtcatgttgtgagttggcgttgggtcacagacatgagggtttttttcttttcgttgttgtgcatttcgcttagctgtgattgatagcgtggtgcagtattatttctaaagggaatttggggaaatgcatatttggtgcatcatgtatgttctatcgaaagctgttgagcagttatactccttacggaatgttaacgtattcttatcagataactgtcttcttatcaaaatatagcaacctaacggtcttcttctctagtcaatttctactctatcagttctgcattcaataaaattattatttctatatcatctttggtaaccatcaggcaatgtgaaatttcagtgaatgaatcaatccttcctcttttttttttctacttttgctttattcagggccagcgaccttccaggaggactttatggggatgtttcgaagaatatgctcaagccagctgctggtaatattatctatcatctttcatggccattgtttcactatgttgaatttgttcctttctcccagttcacttttagtctagtctagattgtggtataattttcaccccttttttgacggagaaattccataggctagattccattactcaattggaactgttctttgattaaagctattgcagggtacttattctcatttttggtattgcatctcaggttttgattttgatacaatttaaccactatcaatgttattgttactatcacatttttcttttagctttacttcccctaaagtggtaaagaaggcttgtctttgtctcattaagataacaaaaaataggaataaatagttcgttcattgtattgatagaagtggatcattaatatattgccatctaagtttatgaatttcttctcagctgtttcagttgagcaagctgaagctagtgctcaccttccaaaaggtgacatgtggtctgtgcataaatttggtgggacctgcatgggaacctcccagaggattcagaatgtggctgacataatccttcgcgacccttctgagaggaaactggtagttgtgtctgcaatgtctaaagtcactgacatgatgtacaaccttgtaaataaggctcaatcaagggatgattcttatatcactgcacttgatgaagttttcgagaagcatatggcagcagcaaaggatctgcttggaggagaggaccttgcaagattcttatctcagttgcacgcggatgtcagtaacctaaaagcaatgcttcgtgcaatttgcataggttaatcacaccctatttttcttatctttctgtcatatgtttttctttttcagtaaaataggttgtcctttattttgtccaacttatggagaggatttacatgggcccttagtacttctgtgctaactgctgactatttacaattatgtaccaatggtgtggtttgattgcagatatatagtcttagctgagttatgatacatttccctttttgcagctgggcatgccacggagtctttctcagattttgttgttggacatggagagatatggtcagctcaattgttgtcatttgccataaagaaggtaacaatgaacacactaaaagaaattaacatctctatggcacaaagcaattactctcgctgtagaattcatgcatagaacctccttacactacagtagcttcagtaataattgctcattggatcatcctttcttctgtggaaatccggtcaagccacagctgaatgtagtctatatgcacctttcttttttgagatagaactagcagtgctcgatctccttttctgaacattattattcatgagaaataaatattctattttataagtgcataggagcttattttaaatatttgggtgtagttttacacttgtaccaaaccatttggttctttaatgttgttattatcaacaaaaccaatttgtgcatttgcatttagtttagagtaatctctatggaaatacacctactatattcagaaggcactgctcatataaaaatattacctagcttatacctttaaaaacatggacttacaccaaaatatcttacactatgcagtctggaaccccttgcagttggatggacacacgagaagttttagttgtaaatcctacaggttccaaccaagtagatcctgactatttggaatctgagaaacgacttgagaaatggttcgctcgacagccagctgagacaataattgctactgggtttattgcgagtacacctgaaaacattcctacaaccttgaaaagagatggaagtgatttctctgcagccataattggttcacttgttaaggctggtcaggtcactatctggactgatgttgatggggtctttagtgcagatcccagaaaaggtaatcttgtatcaacttactgccttgacacttattctggaaatttactaccagttttttttatgtgttatgcaatatgaaatggagataaaatgcgtgcatgccatttcaatctcatcatctttttttgtcaaggcttatgcctccatgaagaattaacagtatgtccgtgtgactgcctgctgaaagaacataata

SEQ ID NO: 26173 - DNA, 4888 bp, Oryza sativa
taactaaccaaccacgtatgtatatgtgaatctctatgcatccacatacttaatggggctattgggtgcaaatgtatgggcggatccagaaagaactaataggaggggctgaacaaactatacaaaactatagccccctcctctaatggatgtatgacaaaaaaaaattagtgggagcttaatgggggctcccatggttgcaacgtcggtagttggggctagagaccctgacacccccatggcagatccgccaaatctgttctgtacaccattaatgggattgctaaaattatcacaccacatttttctctcctatacgtatgtatggttctatctctcagatctcttttaatcagataataaatcacttctaatcctgattctctttagtgtattacaaaaattacaatataaatttgaatcttacaatgtaattacagtgtaagttttgaaatttatggtgtaattacaatgtaagtgtagataatttgcaatgcaaaaacgatgctattttttggtgaaaaatatggtgccaccaatatagctactccccatcattaattaaacataagtgagttaaatatgtcgactttatttctctatgcatacactgcattttgagtaaccttactctttgtataatgtgtccattttgagacatatataataagagcatctgatttgcagttagcgaggctgtcatattaagcactttatcatatcaggaggcgtgggaaatggtaatttctatactatatctggacacattttgattggtgttatgatcatactactacatgtttaggcattcaaataaccctctgagcttgacagaagttgcctggtgcaagataggctattcctcaaataataacaacacttaagtagtatgagtctgtgagattctgatgaaactacactaggcttgcttgttagttactcaggtcatatataaggagaaccatttccatagtctattatacactagaaactattggattgtgtttcttcagtatcttgtagataacttgatttgttttctgtatgcagtcgtattttggggcaaatgtattacatccgcgtaccatcatacctgtgatgaaatacaatatcccaattgttataagaaatatgttcaatatttctgcccctggtaccatgatctgccagcagcctgcgaatgaaagtggtgatttggaggcttgcgtcaaagcatttgcaactatagataaattgtctcttgttaacgttgaagggtaagtttttctaagttagcacatttcttattttgatccttcaatatgtgaaccatatataatctgaattcagtcaccaggctactttgatgatctttagcaagttccaaagaattgtgtcttctactctcaaataattttctagtgcctggaatcttgattttacacactttgctgacctttcaaggttaacattaatataatagaagcataaataagcgcatttaggatttactagtgattgtattgccataatagctcattaatctttggtgcagaactggaatggctggtgttcctggtactgcaagtgccatatttggtgctgtgaaggatgttggagctaatgttatcatgatatcgcaggtagatagtgttttgcatctctagcatggcatatgattgatgaagcttcatcctaacttcaaagcatgtgcaggctagtagtgaacactccgtatgctttgctgtaccagaaaaggaagttgctgcagtttctgcagctttgcatgtcaggttccgtgaagcattatctgcaggcaggctatctaaggtgtgtttatgatattttttttcactcttcatgtttattaaaatgttctatttccattgtgaactatccatttccaagatatggattgcatgataatcaaatgatggttataatagttctcgatgggtatctgattttcttttgaatatgagaaaaatactttgagagaactcagcggttttgattgacatagatgtgttattgcctaaacaaattctacatatgttacaaacttagcactctagtgggctgtcagttgtgtagaatactctctgttctacactataaatatgtaatgatgatattatgccctcgaatttggtggtgaagaaaaaaattacacttatgcgaagccaggggcagcatcagcctggggccaccatgtcaaggttgggctgcgtatgagtcatgctagagaagggcgtgtatcattacttctttgtttctttggaaagaatgagccaatatcctttagttatatctttggctaacaactgaatctaataacatactaggataacaagccttctaatatgttgaacaagatgagaagcctgatctaacccctgtagtgtgtaactgtatgctgctccagctgctgtcccacctgtggtagtctggtagacactcttgtgcgccatacgagtggctggcttgctgcagtgctggtacttaagcccaaccagaaaggtggtcttcgtgtaaacttccatgatataaagcattaaatccttaaaagcaacatcctgaggaaaaattagagctacaggctggaaatcgacctaagaggcttctaatatgaccatatcaaaccttattgtactaaaatgtaccgaagctggttggaactaactcgattgagggatgtatatgttctgtctgcttccttcatggttagacgtttagtgaatgctgcacaatctctccatgatgtggatatgatattgatctgcctactttattatttagatacgaatttatattttcaggtcgaagtcattcataattgtagcatccttgctgctgtcggcctgaagatggcaagtactcctggggtcagtgcaaccctttttgatgcacttgcaaaggtaatcccacattttaagttttgtatgccaaccatacaagaggtcttttcaagggaccagactaatttacttaatgatggacccaggcaaatattaatgtaagggcaatagctcaaggttgtagtgagtacaacatcactgttgtattgaagcaagaggactgcgtaagggctcttagagctgctcactcaaggttcttcctctccaaaaccacacttgctgtcggaattattggacctgggttgattggtcgtactctccttaaccagctgaaggatcaggtatatcatgctccatatccctttttgttatcataatgcacaaagaatagtaaactatatttctattgtggaacactggaacctcactaggactaagaacataagaagatgcacttacacttccattatcatgatatctatctaggtcactcttaccataaggctaattgcctaatttagaccacttctattagtattctagatttctagtgttacgttagtctgctctatatttttcaccatgtttgaagactctgggagcagccactcaccaactctcaagtagtggctatctgatttctgataaatcagtagatgagacacatccatcacatcttctggctggttggccactatccttcccatctccattctccactatccagctcctgcactgtcagttgccacattcagttattggtgccactcccaccagatggatcaatctagatatgcaggattgtatgcagatctgttcttggctcaatttactcctatacctgttattcctaggtgaccttagttccactgtagcaagtttctttgatcagggaatgaatggcatgtaccctccacagaaactcacaggcaatgtaacttctagttctagctctagagtacttctgtcacatctgatcttctggttgtaagttgttttctgcgggttcaatttcagttggatagaaatacatgagcaaaatataacaaaggaaacatttccatattctattgttcttagttgcctgttaatatattagatttgcgtatgatctctaaaaagggtgtgcggttgattgggttaatttatcttttcacagaaaagcaatatgtaaggtgctattttctctttgactgggttttcctattgcactttacacttatacttaattactctgcaggctgcagttcttaaggaaaatatgaacattgatctgcgtgtcatgggaatcactggttcgaggacaatggttttgagtgatacgtatgttaaatgaatctccacttccctcttttctttccaaattaaatctctggtgcagaacaccacaatagatttattagctcggtagctattcttgtttcgttcaaaacttccatgcttcaaaaagtgggcaaactctatttttggcccgcgaactttcatcaaagttcatttttcaccctgaacaatattaagtcttagggtagaatttgtccagttttgaaagtttaggggtgaaaattaactcgttttatagtttacggtgaaaattgaacttcaacagaagttcaagggttaaaaacggactttaccccccaaaaaaaaaattatgtacatgaactctattggtcaaattgtcatgtctgatgatagcatatgcaaatttgtgtcaaacaattgctttactttctattggttgccctaaaaacctgaccagacagaatattgcagaagggttgtagtcaagattgtttgcggatgttgctgtatgataagcattagtattaagtatttacaaaagctgaatgtttctttgtcctaccaaaaagttgattggtttttcatgatttctgactgatgttttctatttatatgctaatctacatgttcttatctgtatatttcttatgttctttctgtagaggaatagatttggcccattggaaagagcagctacaaactgaagcagaaccagccaaccttgacaagtttgttgatcatttgtccga

SEQ ID NO: 26174 - DNA, 11886 bp, Oryza sativa
tattaagtatttacaaaagctgaatgtttctttgtcctaccaaaaagttgattggtttttcatgatttctgactgatgttttctatttatatgctaatctacaatgttcttatctgtatatttcttatgttctttctgtagaggaatagatttggcccattggaaagagcagctacaaactgaagcagaaccagccaaccttgacaagtttgttgatcatttgtccgagaatcaattattccctaacagggttttggtggactgcacagcagacacaagtgttgcatcccactattatgactggttaaagaagggaatccatgtcatcacgccaaataagaaagcaaattcagggccactggacaaggtaatttttttgcctatcagcaggctttgctatcaaataaatgcatatgcctttttatttttaaatagttgatcttcaaatgagcatatattttttatgactgatttattcagtagaacatggttaaacatattgatggaactagacacatgtcagctttgtatggatgtgagaagagtcatccacagtttttagtacagttgaatttacagtgctagatataattggttgcctttattgactaatgaacttatttcccctgctgcacagtatttgaaacttaggactctacaacgtgcatcatatacccattacttctatgaagcaactgttggtgctggccttcctatcattagcactctgcgcggtctcctggaaacaggtgacaagatattgcgtattgaggggatcttcaggtcagtttgagcacatgattacattgtgtggcatatcaattttcatatgctattataacgcatgggtggagtaagatacttaacagatacttttatttagtgaatttagtgtgatgctgcctgataatatgctctgctgattgttcaactgcagtggaacattgagttacattttcaacaattttgaaggaacaagagctttcagtgatgttgtttctgaagcaaaagaggctggatacactgaacctgatccaagagatgatctgtctggaactgatgtagccagaaaggtacttcttccatcataggcttatcaacctacataactatacttcctattgactactctgcataacctgcttctattggtggttttgagtaacacgtcataagagatggaaaataattttatgtgccttcatgcttcaggctactctaccaggctcctcagtctttacactcttcagttgtatatctgtcttttcttttttttcttttttttttgcggggcagtacatatctgtttgaatggcacttaggttacactgttgaaaataaataaaagggaaccacagtgtaggtactgaactggaacaaattatatttttgtttcctcttgagcctaatttatcacaacttccttatctaggaacaaattgactgtctatgttttcaagatataaagggttcactcatggaccttggtaacttgagtttagttttcaccctaaatggtgccttttcacataggctgcttctattggtggttttgagtaacacatgacataagagatggaaaataatttcatgtgccttcatgcttcagaagacagctatagaaaccttgtcaggctccttttttcctttctcctctttgtgccttatctctctttctctctctctctctctctctctctctctctctctctctctctctctctctctctctccctcttatctgccttagctgctccttgccttggctatacaagcagcctctcagttggccagaaaccaaggctagatttgctcaggggttaatgattggggtactgatgattggagtaaaaattataagaggaaggagaactgagagagagaatatacaccgaatatttgatggatgaattcatgaatatttgctcaggagttaaagacttgcatgattgataggtgcacaatattgaattcgtttttcactatgctatcttctctatccttttcagttttttttataatttaaacaatatatggaagaacatcaatatttcacacttgttttgtgagaacatttattctttgttcaattggttttttttttttttgccaatcaattacttttggaacaggtaataattcttgctagggaatctggattgaagcttgagctttctgatattcctgtaaggagtcttgtgccggaggcattgagagtaagattgcatccttcttgacgactataccttgatattaacactctaattagatttctgttatgcagtcctgttcaacagctgatgaatacatgcaaaagttaccatcctttgaccaggactgggcaagagagagtaaagatgctgaagctgccggagaagtaagtagatctgtttccatgtctcaaagtaaccgttattgtttgctgatattttcatatcacctcatgattacaaaccatgctgtatttcaataggcttcatattagttgttggttcagtacttattgttcgaaatttatgatagaaagcctgctgaaattattatatgtattatatgttgtcaaaatgaagggttaatattatcatctatataactactgattttcagtaaacattattctgatcgtgttgtcatttgctctgaatacatcaccatatacttctccatgcgagattccaatctaagggactagtctaaaccatctattcgtttaggttttgcggtatgttggagtggtggatttggtgaacaaggagggcaggtcgagctgcggaggtacaagaaggaccacccgttcgcgcagctatctggctccgacaacatcatcgccttcacgacgtcaagatacaaggagcaaccgctgatcgtgcgaggcccgggcgccggtgcagaggtgaccgcaggaggtgtcttcagtgacatactacggctggcctcctacctaggcgctccctcataagctttgtagcaggaagcattttctgatggtggtcaagatggctttgaatcttgtaaggttgcctggtttcttcttctcttttcctttgcacaagcattctaaatcacagtgaggaaataagcctttgttctgtagtgatgttcgtcaagggcaataggtaggagttgtgcaggtcttgttggaaaacaattcttgttcgttgcaataatggtgtggtcgtcaggtttgtttttgatggtgacgctagtgaggtgagacggcattacaagtgaagaatcaataatgcaaagcttcgaatcgtgatgatggaagaaaaaaaaaatccaattgtgcaatgctgcgtaagacctgaaaggtggcaatgtctctgggaccgattcgatcgaccttggaggttcactttacatgtcttacgacctttaatcctgcagagtttggttacaaaagggcttgggattgaattagaatccattggttcctacatgtcttactacaccaacaatcattaatcacatctcaacctaatactagcggaacaggagcatgatgattcctaaaccataggttactccatgttctaaacttgaaatgagctcacttggttagataaaacggaggtaggttactccatattctaaacttgaaatcagctcacttggttagataaaacggaggttgtgcattaagagactcgaagcggcatcatgctggtcagacttcagagagaccggcgtttgtacaggaactgaagtaggatagtgtcatgtgtcttgaattgaagtataaataaattgactgtctgtcacttactaatttgagtggaaggcatataccatgtatggttttttatgacgtggagaagagggaatgaggagagggagaatagtgtgtgtgtgtgtgtgtcattatatacccttatactatgtattatctatatgatcaaatcattaattacacgaatctcctatagacaactaatttaattaggcgcatgcagctgcagtttctgtgtttttctttagtgtagagggctaacatttggcaaggggaaatgatgtactaatttttgttatacttttacatagtttcagtacttatttggcaaggtggcaatatcaaacttttaactcactactacacaaaaaaatgttgttatagttaatacacgaaaaataataaaatattaatatttgatacattgacaaactaaaggattatctttttttgagaaaaagatgttttttagaaaaatatatatacttttacatatcattagtaatgtcataactagaaaaactaattatcaaccatatgtgttaagctttcctaaggaaaaccatagatatgccctaaataaaaggaaaacaatagggttcccatataactaaggctgcatcctggagagaagtattctccccgcatacgaaaaatgaaacgcctcatttgtgcataattgattaagtattagctaaaataaacttaaaaatgtttattataatatatttttttcaacaacttgcccatatttttttaaagaagctgtttaacgcttcgtaaaacgtgcacgtaagaaaatggaagggtgaaaattgggaagacggagcactgaaatttatagctacacaagttttccgttccgcatatattatacagatgtatgatgtaaaaataattatattctccattcatatcaaaataaattaatctaggattgggtggaaggtcattcaacgaatctacacaagtcatgggctttgtttggaaagagctcaagatattctaagaagcagctgggtggtagctaacttctgataatctggaaaatttaggtttcttagcttttggcttctagttcttttctggattttataattatagcttattagaatctaaatgaaaagctgaactgtttaggggagaaactgtaactgtcagaagtttcccaaacaaaccctaattggtttatttcggaacagaaggagttgatagcaactgtttgaaccttttatgcccttaaatgccccctaagggatctgtgaacccctacactttttagagattaggctcatatgtagtttggttcatattcaggtttggatagaatatgattatccatatttgcaagtatatggtgatcctgttttttagttggttgaatatgaccatcattatttttttttgttagatggatgagaatggatagaataaaaacaataacatattaattaataataaaatatgttaattaacaataatataactataatatatactaattaacaatgaaatagactaagaggaaaagagaaaattgagaagatatgcaaaacgaggtgagctattagcacttgattaattgagtataaactattttaaatttcaaaaatagattaatatggtttttaaagcaactttcctatagattttctttttgcaaaaaacatactctctctgaaacgtttcaggttataagacgtcttgacttcggtcaaagtcaaactatttcaagtttgaccaagtttatagacaaaaatagtaatattcataatactaaattaattttatcaaatcaatagttgaatatattttcataataaattttttttggttgaaaatgttactactttttttctacaaacttgatcaaacttaaagcagtttgactttgaccaaagtaaaaacatcttataacatgaaatggagggagtaccgagggagtaccgtttagtagttcgagaaacgtgcgcatggagataagacaaatctcctctcaatgtcctgctgccaaaacgcaggttctaatcaacactaattttacaagtcaactactaaatagcaacaaaatacattttgctaattaattgctaactatcaagattaataaaggttgatatcctcatccagtcaatttgactagatatactcatccagtttctttgtgaaatattttctttccgtttaatcccatcatttccctatttcccaccatgtaaggccgtgtttagcttgtgtaccaaaattttttttaagtatacggacacacatttgaagtattaaatgtagattaataacaaaataaattacagattccacctgtaaactatgagatgaatttattaagcctaattaatctatctttagcaaatatttactgtagcatcacattgtcaaatcatggcgtaattaggctcaaaagattcgtctcgcaatttacatataaactgtgtaattgatttttttttcgttcatatttaatgctccatgtgtcaaaatatttaatgtgatggaatttttgaatgtttgaagtaactaaacactgcctactaaacacactgaaaacctggatcaccatctttcatccaaccaaaaacaccctatagcagcggtcggggcagggcgaaaaggtggtcgcgttcgtcggccaaaagccaaagtttgaccgcacaaaacagcgagtctacaagcagaagaaagaatcatcgttgctagctacctgtacccctttaaatttgccccagcaatttcagctcaattttggatggatgcgcccaacttacttcgcgtctacttcaattcgcaccgccattcttcctctcagcatagctaaagctagctcagcatcgtcatgctccaaatttagtccaagatgaagtctttccaaaatccatttgttttgtccaaagaaatctttgccaaaatttttctactagtataatactatctcctgcttcggttgctcttgctcgcttagttaaataatactaaggacagtattctacttggccgccttcttcttcctcttcgcctctacctgctgcatgccgctttaccccttctcgatgcggggttggattccgacgagatacttgagccgacgagaggtaatctgcttctctcgccttctctctccgttgtaatatgttctttgtcctcgatgtgtttccgattttgcttttcgcggcaaaagactttcggtgttgctttttgcgagggtttgtgttagtgttcttgatgggaagattgccgggttttttttttttttgctgctttgcttagcactttttttttatgatttcttggacaattttggagccatttcgtttagtttgagttctttcggtgtttttgacgcctgtgaggtttcttttattctctaaaattttcgccgagtttggcgttctctcccaattgtttcttcgatattttcttgaagaattgaactgggtaatttcattaagattgaattcggtgcgaagtttatgtcaggttgttgcacacgaatgatttttttttaaattttttttgcagtttgattcgaatcgaagctcctagtcttctttaccatgtgaagaaatcaactggttcagcatcaagaagcagccatggccgccgttcgcgtggtggcgccggcgccttcggtgctgctgcttgtggcggcggcggtggtgctgcttcacctggctcgcgccattgccggcgcggcggacgaggccgcggcgctgctcgcgttcaaggacgcgtccgtggccgccgacccgggcggcgcgctcgcgggctgggccaactccaccacccccggctcgccgtgcgcgtgggccggcgtctcgtgcgccgccggccgcgtccgggcgctcgacctcagcggcatgtcgctctccggccgcctccgcctcgacgccctcctcgcgctctcggcgctccggcgcctcgacctccgcggcaacgccttccacggcgacctctcgcgccacggctcgccgcggcgggcggcgccgtgcgcgctcgtggaggtggacatttcgtcgaacaccttcaatgggacgcttccccgggcgttcttggcgtcctgcggcggcctccagaccctcaacctgtccaggaactccctcaccggtggcggctacccgttcccaccgtccctgcgcaggctcgacatgtcgcggaaccagttgtcggatgccggcttgctgaactactccctgaccggctgccatggcattcagtacctcaacctctcggccaaccagttcaccggaagcctcccggggcttgcaccttgcactgaagtttctgttcttgatttgtcatggaacctcatgtccggtgtactacctccaaggtttgtggccatggctccagccaatttgacatacttgagcattgccggtaacaacttctccatggacatctcagactatgaatttggtgggtgtgcaaatctcacattgcttgattggtcatacaacagactacgtagcacagggttgccgcggagtcttgtcgattgccgtcgattggaggcacttgacatgtctgggaacaagcttctgtctggtccaataccgacgttcttggttgaattgcaagcactgaggcgactctcactagcgggcaaccgattcactggagaaatatcggataagctgagcatcttgtgcaaaacgctggttgagctagacttgtcaagcaaccagctgattggcagcttgcctgcaagttttggacaatgtaggtttcttcaggtgcttgatcttggcaacaaccagctctctggggacttcgtcgaaactgtcatcaccaacatttcttctcttcgtgtgttgcggctgccgttcaacaatattacaggggcaaatccactgcctgcacttgcttccaggtgccctctgcttgaagtcattgatcttggatccaatgagtttgatggcgaaatcatgccggatctgtgctcatcattgccgtcacttcggaaacttctcctgccaaacaattacattaatggaacagtgccatcatcactgagcaattgtgtcaaccttgagtctattgaccttagcttcaacctgctggttggtcagattccaccagaaatattgtttcttctgaagcttgttgatttggtcttatgggcaaacaatctctccggtgagataccagacaagttctgcttcaatagcacggcattggagacattggtgataagctacaacagcttcactggaaacatccctgagtccattaccaggtgtgtgaatctcatttggttatcacttgccggcaacaacctgactgggagtattccctcaggattcggcaacctccagaatcttgccattttgcagcttaacaagaattcactctctggcaaggttccagcagagcttggcagctgcagcaacctcatctggcttgacctcaacagcaatgagttaaccggcacaataccgccacagctagcagcacaggcggggctcatcaccggagcaattgtctctggcaagcagtttgctttcctccgtaatgaggctggcaacatctgccctggtgctggtgttctgtttgaattcctagacattcggccagaccgccttgccaatttcccggctgtgcacttgtgctcctccacaaggatatacactggcacaactgtatacactttcagaaacaatgggagcatgatcttccttgatctttcatataacagcttgaccggtacaattccagcgagcttcgggaacatgacatatcttgaggtccttaacttgggtcacaatgaacttaccggtgcaattccagatgcattcactgggctcaaggggattggtgcacttgatctctcacacaaccacctcaccggtgtcatccctccggggtttgggtgtctgcatttccttgcagattttgatgtctccaacaacaacctcactggtgaaatcccaacatcagggcagctcatcacatttccagcatcccggtatgagaacaactctggactctgtggtattcccttgaatccttgtgtgcataattcaggcgcaggtggtctgccccaaacttcttatgggcataggaattttgctcgacaaagcgtgttccttgcagtgacactctcagtgctcatactgttctccttgctgattattcattacaagctatggaagttccacaaaaacaaaacaaaagagatacaagctggttgctctgagagcctcccaggatccagcaaatcaagctggaagctttcaggtatcggtgagccattgagcatcaatatggccatatttgagaatccattgaggaagctcaccttctctgacctacatcaggccaccaatggcttttgtgcggagacactcattgggtcaggagggtttggtgaggtttacaaggccaaactcaaggatggtaacattgtggctgtcaagaagctgatgcatttcacaggccagggtgaccgggagttcaccgcagagatggagaccattggcaagatcaagcatcgcaaccttgttccattgctaggttactgcaagattggtgatgagcggctccttgtttacgagtatatgaagaatggcagcttagatttcgtcctacatgacaagggtgaggctaatatggatctcaattgggcaacaaggaaaaagatcgcaataggctcggccagggggctagcattcctccaccacagctgtgttccacatatcatacaccgggacatgaagtccagcaatgtgttgcttgatggaaactttgatgcctatgtgtcagactttgggatggcgagactcatgaatgcgctcgattcacatctcactgtgagcatgctttcaggaacacctggatatgtgccacctgagtactgccaggatttccggtgcacaaccaagggcgatgtgtacagctatggagttgtgctcttggagctcctcacagggaagaaaccgattgacccaactgaatttggtgacagtaatcttgttggctgggtgaagcagatggtggaggacagatgcagtgaaatatatgatcctacattgatggccacgacatctagtgaattggagctctatcagtatctgaagattgcttgccgctgcttggatgaccagcctaaccgcaggcctaccatgatccaggtcatgacaatgttcaaagaatttcaggttgactcgggcagcaatttcctcgatgacttctcactcaattcaacaaacatggaggaatcatctgaaaaatcagtgtaaatgcttctggttcttgcagattttgattgttaatggaatgtaagtaaactagtttaatcattttaacttacaggaaagaaaagtagccccttttggtaggtgaatttgcagttttggtttcagtcaatgtacataatacacaataacaggaagagacacagacacaattgtaggcttcttttgtgtagaagattgcctctttagttgtagagccaagtatatatatcttggaactaagttcccatgcttgtacatatgttttcctactgagaaagaacacaacacaagcttttgtaagttggaaattgcttatgttatgacatcgttctgtgatttgcatggtgatgttgcaatttttgcctactgtttgaacaatttgcttaaaaactgaccatatttgtcctttttcgtaataaataaaaatatgttaccacgtctatcttcagctctgattgattctttctgctgacaagcttaaaagaagtgtcttaaatctcaccatacactctgcagtaagtattttactatttcccctttacctttcgtttactgtagcaaataaaaaatttagataatagcaaatcaaaattattactgtggctgacatcttatttcttttagaaatcataaacttcatatctgctattgtcatcaactgttagtcttgttgacaatacattacagtgttagattttggttgtcatatcttgacaataatgaatggcatagtgaaggcatcatttccatgtactaaattttccaatctattttatttacaatattagttaaaacagattttgctagatttggttatttgttcctaatggtagttgttgacaaaatgataatcgtaatttgatattcgtaactcattcaccatttgcatttcagattccttga

SEQ ID NO: 26175 - DNA, 24247 bp, Oryza sativa
cctgctggtgtggcgccatgcaaagtcatagaggtacatacctgcctaccttctttttgacatttcctgatgttacttgccgtcttggcctaccatggcccattgctgtggaaggcatatatcatgatatcggttcatactcagcaatcccttattgtctaaagttggacagtttttgcaaacatatttgcatttcttttagaaacacagtacaaacgcagacactcacaacacgcgcactgcgcacactcacccctatgatcacacacacgcacactctatccctatgattacctttggaagactagaccaacatatctcgagattgatgaagtcatcacggaggcacggacgccttgctgtcaacgggtacgttgcctactactgaaagaataatttgtcctaaatacgagaaccgggtgggttggttccaccacaaggattttttttttttttgctgtcaataagatggctgcgtgctttattaatatgtgtccaatgatgcctatcacgtgtggtcaaaattaagctgaaagccatactcttttgaactctgagtactagattacctcattacttgactcttccctgatgatgataaatcagggtcaatcagcaatctggtagcattatgatattatcaacttggtgtaattttcttccctttcttgattattccgcgagaaaaatgatgaatctgctagctttatgcgacagattttcaatcaacaaactcatcagtctaaattcttttggtttttttatatcaagcacggtgatcactaatcagatatcactttcagggggttgcttgcttccatgctgtggttcaaaggattcggtgttaggttacaggtaagatgcgttggttggcctgaattcttcgcgcgtgcgcttctgacagcgtcatctgggcatgggattggatcagatttccacagtcaccatttcactcatgccgattattataatccgtaacggtttattaataaccaaaaaagtaatttgtgaataaaaattttatatatgtattctactattcttagcgatttaaaagcaaatactggaaaataaactaagatgaaaaaaaatcccaaaatcaactctaaaataaagttttataattcatttttcgctgcggcttataagctgaagggtaaacgatagagttgttcacgctttcaacctgaagaaatcattcatggcattgatgcttttccttccgtccatgcgtaaacgatagagttgttcacgctttcaacctgaagaaaatattttcttagcttcctgatcattcatggcattgatgctttcccttcagtccatgcgtaagatagaaggggatctgtgcacgggtgttgtgtcaagttaggtgcaagactgaagacttgcaggacagtgaccccttgtctcacattctgaatttctgatgagtgaagtgcatctggtacaagagtggtttgttaaagtactaatcaagttgtgccattttgtaattcttttcgtaatatgatcacaaacctttacacttggcaaccccagtttgaccaatttgccaattgggttaaaggacggagattaattgtaaacgttaacaacgtaaagttcaagcttgaaattactttgagtttgtcaatatatttcaaattagttacatacagctattgcttttggagctttggtagttattaacagtatatatcactaataaaaaggtcaaaaggtcgatttaatacaattcatcgaatcaaattatgtttgtgtataaaaaccatgttatcaaatcatatcactaggcaccatttaagtacatactctgttttgcatgttatcacaagataacctagcttgtagagtttgtacttctagaagtgtgatctttgtgtttccaaaagcgagatcccatgcacactattgtcatatatttgtacctaaaaattgaccttaaattgggtggattgccaacgccaagtgggttaagaaaaaaaaggaaatgtgaacatgtatactcttttggttgctttccgtttaacttgagcagttcagataacattagggcgaaaatgcactgaggatcacattgatatggatgaaacatctggaaaagtaatctctatggtagtgtttggtttggggaccaagtgggatgggttagacctatccctttttttaggatgggatggttccggttgtgtgtttggtttgtggtataggatggttatagttttttgtttggtagaagggattgaggtgggatgggatggacagtgtttcacggaccgttagaatgggggacggaggagcaggtcggcgcgagcgaaggagaggcagcgccgcagcggagccgagcgggaggcggcgggagctgacgacgagcggcggcggccggtcgcggaggcggtcgcggacgaggcggaggcgggcgcggagacgaggcgaggagcggtcgagcggcggcggccggtcgcggatgaggcggcggacgtggcagagagcaggcgggggagggatgggtggccgtggcggagtcgagtgggaggcggcgggagctaacgacgagcggcggcggccggtcgcggacgaggcggaggcgggcgcggagacgaggcgaggagcagtcgagcggcgggggccggtcgcggatgaggcggcggatgaggcggcggacgcggcggagagaacaggcggaggaggacggagcggcgccgggagagggagcaggcggaggagggacgggcggccgtggcggcgccgcggcggagctgagcgggaggcggcgggagctgatgacgagcggcggcggccggtcgcggagacggttgcggatgaggcggcggccggtcgcggacgcagaggaggacggagcggcgccgggggagggagcaggcggaggaggacggagcggcgccgggggagggagcaggcggaggagggacgggcggccgtggcggcgccgcggcggagccgagcgggagcagacgccgttctctccgtcgaagtgggatggattggtccggccgattttggcggaccgtttcgtcccggatctgggaggaatattcctctccagggaccatcccatcccactcacctctcaaccaaacacctctaaaagtgggttcatcccatcccatcccatcccatcctctcaaccaaacactacctatgctatcgcggcaattgttcaaagtcccgaagaaaaaccagatttactaacggattatctcatctaattgttggcttttctataactttgacgtgtggtcttttttctttagttaactgatgttgcattgtggtagttagaaatgcttcatatgaaagccttttctcgttaaaaaaaaaactagtggcagtggtggtcgtgattatttttttttccgattacacggaagatgcacattactagccgagtgtgtctctcaagatgttgaagaggccaatggcaaacttctaacgtcacaacgaattattgaaagccacccatcttctcgatatgatgttttaataaaatactcctaaaggtgtttcacaaaaaaaaaaactcctaaatttttgttaatattgcacaagagtctttccacaccacttttatctaatgtagaaaggcttaagatgatcaaatgggcgtgaatatgaggtatgagcttatgttaagattgttcttgcaaaaataaatgttaagattgtgtttttcaaacactatcattctatcaagttcttccctgtaagaaaggtggtgtttgatgcgaacagaaagaaaacccactcattcgttccatgcagcaagtatgattactttttatactatagcgagcgcccaggtttatatctattttacaaaacgattttgctaaaacatatggcgaagaatttttgggagaatatcagtccatttcttgtctgtttgatctgatgtgggcctcatttttcggcctaacctagcaaatgggcctttagcaagttaggcccagtataacttctgtcagaaaaaaatgggcatttgcaaatttaccaccggttttttaatattgtaaagatgccactcgaatgacagttctagtggcatttttgcaattttctagtggtaaatttgaattgcctaaaaaaagggtcaacttggcaggcctacagatagttggaccttttgaagcaccctaacgaggggccgcctaatgggagccccccccatccccctatacactgctctcttccttcctccaccccttcttctcttcctaatacaccataaatttaaaaaaaataaaaaacacaaagttgaaaaaacttatgtatagaaatactatataaaaaaatttgaattcaaattcaaattaaaaacaggtatgtaaactttgggtctataaactaatatttgaattcaaattcaaatttgaattggatatgtaaacttttgatttataaactttggatctaaaacttttaggtgtataaactttagatgtatagaaatactatatataaaaaatatttgaattcaaattcaaatttgaatcggatataattcaaattcaaatttgaatcgggtatgtaaacttttgacttataaactttgggtctataaactttaggtgtataaactttagatgtatagaaatactatatataaaaaatatttgaattcaaatttaaatttgaatcggatatataaatttttgatttataaactttaggtctttaaactttagatgtgtaaacttaaggtgtacaaattttagttgcataaatttactaaaataggaaagtaatgcggtgccaaaaaaggaaaccacgtggaggagaggggggcgccctaggggtgatcgccccttagcaatctcgccctaatgactacttcctctgttttctattataaaactttctatcattgccaacattcatatatatgtcaatgaatctagacatatatgtttgcctagattcattaacatctatagggatatggacaatgctagaatgtcttataacctgaaaatgaaaaggaggtagtataaaaaaatctaaactatttaagagagattttatttatgagaaaaggtgcaacagccaaaagcttctcaaacaggtgttccgacaatgcaatggcttgtgtggtttggttccaaaacttagccctgctaaaacatttataacttcaatagtaacttatacgtattcgaattgaagtcaatgtgtgccagattaatataacttgagaaaccttgccttactatgccaaaacttaagcttttcacattaccaatattttgtaggctaccaatccaacatgccctaaatacacttcctgcaatgcaactctcagtgtatttttcaattgatatgattgtgttttctattcaaagtcatacaagaaatacagttccttgattggtatatatgctaaagacggatgagcgacatacacaatctacccctccatttaaaaatatattaacttttcactacacttatctagatttgtagctaaaaattgttatatctagattcatagctaaaaattgctatattttaggatagagggagtagcaaacaatatatggcacgtgctaaaatgtgtactccctccgtccaacaaaagataaaccctgggttttcgtgtctaacatttgattgtccgtcttatatgaaaattttttataattagtattttcattgttgttagatgataaaacatgattaatactttatgcgtgacttttcattttaatttttttaaataagacagacggttaaacgttagacacggaaactcagggtttgtctcttttttttggacggagggagtacttgataccatttatattaagggttaattagatacataccattaaaaatttaccagttttaaagtatgccattactatttacgtatttataacgatgacattgttgtttatttgtaatctcaatgataccattaagatacgtattaacgaaaacactctcatcttctacctccctctcttccctcatcctgtcatctttctctgctcatgctgctgctgctgctctagatcgattgaagatggatggcaaggacgcttgctgcttctgctagctcgacaggaggccaaaaatggctgtgtgctgcaccggcggaaaggggacccacggcgacgagcggcggtgcttacgatgcaaagacctagatctagagccgctgcggacggagcggcttgccattgtggacgacgacggcggcgcctgggcgccgaagacctgatggaggctcgatctgcggctgctggttgccacgggctgcttgctgcttgcttgaagatgaaggggcgaatgagcttgctggggctagtttgctgcttggagaccacgacgaagaaaaagactcaaatcccatcgctggtgatgcctccctattgctccccgactgggtcgagccgtgcgcatctgccgtgggaattcggagcgccagacagcactgcgcaggccgttgtgccaaatgaccttgtcagatgcagtgatggggaagatgaacagtggagagaggagaggaagaaggaagatgggggtaattctgcccaaaaagtttaggaaatataataaaggggcaagtagtggcatatactcactccgtcctataatataagggattttttttacttgtactgtttggccactcgtcttattaaaaaaaaattgaaattattatttatttttttgacttactttattatccaaagtactttaaacacaatttttcattttttatatttgcacaaattttttgaataagacgaatggtcaaacaatgcaaataaaaactcaaaatcctttatattatggggcgaagggagtaccaaataaccacgaaattataatgctatggttacaaatagttgaatactaatggtatattttaaaaccaacaaatttataatagcatgaacccttatattaaaccctagttgtccatagctaatcttgtgatgattctaaagagttcatgaatgcgtctttacttaacataacatgggccaacttttatttggagtgtctctacgtgggcctaaaacaatagtggtttcaggccgaaaccacattgtcattaattaagcgtatcgattgttgttttgcctctaaaaaatcgtactcctagtatatctttttctgacgataaacagaatgcggttacccttggtacccactaaaactaaaactcaacgtgcaagcatgccacatcatcacctactaataattactattctagcccatttaaaatcccatgcaagcatgccacatcttcactcactagcaattactagtctagcctattttaaatctcatacaagcatgacatatcatctataatattatattatagagatcaacaagtatgtgtcaaatcatcttcctcacattattttctcagcatttcatctttcatcatttcgacaatatttaacatatactcatccgtgaatcccgcagcaaagcacggggtatcacctagtataatagatgattctccgtgttttgcttggagaattattaagtaatctttaatatatttctttaaagagtaaacatgatattatttattaacaacaaataaaactgtttatcaagccatatttgaagataaataaatttaatatagattgcaaataaaatattaggctattggccaatataagcatcgcaataagcgaaatataggaaaaatgatgaaaagtatattagtaatactaatcataaaacaaactaaataatactccacgctttgatgcagaatatatggatgaatatatgttaagtattataaaagtgatgatagattcgttaaaatattatgaacatgatatgagaggtgatgattagatatgtttgcatgttaatttgtagaattcaataaattaagatgatattgcattcttgcatgagttttttgataaataattattactagtggatgataaattgatgatgtggtatatttacatattgagctttaaatttagtggcttgtaatttttataaaaggtatagataaatatggaagtttatgcactagtgaagacagattgtgccagcgaatgcaggttttcgatcataaaggtcctccaagaaaaaggtttttataaactcgattacctaaagattataattaagcttactcagcatatcaaaaggaagtacaatacgtgcttccaagaacactactacataaacgatttttctgtataagaatcctatagtttgcagagggaccgtatctggtcccatttaagaaaattgacttgcatttttgcagattttttttaagaattaatattattttaatggaaaatcgcaaaagtagaggccatccagggaaatcgcgaatttagaggcctgtcgaactggtgtagttcgataggcccctatcgaacggtgagcgttcgactggaccctgtcgatgtgcctatcgaacagagggagttcgacagggcccaccacccggcgccgcgcggcctgtcgaacagggagcgttcgataggtccctccaccgcccctatcgaacaatgggctttcgacaggcccttttaaaccgcgtgcgcctaggccgcgttgcttcttcgtttttctctagaccacatcgccagccgccgccgagagtcgccactgtgtcgctgtcggcgccggagggagtaaggggaggggctagcaggccggagaggaggcgccggccgggaggaaagggttggcgacggcctccaccagtgaagttaaggtatacattactaatccctaagtacgaggcatatgaaagtttaataaaaaatggcttgtgatttgttaattgtttcgcattgttcaatgttagtacatatgatttgttagcatttgtcattgctaaatattagtagagatatttaagtaatcgtatggttaaattagttgttagttaatacatgttattaatttgttgtgtgctaaaataggtagaaggtactatattttatttggattattaaagtagttgtttgtcaataatagttgtaagttagtacatggcaatgtagtataaattgtaatagggtaattatcgaaggcttaaatgattaaacgttagacaatttgtcatgttttatcaggatgtcaggtgaaatgcccattcgtctgtattacggtgatgctcctatacaaatatgtgatagcggggtggatttgactgtatatgacttccatgatactagtctgaatgcactcgagcatatgggtttgaacgacgtgttagggtggttgtataatatgtttgggggtagatccagtgctcgataaatttgtcttaaaagccgtgtgatcaataagggttcaacatggatggcagtggagagtagtggaggttgcatcaactgggagttggaggaagtttgttagtaaagtaagggagaaacggtatagcctagtaaagtaagggagaaacggtatagcctggcaatactaatgcagaagacaacatgtgttgatcgatcgggggagtcaagtcatgccatggtggaagaaactccattggaaggtgcacaagcgaaaaatgtttggcggattgagcaggtcgaggggaagaagtagtagagggtaatacacaagcagaggtcattgttcgtgacaataatcgtgaggccgacgactcggacgacgaagaaccggattcgcctatgcgtgttgacgtagcggaggagaatgaggcagtagtggatcagatggcagtggaaaatgaggaatacattgcacttgtagtggaaggagaagatacaacactgtgggacaacgaaaccaacatacccgatgattagatgaccatatcgatgagtcgtatgaatattaacgatggtttagatgcccactggtgttatgatagtaagcaggtgcaagttggacatatgtttcatgacaaaggtcacttacaagatgcggtgaagaggtggacatttgaccagaagcgtgagtttggggtgaaggtttcaactaggacgacgtacgacgtgaagtgcacacaggctggatatccttggagagtgcatggttacaagccacaacatgacaatttatgggtagcttcaagggttgagcaacatatgtgtttgttggagaatacccgtccggtacacaggaacatgactgcggcatttgtggcacaaatggatattcaaaggtggttagaaaaacatctttgtcccctttcacaataatacatgacatagagaaaaagtatggatatgagatatcgtacgacaaggcttggagggcaaaacaaaaagcactggaaatgaggtttggaacttatgaagattcttatcccaatcttcccccactattggaggtgatgcaggcaagaaacccgggcacacacatggctattctcgacgaggtgaatgaaaatggggagaatgttcttcgtcgggctttctggtcatttgggtgtatgatagaggccttcagaaattgcattcctttgctttgtgttgatggtactaggcaagtacagaggaacaattctaatcgcgatcggagtcgatgcggatagccatgtcgttgctgttgcttttgcatttgttgaaagcgagaacacatcaagctggctttggtttttgcggcacattaaattgtgtgttgttcgaaatagaccaaatgtttgtgttctgcatgaccgacacgccggttcaatatttttaatcaatgtgcaacttgttcaatactcttaataaatgtgcaactacttcaataattttaattgccttgcttattgtggaataggcggaatttgttgagcacgttcaagtagagttcgacaccctgttgcaaagactagagacgagacctccagtcgtcaggcctgacgatgtggcgagcgtccttcgcaacttccgtgcctgtgctgccgcactactttgtcgtgtctcctgcgggagcgcagcagatgtggtgcagctgtcggcctgtagggcatcaccaccactaccccgttgttccagcgtggatcacagtggtctatccacgttacgttgcgggtacgaagcagcccacacatctcacagtcgtccttcctttcagcacaccccagcactggagtacaccagggggtcagctggatcaggggtacccacatcgagcacggcacagccacgtccgcaggtattccaaactccgccttatgttcaccccacccagggagcatctgggttggcacacctcccttacatgccaacaggggacaacgtgttgaacacaccggcatggggacttcatgtcactccgcgtgcgctagatcaaggccacacacagcacacatgtaagtcattttaaacaataacacgctttagtttctaattatatgtatcattactaagtatgccatttttggtttctccctcttatgcaaacagatgatgagtactcccctcgcacagcattcattgaggacttcttttccactgagcctcctcaaggggaagcagggatggattattggcacgcagcacctcaggtcacacagccgacacaggagacaaaggccgttcaggcacccgaggtgacaccacagcagacagcaagagagaggcaccccccgatattttgacatatcccactgagcagattagacgtaggaagaagggggacctagcaagcgtgcgaagggaattgatcgcccttgacttatctatttgtattaaaatttgagacatttatgttttatccctactatttgtcaacactttattattaacttagttattatcattactgtttcataatctttttcagatgaattcattttttgcatacccttccaatgaatcaggacaaatgattcgcttcgaactttgcggcgcactataggacaggtgcataaatgcatgcacgtggtgtgctatctactttcggtgcacatgtccctttgtggtccaccccatttttcaactttatcaactgcagagttatgaaagcgaccatgcgagagctcgactagtcgtgatcacctttcagtatagactgctcgctcgtgcccgtcaagtctatccacacatcaaccctatcttcaccggtacgcttcctgcagttgttacggcactataaatacataccttgaccaaacaagagctcatcaagtcctttcctctttacatttcccattgtcttcagcatcaagttcaacacaatggaagctccattctgcgagcatttagactggcggagagatccactcgcaggtaggggtggaaacaagccgagacgagcctggcttggctcggctcgtgaaagcttggtgcaagggaagctcggcttggcttggctcgctacaaacaacgagctaaaactgcagctcggctcggctcatttatgggctcgagctggctcgcgagcctggcatcaagtaaatctcaagcaggtctaagagaaatggagcaacattttaccacatagaatgtgtaataaagtgatatttttctttaatatgtcatcacaacacataaatagataatatgacaatcaaaattattattttcaacaaataaatagttagaaaaggtgtaaaacttgtgcatatgacactattgtactgagccaagcgagctcacgagcggctcgtgagccggctcggccttggcttgtttcagaaacgagctaggaaggaggcttgggcttggctcgtttggctttcaagccgagccgaactatgtgagcccgagccaagcctgagccgagctcacgagcccaagctttttgtccacccctactcgcaggtctatttccaccatggtgccaccgtccaatcttgcccttggccgtgatcaatggtttacttcatgacatcacttactactgaaatccacggtaggagatttttccaatgcccaaacatttaccagggaactgttcaatccattgttatctctacatttgcacatgtttaatacatacatcgctaaccacatgtctacaatatctcgaattttcagacttaccatagtttatgcgacttcgttgagtgggttgatacgatgaatccacaacgtgacagggcacgcccatatccatgcagcgaaccattatcggactacctaaggaggaaggatgagtacgaacgatgaaaaactgccaaatccttacaatggcaagtaaatccactgggactccccacttgacgggagcgtccagagtgtaggtgtggagaccgttgccaggtgataaggtccgttcgacaacgaactctaggacagagatgcttcgtgtgtcctaacattgtcgacgatgattttgttgtaagtaccactaatttttcactcactctcattacttctgtcatatacctacatatgccaacggtcattaatttctgcacacaggaagaagaccgcaaatgtagctatgtaaagtggattgatacgacgataactcaacctaagacaaccacacaattcattcaagcgtggatggagtacgagcgccaggtttagtccgctagcttacactggagatcaaatccattaggtatacctgaatggtctgatcatcccaaatgcagttgtagagatcgctgccaggttgcaacgtccttctcacaagatacatatggcaggcggtacttcgtctgtcccaacatagacgacaacttcgttgtatgtcacatgcttaattattaatttacattttgcttcgcgttcccataacatttatttcccattatctaatttgattgattgttcaggggaatccaaggatgtgtgcttttacttcatggatcgacatggtcagcccgacgtatgaaggcggaagagtaactaaagctgaaacgcaaacataatataagagattgaaggatcacgaagttgcattacacacacaacgacgtagaaggggtcaatagagaagcttaacccctaatcgctctagttcggccttttgttatgttatgtttgtaacatacccaagcctgtaaacctgagaactaaatttaatttaaatgcatcatgtggttgtggagtggttttaattgtttttggatcttaatcatctcatcatatgcatcttgataggcctagagtcacaaaaacaattaatctggtaattatatgcatccaaaacttccacaaaaattctcaaaaaaaaaaaccttgatatgtcagaaatcaacccacaaattttcagagtttttcagtaaggtttgctaacttgttgatctcctttaatctctccaaaatcctgaaaagaactgcttagtagattcaaacttgctctctctgtaaaatttatttcaaaacctctttttgaagtttggtttcagccaaagtcttctactaactttcttctaacaccctgaggagtggcacaccctggatcactctctaaccctttcttctctccctccaaaaatccaatcagctgctaacttgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttccttttttttttccttcctttttctctattgggccgtcggcccagtccactccacccgtcgcccgcgctcggcctccccttgtgggccggcccgttctccttcctcctctctccgggacgctgacaggtggggcccacctgtcaggtcgtccccttcctccagccacccgcctctgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgaccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgctacaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttcccctagggtgtcgccgccgcccgtccgtgcctccgcgtcgccggtcatcgccgctcgtctcttcccacgccggtcgccgccatcgcctcggtgaggaatcacctttcctccttcctttcctctcccccgtgagcgccgccgccctccgcgcgtgcgtcgtcgtcttcggctgccgccgccgccttcgcgccggtcgccgccgtctccccgcgccgccggtcaccgccggcggtcgtgcgccgtcgtcgcctcgccatggccggccggctcgagccgtgccaagccaacagccacgcccctctcccgccctgtgccgctgcccggtggggcccaccagccggtggaccacccctccctctccccttgtgccgctgccagtggggcccgcttgccagccgccccctctccctctcttagtgtcgctgaccagtggggcccgcatgtcggcgccgccccctcccctcgctgacgtcagccctggggcaataattgcgcaataattaattaaggacttttctttattagtaaaaacacagtttatcttctaaaaatcataagtaaatcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgtgatctcatcagtgcgagagaaaggcaagtcatgcaatacgtttgatcatattgtacccaatttacaaatatcccgcatttctattaaatgtgcattcttttacaatatcatgtgggatgggtcctaatactcagccatttattgtttaccttatgccattgataacctgggtatcaaaatgactagatgttggttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccagttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagctgttttactgcttccaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacataactgcactgtcaactgctgctaaccaacactgtcaatacatgttcatcactccatcaaacctaaaccagagacttctaacccaatccacttcagcacatttactctccacatcacccctgaccaagaggatatctagcccagatttcttgctgcacaaaatccaccttgaatcccctccaaagatccttggcaggcaaccctctttgacagcctccaaggctattttcgaatttctttcactgacagtgggccccacaccctctgggacccacatgacagcctcccactctcccctcacagcatccaccgtcccccatgcccaatggatgcccaaggaacacaatgaaagcaccagcgacctctctctctctcactcccccactccactcttccttatatcccatgccaaagcaccagaagcaacagcacactccccacatcgcgttccaagtccaagaaaacacaccccacgcacagaatgcccagagctcggccgtcttacccggctccggcgacttagccgttgtcgccgtgcatccctggtgagttcctctctcttccctcctatggaatgtgacctacgcatcacgctgagctcacccgtaccccttttgccctaggaccaatctgtcgagcacgtggtgggcgtcaccgtcctcgccgccggccacccgaaccgccgacaccgctccggccgccgttcctcaccaccgaagcaacaccaagctccggtgagtttccgccggattcctcgtgcatgcaccctctgtggctcatctctaacacccccgtactctcgaagttgcagttcgcgccttgagttgacccggcgacgccgacgccggagttttaccgccgttggccaacaaccaccacctcctccgctccctggacctcgctgcctccgtttctctgcttggtgagcaccctggtaccatatgagagcacatgcactaaccctttgcactaaccaagcctctgcatacacatgcatgggcataccgagacacaccgccacttatcggaacttcctatggtttgtgatatgatgaaattgattaatgatatgtggtatgtgatgattttagcgggtagtctatccaatacaacggtgtcgtgcctcgtgaggtattccgggctgggttccttacggcgctaggttaaagcgtgggcccgctacctagtggcgctaccttgctagtagcgtgggtaaaacacacatcgtgctggtgcaaggctagacaataaacaatgtaacggttccgttatgacctctagatcacactcaatgtgtagagtgtggtgataccgacgggtatcggaaaaactagagcgatccatatcatgtgggcttaaaagttgtacaaactctgcagagtctaaaactaatcgattagccgtgctcacggtcatgagcggcatggtgaagtgtcatgagtataatttgtgattttgataaactcttgtgaacctggaaaatggttggaatgttttgtttgtgaacttgggtaaagttcggtgaatggtgatgagatgatggagagtggtgatgatctaccttgaggggtagatgtgtattatttattcattcacattacaagttttacttactctatactattgttataaaattccgttgcgaaacatgttgtgaactaaaattggcatttatgcaaattaacctatacacagcttatccttgaatatggccaacatgtagtatgctaggattgtttccgacttgccagtacattaatttgattaatgtactgatttcttgctttctattacttgtttatgctcggaccccgctgcaggtaatgactgtttggatgaggagtttgatgcagcttgtgatgttgcagatttctaggatggttctaactagggatttatcctagtcggtttgcctatgggcttttgggtagcacgcttaccgcatgaaccaatatttatggcttgtcaccaagtactacttagaaccttattaagattatttatgcttattgcttagaaccacttattatttggatatcatgcttgagatgatttatgtgagactatgttgcattcctgggcaactagtcccacatgaggatgggtttgaaatggttgagataaccggggaatatgcctttgttgagatcgagtctctggggtacgcttttggtcgccaccattgagtggttgacgggcgtatgacatagatgactagtgtggctattccaatggttgtgtcttctatttcatatctgatggcttagagcctatgtagtgcactcttcaagacatgtcggggtctgtgatgaggttggatggttaccgtatttatttgggctttatttgagaccccatccatctagatatttcgcgctgacatgccttggagcgttgcaccacctaggctttgggacgtcctcacaatgttgttgtatgcctcatgaatggattatgtttatctatgtgttagctaatgtttcattctctttttcatctattaagctcatttgtgcatccgctgcaatctcttcgatcccctcctattctttatccgtccttactaaataaattgcgacaaagccatgaaaccaaaaatatatacaaataatgaaactaaataatccaaatattttaaccaacaaataaatactacaatttcccataaaatatattaaataaacaaataaatactaatatttcccaccatacattatcaaaaccctaaaccctatacatgaaacattaaaataatctttccttccttacacataaaatattacaataatgaaacaaacaacatattattaaaaaaaaatgggcgagtggaccagtcgaacaaccgttgttcgacagcttagcctgtcgaactggtggtattcgacaggggcctgtcgcactgcccctgttcgacagcccaccctatcgaaatgcccctgttcgacaggccccgtcgaaatgccactgtttgacatgccctgttgaactgcagccgtttgatcgccttttcaatcacgcgccggccgttcgatatgtgccctatcgaactacacccgttcgacaggcccctatattcgcgatttcccccggttggccactacttttgcgattttccattaaaataatattagttctaaaaaaattccatttttgcatacggttgcttaaaacgttcgtatacaaaaattaattttcacaggcggacctcttaacatcccgcatgcaaaaatgagtccattttcacatacaggtctcttaaatagattttcacatgcgggctacatggagagcacttgggcccacacattttccgcaccatttttctccttctcctctttctctgcaccacacctttttttctttctcttctctccacgccataactcctctcccactccctctcccttcccccccttctcttctccggcggccgaagcggtggtagctggagcgagtggtctgcggtgggctcgaatgggagactggcggaggagcggcgcatcgacggtggcagccttccccccacgcagatccatcggcgggctcgagtgggagaccagcggaggagcagcgcatcgacggcggcagccttcctcccacgcggatccggcagcgatggcccccctccctcatggatctagcggtcccctctctcacgtgtgtggcaggcagcaaggtggacgacgatgagcatgacaaaggtggtggtggcggcaacgacgacatcagcttggggctagggtttttgggtggtggcaggctagggtttcggctagtttggaccgcatgtgaagatgagatgttcgcatgtggttgcgctgcccacatgaaaaaaatactgttcacagacatctaggtgcatgcgggccacccaatctcatgcgaaaagtccgattgcaaaattgatttctgtactagtggtacgccacactctgttttgtttcatatcccatgaatttcagtgtatatatttttgcggaaaaattcaatgaattttttgagagaaaggttcaacttatatgatgatgaccctatcgaaatagacacgctactaaaagagaacgtgctggttaactcaaatggacgacgcactacagatggtcctgattcttttatatgttttccccattgaattcgatcggctggcgaagtgaggtcggttcggtgtggtggaggcctcatgctaccacttttggatagaggtaactgagatggtggatggtggataaggatcgtatcgggttcaggtgtaaccgtgtaagtctagactggcgaatcattgggccgatagtggtgatgcctatgggttaccataacccccggacgttgtcgaggtgcctccctcctgcttctcttgacataaatctctatgggcaaccatatctaggttcctatatgagcagcgacggtatatttggcctcataacctccatggagacattgtttttgaagactttgtcttgtggtgcggtgttggcattggcggtgattggccacgtatagcagcggtgaggttggtgctaggttccccgtcttacaggcttgtgttttgtgaggttagcacgtgctttctgggcgtacgctccggtgcacggacaacctcgacaggcttctattgttgtaattaaaaattttcttgtaatcttaataccattggatagtctcttcttatgccatcccagctaaaaaacatgaaattttaagcgaaattaatttgaatataatatttctagattgatatccttcttgaataattttgaatttgtttgtttttagattgatatccttatagaataattttgaatttgtttgtttttagattgatatctttctagaataattttgaattttacccaagttcatgggttaggcgcccggtttaattagggtgttggacaaacttttattcgaagtttgaaaagatattattactgttcataaatgctctcacatagggctattgcaaccacccactcgggagctagggaggaaaatggtctgaaacgatcgcaaaatagcctcaaccatttccataaccttatttttcttggaaacaaaatcaaatacggtaaagtcggaaacaaaaactatatcggaattattggaaaaccagaaacgaaacaatacatacggaaacatgtcggtgcagatcgtaaaccggtaacaaatacggaaacattaaactatgaaaacatatatttaactttacataagtatgttatatgtataaataaattcaaacttatactatataaattataaattaacttcattttaaccatgcactcaagttagggatttgattaaagagtccgtcaatctctaaattatgggtcaagtagagacatgccctataaatcatatttagaaatacggtaattaccatattataagaaacggtaatttccataagaatacgtaaatacagaaacgatcggtataacagcaaaaccatttccgtttccatatggctcgcccttaccggaaacaaacgtcggttggccgggaattaccatgaccgttttcaccccccccccccacccccccggttttcacccctatcgggagtagttgtggttctctgaatgaatgaagcttcggttatattctgttagtcttaaaatatatcaatctcgattaaatataaattcagatttatagtatatttaatctatattgatatattcaaagatggagggactagttctgaaaaatacaccagtactgaaatgtgaactgaaaacacagactgtgaatgcagcctctttggacttatcatttgcagggttgcgtgcctttcggtcgctgccagagatagtatgtctgactgatgtcacattgtgtacgtaaaagcaatgcaacgaggacagacaaggactgcgccatcatgttgccactttcttgacacaacagaatgggaagctcattcaccgtacaatctctcataaaaagtcttattactaactgaactcatggcatgacattacagctacagaagactggtggcaactggcaactgaacatcaaacaagtccaactatcatatctactgatgaattgatctcaacttccattgcgcagcccagcgaaaagaaaaaaaaacttccattgcgcagtgaaatttcaggttaattagaaacaattagtagtgatcactcagttctgacaaaatccctttgctagagcagaagacacaactttcacaatgtaatcattttgatgattacatttctctttgcctctcaattcctgatgcaaggcactttccataattcttacaatttcccttacaattttgccataccacaggatcacataaagaaaatttgtttggcaaagagaactcgatgcttatgtttctagatgcagacaatgacatatgtttcacatccattcccatttttacctattctacatttctttttgccatccatcctaacatcctatgctaacatcaaggatagacaagcctcttagattcagaaggggagctgatattttgctgtttctgggctcctgccacccattctttgagccaatccaaacaccgaatccaagtgtctgcactcatcaaccatgtcctatgcataattttgccgccaaatgtactcctgagtcttatttctcaatgacatgtgttgttaattctggagttaggtctctttattacgcacaaaatcttcgtctctgtgtaaggagagtcaatgc

SEQ ID NO: 26176 - DNA, 1563 bp, Oryza sativa
aaggttatgacattttttttttatcaggaggctatgacaattttcacaagcaccgtaatatagaagactataagaagattctgacctaccttgatttttgtaaaaagagataaaattcaaggtgccgtgcatatattttctatctatcttaccagtgggcttgcctcttttgaaacacttaaaataatagtattcagtttgtagtttggtactgagtttaataatctaaattctatgctattgacagtaaatatttaggcacgataaagagttattcatattcatatactatgaaatagtttctggattttgaaaatagagataagactcagacagaaaataatgtgatcatcttaccttctttgtgcgttcgagatcagattcgatacattttatcctatcccaagattccaagagggagcgctctttctccaagggaatctctggtggcttgttgccaagctcatcgaccttaccctcgagcctctgaagccgctcgatgacaggactgatgcggtctacactgaaagtctccactgctggatgatcatcagaagttggttcaggctcagctggaggcaatggattgtcaacccgcatctcctgctgaccatatgctatgtggaagaaggcaaaaacttttataatcaaggccagcagtaatctgaagaaacggcggaaaaatccttcatccgtgttctctttaggtacgactgttcggcttctgttgctcgaggaaataccgcctctgttgcttgaggaacctatacaaacaaaaaacactgaacagactactcgaagcaaatagttaagaatggttctaaggaagaactaaggtctaagaatagtaagttcaatagcttgttctttcattaatgcatagggatgtttcaagaaacattaatgcatagggataagtataatgctgtccttgcttaacacagacataatattcacaagggaaagcttatccataagaattacaaaggtgaatagaatcttgtaaggggagaataaaaaaaaaacagatttgctgaattacataaaatgacatatgaagactataaataaacatacccgttgcatatgatgttgtgctacctccaaaaggccgagcttgagctcttacttctggggcactagttttatcaggcatcgctcctcctctaccatagtcaacagttttgtctaccacaacaaagtgatcatcgcagctgtagtaagctgcagagtctcgtgctctgatctgcatctgtgtagaatataagagatttcgtaaacactaagaaaataatttgcatgggcacatgaataaacaagttcatgctacaactgaataagggaaaagcttacttcttcacgaactggagctaatcgactacattccactggccttctcatcattggagaactgagatcatcaacatctgaacccgactccactgttgatgtgtcactgcttctaccctgtcatgagtacatgaaaaaaaaaacgctattaattgtcaatgtgaactggttcatggagagcacaatgccttcattcatgttttagaatattca

SEQ ID NO: 26177 - DNA, 1000 bp, Oryza sativa
ggttggtcaagcccgcaaaacatttaccggtgggcctaacactccccgcaggtacattgcttcatcccattgctcccataggcttttagttttttttttttttggcaaaaagtcgagacaaaaagttatatgccctaatggcatgtggatgtcatgtaattactaaatttttagcatgctgaatatataacatggatatgttgctttggattaatatcactgtcttctcaaaaattaggtgccattctgttcgttttttgtatggagtatgacaagtatataaaatagttgtatggagtaggacaggtatataaattaggtgccattctctttttttttatggagttgtacaagtatattttttgggatatcttgccgtgctgtgtactctgtgtggctgctacatcctctatacaattgctccagagactagccagagcttaaaagaggcacacagtaaaatcaggggagagactatattcgttaataatctaatcatatgtgctgtaattatcgttgcgccttagacctattgcaactttggcttgaggagtctaagatttcgacaactgatgtatacaagagctgaaagtgaatgttgtatgtaaaaagacgtacccgttttttcttatgttggcttgtgcccgtcgtcgctgcatgaaattgttttcgtttgctccccgtcggcggctcgtaatttggcctcatcttgttatttatttcgtaatttttgtccagaacatgtgaacaaacccagaactgtctcctatatatatatatatatatatatatatatatatatatatatatatatatatatatatatatatatatatatatatatatatgtatgtatgtatatatgtatgtatgtatatgttacatgtggattaagctcggtatgtaataataggagatcaattaggtctaaaaaataacatataattcggcaggaataaataacagataattcgaaacaaatcaattcggttagagaacg

SEQ ID NO: 26178 - DNA, 10252 bp, Oryza sativa
  unsure (1)..(10252): unsure at all n locations
cgatcgatttgtgagtaatttttctctaacagcagagtgatctcctaaaaggttaatgttgctttcggagcagagtgtgaaccatcagaatagtcggaggaatgatggcaaagtttcagctgtttcttggggggggggggggccaataacggacatgatacaaaaattcagacaatttttattttcatttcaaaccattttcgtaacttgtggagatgcttccctctttggtatgacaacacaattctgttgctctgagctaaatagctaatagcatggtattgcatttgggcagtgccaaatcctaggctaattttggcataccaaaacttgcttctaggtttcgctattatttaggagtctgattttggtaagggttacttaattattggcttcagtccaaataattgaaagtgctattgtagttgtccaaaaatttagtagggaacattttggttgtgatccaaaatgccccttatttaccaaaaagtgattaaatttttcatttcgaatcaaaggggcagctaagtccctgtttagaagagctcttgatattaattttccttatcccaactcctaatcttcaaggaattatatcctcaaataatcaggaccagatgtacaactatttggctatcagatttataccagatcctcaaggacaggattaaaaggaattggccataattggatgaatgaaatttttagaactatagataatgtgaggaactaatattgtaaaacagatggtttagactgaaatttattacaaaacttaaatatcatggcattgaaaaacacagatttaacgccttggcatgtacctcactagctaaatgtaggagctataagtagttgttgcctcacatctataacactaccttgcactatactcccttggtaaaaaaacacttttggatttgaatatggacgtagcatatgtccagattcaaatccagaaaatgttccttttttttaacagatagagtatatgcttgcgggtggcacccttgtcatgcactggtgcattggcacacccttgcatgagagaaaatataagaagaggtatagatggagtgctaactccaagagtgttacatttatttagggataaggtgagaggagaataaaggaaagaaggagagggtgagccactcttatacaagaagtaaggaaagagaaatagtggtttaaaatgaataaaataaaattatttgcacctaaatctaacatattacatctactgctaagcgagataacagccatcgtcatctccaagagaggtgccacatttggttacccaaatctccatttaaccatccatgccaaaagatttccacctattattgtgccttcgaatatgttgtttcttcatcgccattcaaccattcgtctccctattgttttcctaccttccccgtagtaaaccaagacataggtgaacttaggatatctagttgtgtctctaggacaatgttgccctgccctctttccaccaataccttggacctccttcaattctctagtgatgaagacttttgcctcgatggtgttccctctggctacaaagatcaattctcctccctctttccgtcattgctgcctgtagaacttcgagaggaggtgggcgaggtcagagttgagcaggcgcctgggaaggatgcactgaagtcaagctacatggtgttgagaaggagtcttccaagcttgagaccaacacgtacgcagatcaggactgaacctagagacggtagagcagctcgtttcggtagggaggtagcaatgctgataaggagaggccgagagggagaaggcgcgtgacgcagttcagcttagcgaggaagtagtggtgcttctcggctcgacaaaaaggcagtaatgttcatgtgggatgagtggcagcaacgaccaggggcggatccagcacgggtgcggcggggtctcgagactccactactaccgtgaagactatgagagaccccacgaaggccccactaaaaatttttatcatatgtagatggaaggggggactgtaactttatctagtttgctcagaccctactgctatttctttttggatccgccactggcaacgacgcaggtgggagagctgattctgcttctactactggcatgagacagagtgcaagagttagttatcgaggatagctagtcatacggcatgtcaaatttggtcaaccgctcctctcgtttagccagccggataagataaaattgtaaatagccactctgttgaaacccatccttttacatgtttactcttttctaatagagagtgatatagccaatctcttagagatgctcttaaacttgctatatgagcaaggtcaggcccaatacaatgcaaggccattcatatcaatatccaatttttttaaaaaaaatagaatagattatataatatgttatacatatgtatatgaaaaataaaaaagaagaccgtattcaacacatcataataaacaaataaataagtaatatatgatattatacatttcaaatattagtatattagctctaaaaaaattgcccctttacattttcgttatacaaccttagaatcctagctctgacgcttatatgagcatatacttagagcaattactataaggttcagatgctacgtacctctattaagagtaccacataatattagatgatgaggtggaggagagaagtgaggaagaagaatgagtcaccccttattcaaggggcaacctccacataaacaccaaaaaaaagtgcaaagagagagtgagatagtgtgagagtgaaccaacaaaaaaatatattagggtttgggtattagagacaatatcattactaaaaaaacgattttttatggtgttggtctatgattttcgctggcggaaaaataccaaaaccgccagcaaaattgtaacgagggagtaaggggcatcgacggctagcgaaaatggatctttgacggtgcccgcgttataccagccgccaacaaaaatatgtctattttcactggcggtcacttaagtgcgccgccagcgaacatggataattttcgctggcggttgtgttatacaaaccggtagggaaaatacagttattttttctggcggcccacttaagcaaccgccagcgaaaatagattttcgttggcggtagaaggaccgcttgcatagatggaccaccatctattaatatggaccacgcggcccaccaccaccaccaccaccaccaccagtccaccacccacccgccccctctctccagctcccctccctcccttctctccctcgcaactctcctccctctcttctccaccgtcgccatccatcctcaccaaccagcctctcctcttctctacccccaccagcactctctcctcctcccaccccacagtaggcggcggcggtttcggcgtggcgatgacgacgcgaggtgggcacgcggcggcgacagtaggcgcggctctcgggcgcctgcgggcagcggctcgcggggaggccggatccgccgccgccggaccacggggagggcggcactgacctcgacaccattgaccgtgctcccgctgctagatttgattttttttttctttttctttttctttttgcatgttgttctagatgatgcgcatgttttgatctgtgtaaatgatgtttgatctgtgttgatgatgattttgtatttcgtgtttaaatttggaaataagcagcgaatctagatgtggatttgaaatttgaaatcaatgaatcaatgggcggctgcatgggtatttacgttggcggctgtgcagctgcatgggtttttttttgggctcaatataaattttcactggcggccgatttaacactgtcttaagcaaacggcagcgaaaatggatttttgctggcggctggcttaagacgaccgccaacgaaaatggatttttgctggcggtcaataaccgctagcgaagatcttgatcttcactggcctttactttgtggcggctgcaaattccaccagcaaaaatctaaaatagccgccacgaaaaatagttttcgtagtaatgtatattatacaaattatctcttaattaataagtatatgacatggctaaaaaggtggcagtcatccctactataaaacttactcttaaaggttactctctccttttctcttctctctcagagttgctgcgtatctgttgcccttgccctaactaatagtagcagcagtaggcatcatctctagctagctagggagacaagcgattatgttaccaacctgaatgtccccggcggccctcccctttcccatccgatcaaaccaaagtgctccagtaattcctgacaataaagcgtaaagccactaataagaaacactccaatgcaagtagtaggcccagatttcctgaagaagcacacaccaatattcaagagaaagatgcatagtactctttaatttgtaaatcaagtattggtggcccctcttattacactgacatatctatatatgttttaggcttagaccatgcagattatcttcatatttttttagttggctttattcttagtccttgatactttcgtaggagaagcaatactatgctccgtgaagctacacttttaaaattggtagccagcgatcttttattctattttggatggcgtagtttctataaaataatgttataaattctacatgttttatattcagtattttagttggatatcatcagagtgagatggagtttgttccatgaccacgtggtttttatgtatctcttctcttgactcgttgaccgtgtgtctgttgatagagttcggggatgtaaattatttcccttattaagaataaattttaggtttaaacacagatactaagtaagcagatgaaaattaaaataagagaagaaaatgtaggtagagaaattatcatattttagaataaatttaaatgttaccaaaattatattgtagggcggataaaatatgaagcatgtatttagagcaagtttaatagtatagccaactgctagctacaaatcatctatagctaatgtaataactaattcatacattagttgcttactatactattaatatctggtcctacctatcatacacacattacgtcttggagtccgtactgcagctgggctacagatctgtagcctgctgctcctcccttttcctttatctttttaaaatatgtttataactggtttatagtctgctattgtatctgctcttaaatacgtatgtattcgtgtacaatagtatacttaagtaggtggagagagagacgacagagcacgcggaatgatagcccgatgatcatgcgcggccaaagcgagcgaatcgatccgagagaaagcagaatgaaataggcaggcagcatacagcagcaaaggcaacaacaatatatatactgtatgagagaaaaagaagggaaaaagattgtgggcgcggcgtacgagaggaggagaggcctgacgccgggaaacaggtcctcctgccggcgggacgacgtaccagtgcactgcagcgcggcaggcagagcgcgtagccaacgcccgcccaacagtggtgttgtgcctggctactgctggctttgctggattttccaccttttggtccttttacaaaaacttattctataaatgaatccaaaaaaacatattctaaaaatgatcatttttgcggtgccaacaatggtcatgatagcgccaatgacattggcactgtccccttcatccctcggtgaaagctaactcactaatgtgaagggaatagcgtaaatgttgttagcgtcgatgacctatttgaaaaataaataaaaaaggacatatttgtaaaaaatggacctatttgaaataattttttttattacaaataggtccttggcacagaatgacagtcactgaggacttatttgtaaatttttattataaacaggtcctttttcaaaaaattacaaattggtcctctgaattagcttccactgaggggctatggggatggtgccaacatcattggcgctatcatgttaggacaaggcgctacgatgttggtgtcacaaaaaggatcatttctaaaatatttttttaaaagataattatcactgtatgagtactaattactcgtatcacaaaatcacttcaatttttttcatattctaccctcaaccgtctttccactcttacctattgtcatggtcgacatcacatatcaatgcaggaggtccgaaacacaccgtgacgcggttggctggaagattgcggcggcaggtgcgtcacaggaagctgagtagcgtgtgtcggacggctacagtacaaggcttgcagattgataagattagcttgagtccgaattttattagcaatcatgttgagatttgtaagcatatttaaaggcaacatctatctatctattaattattatatactaaaaagtccattaaacttcctacaaacgctcttaagccatcatgtgtactcctacaaatacttctaaaccgccacatggcactttaacaaaccagtgggcctaataattttatctattataattttattgaaaaaaacccagtccccccctcccctctcctctcctcccaccatgggtcactaaaagtccattaaacttcctacaaacgctcttaaactgtcacgtgtactcctacaaatactcctaaaccgccacatgacactttaacaaaacaatgtgtctaataattttatctattataattttattgaaaaaaacccatacccccctctcctctcctcccaccatgcgcccaccctttcactagacgtgcttcctccctcccctcctatccaatctcttctttttttatttagttattaaaatttttgaacaataataaatcttaaataaccaaaattttcctatagttatttgttgttgtccattaacaattaaaaaaatataaggtgttctttaacctataagaaatataaaatttttatcgtatcctaaactttgcatatcacttagaattgttatgtaaattagggaaaaattgataatgtagattatacgatcaatttacaaaatatgcataaataaattaagttagatctattattataacaaaaataagaatacgtccatccgtacatgcttcatcttcccctcctatccaatctctctttttttttcctttagttattaaagctcctaaacaataataaatcttaaataaccatatttttttccatattacgttagatcttagtcacaaaataatctaattgtgattaacatcccaaaacataatacctccgttctaaaataccagtatgtttgttgatgaccaaatttggtagctccatgagttggattcgaagttggaaacgaagccgattttggaaaaaagcctgttcgggaaggctaactacgaacggcatcggctgccgctcaaatcggctacgttgatattggctgagtactgggcatgatgtaatcaaaccgacgccgccaatcttgggaaagtggccccgcaatcgtcattgggtgggattaaagctagtcattgggtgggattaaagaccttcatagctattgccacacaaggataggagtcctaagagaggcaattgtatctattaattaggacatttttcttgtttccttagagatattttggtaagggcccacctaaagggatcgttcgtattttaaattatgttagagataagagtcgtgtccagaaaggacttaccatgtactttgggtataaatatagcccgaccccatgtaatcaaacaacgtcagttcaatacacttcagcgcatcgccacccttttacttttcattgttcttttcgacgagtttttgctttcgagttgggctgcatcaggttcgatctccgacaaaaaggtatatcttgtcatggcggcttgcgctctcaggatcagtgcttacatcttcatgacactctaatcacatcttcgcaagctttcgagttatcatatttattgcataatctagatcgatctcgttatctgagcttcatcggctagcctctatcatggaaaatggccgataggctcagccttcgactttgatttaaattatgcggtatatctgccatcttgaatgagctttcatcggttcgattagatcttctgccactcttcacgcttaatgttgcatcggttaggttcgatctattaagtactgtcctgaggccttttatctaatctattctttgactgctaatagagatagtgtcggggtttcagctgatcttacctgatttagtcgttttatcttccttcttggttctaaatcgtctagatttaccccttatatgaagatcccatcctcttgaagtagatcaagctccctagtctctagattaggtcaagcttcctatatttcatttgtgctggtatcttggtataaggtggtatcggagtattagccgatacagattgggttcgctccatcggctatgctatgagcacgcacaatctcttctttggagcatgtttagatatggagcgatttatattgtctcggtgccaacaccgatctatcccagtcgctcgatctaagcatgccccatctaatggattacatgccgctgatatctacagccaatcgagtacaccgaacaatctccaagtttttacttgcctacgccgatccaacttaagttgcatcggcgtggcccccaacaatatgtcatcggcagacctgtcgataggctatcgttgatggatttaactctttgttgtttcatgtcttgttggttgcaagatcaaaccatctggcacgctcaggacccgaaggcaaatttcccggacctgcactgtaattaagcagatctcctaggcaacaatgttaaaataacattacctttattaaacaaaataatgttgattaaataatacataaaaatattttgacatcatttatatctgtaataattaaagtaatcaacaataccataaaataaaatactcttattatgattagcattccaaanactataactgaagttctaaaatataaatgtatctgaataatgcaaataggtgtatcatgacaaatattttgcaaataaaatcttaatattgaaagtggatacattctagaaagaaaggatcaaatgtgttgttgaaaaccgtatcgttatcttataattaagaagaataggggggcatatttgtcggcattttcctctttagtctttggagttcaaacctaactaatcttagtataaagtatataatatccagagtactcgacccatatagggtttttcttatgtatcaattctatgtccacttttcttatgtatcaattatatgtcacactcaaacatatgtatcatttctacttataattaaactgctattcactaatcgttgagtcaggaatattgatgaggtgattgtttattaaattgactatatattcgagattcaataaacctatatatgttgtcaagtggtaaagacgaaagtcaacttgcaatatagattaaacacaaacagaataggtcaatctcatgaaataaaataaagctgcatcgtaactttttgaaatcgaaaaaaaaacatgtatccataacatacaccctacatataatcaaagataaccacggctaatctcattggcatataacctatgtatttattgattcattaaagcatataaccaattggagaaattattagattaaaaactcatccttaacaaatcagaaaaaatattcgagttattttacctatagtagcaagctatcgtagggtgctcaactttgtagctaacgaggaagggaaattactatgttacccgcttattaaataagggttaatttgatccgtgccattgccaatatgcctatttagataaatgccattacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaaattgactcggtttatggtataaataaaacatctatggtatacaagaaaaattgttatttaatttaaaatcaaataaaaataagaa

SEQ ID NO: 26179 - DNA, 3032 bp, Oryza sativa
cctgcagccctaaaaggttagcaacttcatcctcctctactttttgcttagcatttacatttagagctatgttttgtacatatttttccctctagaaaatgtgataaaagatgatgagagagaaagtatgtgtagggaataaagaatatagacaatttgtttattttggattttataaatacttgtttgaataattacatataataattctgaaagaataattagccgtaaatgccacccatgtcaaatctaggatttgaacccgggtgggctggttccaccacaaggaacctagccagttgagctatgctcacttcgctacatataattattgtatgaatggttaattataaaactaagttaatttaaaattaaaataagtacaacatattaaatatttgtttacaatgtaattaaaacatgaataatatgtagaatggatttaataataaagattgtatgaataattatattcaattgttgtatgattatttaatgagtttgtatttcgtggattttatatatttacgatttatatgcattttatgtagatggatcggtaacggatgtacgcggaccggcggtcaaaagagtttattgacggcgtgcattattttttgggtgtggccaatgataaaaagtgtaacggtttcataagctgtccatgcaacaagtacaaaaccagaaggagtattccactgcacgaagtattcatggcaacctgtttcagtgggggttcatgtgtagctacaattgtgaccaataaaggttttataaaatcacacctctatttgaatctcaaccaaaattatctatctggaataatattacagaaagaagcgaagagttagctaccaatcaccttaaccaagaaaaaataattaaaatttcagcgacactatattttaaatttttaatttaatgcgtgccaatatatataggaatgggtcctgtaacatcttaattagtacgtataccataatactcatgttatatataggccactgattataatattcagggtttcctttatggaaaaccaatgatatagggttttcttaaatttactctaagaatttgagtgaacttagggaccatagatatcaactttaaaatgaggttagctaatttatatttaaaaaatgagtaaacttcactccacatccgaggaatgatgtagactacgtgggattaattaattaatgctacttataaattgttaagtaaattgcacatcttttcccatcaatttacttctagtgatgaactaattatttgtgcaacgtttcgatcaagttgggcttcgatttttatttttctttttggcagctgcgaaagtagcgtaagatgtagaatgtggatgcttgaccctcgagcaacgcgtctaagcaaccgccccccccccccccaccacattacttaatttctgatatgtatagtaggacgtgactacatatatgaacgttgcgttactccaatttctgatatgtatatatagtaggacaagcaactcaactgtatatgaacttcgtcgtgcattaaattaagtgatcacctcaagtcctcgaagaatattattcgctccgtcagaataaggttataagtgcagtcatgagtttccgtgtctaactttaatcgttcgtcttatttaaatattttttgaaaaacctataagaataagttacgcataaagtactattcatgttttataatctaataacaataaaaatactaatcataaaaaaatttcaaataaaatggacgatcaaagttggatatggaaactcatggttgcgcttattttgggacgaaggtagtacaatggaagtactcctagctagtaactaaatcggatcaggtttaatagtgaaggcaaataagcaaactaatgttatatgtacttactcccatcccaaaatataagtatttttttttacttcaacacggtctttgagatgctactttcatcaacaatgtctacaaaagtaagatattttaaataaaaaagttgcatattgtaatagtttgtttaatgacaaatatcaagtaacatcaaatttacattattgatcttttttatttttttgctattaataatcaaaatttgaaaagtttgacttgccactgttctaaaaatacttatattttaggatgaagggagtacttgataacatagacaacacactacgtctagcagccccaagacactttaataatttcacttcattggtttgcttttaatatattacctctctttctttcctttcacttggagctcatgtgtagagattgtatttcgtatgatggggctgctcattctctccccttaatttttttctccatctgaatttcgtcatatcaccatatgaatttactacggatatgtttggagaccacaaacagtttctctcagaatcaaaaactttcctgagtaattcggtttttatttagatttaaaaatatataattgccgaattaaaaaattctgactagctgtttctcatattaatctaaatctccttcaaacaaatcctatcttatttgttttgagcacgtagaacactaggcgttagtatatggaatggcttgccagcattaaaccgcgcgccgaggtgtcggtgccgcgcgctagcatatagctccagtcctgtgtggatcatcaagcgaatgcgtgtacgtgagaggctgtgactgtgagcaatccaaccacacgcgcaaacatagccgtacgtacgtactgatcatttaaacatgtctacttattatactaacgtataactcgtagtactcattaattcacggatcccaaatgtacattgtatactcgcgttctcaatttttcacccatcctaacacattacacacataccgatatagaaagaatactagaataccctcgttttattaaatcctaattaacacaattattctccaccttatcttcttttaatacatttatattgtactttcacaaacttcaatacaataataattacttaaaaattgagaagaaaaatatcttattttatgac

SEQ ID NO: 26180 - DNA, 13640 bp, Oryza sativa
agcaacaacgtcatttatcatcacataaaaactccaaaatcaaacacgcaacaacatcatcatcacataaaaacaacaatacaaacaacacaaatacacaatcaacaacaccggtggatctgcccggcgctaccgacgtcccctccgccggatcttcccgccgccactgatgtcccctccgccggatccgcccgtgggtgccgccgacatcaccgccaccgctggatctgcccaccgaaaacactgctgcagccacctccgccggatctgcccgcgggagcgctgatgccaccgccaccgccgcgggagaagcttgggcgcggagggtgaggaggagggggtagaggaccatgggatctgcccgccggaaatgcctctaccggatccgctcgccggaaacgccaccaccgccgcctccgccgaattcgctgtggatccacgggagaaccttggcggaccaccggatccggcccgcgggagccgctgacaccatcgttgccgcctcctctactgccgtcaagggagagacaaaagggggagggggctgggacgagaggggaggagagggagtggccgagagggagagggatgagtgagaggaggtggcgagtgaataaggacgcccccctcacctcccacgtgtgactttagccactcgtgccccggctctttctctctcggctcgtcccatttgataagtgccggttttttttaaaaaaaaggcacccataatacattacaggtgtcggttaattaaaaaccgacactcggtaaattttttttagaaaaccgtcacctataggtaccggttttttggattttcagcctgtggaggtggggaaaacgctataggtgccggttttagctgttccgggacctgtagtgctaatatgtatgtgtgtttttgtagtagtggatatagcttttgaagaatattatataatttattgggaattgattgtcaaagtttaattacgaggaattattggtcacttaatttccattactgacaaatgaaaatgcatctcatgaaagttcaccaagtgaatactccattatacctttgagcataggactgtaaactgctaagagcatctacaacggtctctttaaatccatctctccaaatgttaatttgactaatttgctaaaaaaaaaatagagagccaaatttacctttcacaataaccgcctctccatctaccctctccaatgtgacaatgggtggcacatgtcaatcaatgtacttctttctctctcccacatcatccccccacccaccccacagtccctacccatcacctcaccggtgacgagagcggagaaagggaggacatagaatggagctcgatagacaatggtgaatgaggtgggcagtggagggtggcaggctctgacatggtcgataacaaaggcatgggtggaagtgttgacgacaacgattgtgccgactgtgcatgcagtgcaaagggcccaacaagatttagcgatggtggagccggcacggagacaatgaaggccggctcaaggaggaggagacactcatggccaccccgagcatggaggggtccgctgactgatggggtggaagaccttgacgtgccccgtctccgcccactagacctggtgacagcccgacgtggtggagtgagggcattgtggtggcagagttctagcgagggcaagtcccgtcaccatgatggcaacggagttatggcaacggagagggcgcaacaaggatggggaaggagccaacaaagaatgaagtcggggcagtggagaccgaggtagaccgatggtggggagggcccatccccatgacatagtcatgcctggcgttaacgaggagggatgtgggctagatgacggtggaaggtagggagcttctgtcgacgaccgagggccaaggggagctgggagccagtagcacatcaggggtggccacaggagcttctgccagtagtggaaaacaaagccggaaagatcaatcgttggagctctagaatggtgggtgatgacacaggaagggttgaaatcctatcatgacgccaccatggccatggtctcctgcgatttgtggtaggcgagtggtgaggcctactattgatatggcaaaatggctctctaagtttggccaatgtgcggtgaggtttggccaggttggcaaggctgttggagacatattttcaccaaaattgctaaattttggcttagagagtcattaacaactcagttcgagttgctccaaaggctcctgctggactactttttgtttaaactaaatgttttaatgttttcgaatacgtgtaatcaaaacatttaaaccttcactcactaatacatatatggggcaaaatttgctatagaacactctagatttgtagcatttgctccataatactttagctttgtggttttgttataagacactatacctttttggaaaaattccatatattcccctaaactcttgatagaagtccgtctaccatcttgaactttaaaaccgggcatccaaccctctaaactttgtaataccattcaaattaccccctaaggtggttttgggtatttgaaagcttaaatgagtggttttgaataatttatatagcatgttcacgtatcctcaatcatcaatcatagatttatatcatacagttatatcatattagttgtcggagtatgaaacttctctagcgaggaagcgagtactccctctttgaagattcaggcaaggggcgagttttgagttcaagtgtaaatcttgtgaaagatgaacatgggggattataaaggtttgggctgcacgaatgtgtaataccctactcctgtgtgtgtggactacagatggagaacgagttacaaactgtggagcttgagcattagtggaagtatttttgctatcaagaatcgaaccctctatccgttggcctagatcctccttttatatttcaaggggagtccatagcaccaatatattgatgtcaaagtggagcctactccattcaatttagtatgttttgtcttgtcaaagtcttttgaaccgaacagggagggatgttctcccttgttggctgacgggcaaggtgccctaaaataaaagaagtgcacttgcccctgctatttcacagggctacctgggtgcgtcgtatagatgcccccaagctcccccattgtcgatgggatgtgtataagacgggttagtatatgttacttcacattaaatgcgaggcttgacgatgaactgttgtttctaccccagatacttgggggccaaggacggattgttgatggtccttaagtaccaaatccgaccaccaatccttgcataaaagcaaatgaaataaaacattagacttagtggtagtggttattactaatcatttccacaagagttgagaaatattcgtttgtaggtgaattatggacgaaaaccacctgccatgtaatgaaatacatctccaaacaattggacacgagtacaaggattggagtgcccacatgtcaatcaaaaccgactacaattgagccaatccacggtacaacatgcagagggcccaccaagaagcctcacaaccgaaggagtggccgggagatgggaccaaggggtcggccaaaccacaaggtcggccgaaccgcctttgtggtctctcacctccaccttcaacgtggacggccctaattcatcccctattatggttgtgggtggaccaacctcgtagccgctttagtaaccatcataggagggctataagaggagctctcacttcactctcacaacacacaacataagtggagtacaactcactttcatatttaggctactctctcgtagagtagaatataggaaaagagtgaggggaagctccaaaaggagtgccctagatgtcgaagttctctctaggggagttctagaggagtgccggggatgtcgacactatctatgctggagtcttgaaggagtaccggagttgtcggcactttctccgatcttgtatctcgacggatgcttcatttatataagtaagtatttgtgattcccttttgtatttacttttcttatttaagatagattctcattattacgggtttgtcacttagtatttataaagaagcaagttcttggctgagtctagagtagtaatcgataacgtaaacatggtgcctagattagatataaccttcgtttgttgtgtgctccatggaaagtgaggtgggcggcaggtggtgacagtcatgtccctcctttgtattccttcacgtttgggtacatcatagagttacagggtagactcaacttggcggaccaggggagagctagtgcccgaaataactaatagagttgtaccttgtaagggttacggataaggcatacatcctatccttagggttacgcattgtacaaatacatatactcgcaagtatacgagaaggttatgttaatcgtaagaaatttagccgaagtataaggaaaccgtccccttgagtagaaggtgttagagtcctattcagaggggatgcagactttggtatctcgtacatgtgaagtcctctccgagttgtacttggaggtcaaggcacttaggggtataagtacaagcccttcatggggtacgtgatcatcgaatcataatctcaccaccagccgtagcagaagcaatctggagggctcgaagacccagccgccgatcgatctcggcaagttgatctagatagcattactcaacggttttgttgttctctattgtaatctctgtgtttctcttcataatctcatataaactaaattaaggcttttaccttacaaggggcctgaactagtataatatttgtcacttgtcttcttgatgtcgtatcgtgtagatccttgctccgcgtaccccaataccctcaaaatacagtctacgggtatcactgtcgacataccttaacttaatattaacatagttaacccgcagtagttctctctattctaagcctctcgtttcattgttgtccttggatgaatcctattcttagactatacacatacgttctctatgattcggtacccttggaatactataaagtgaagggctatagcgcgcggtatttgtgtgcttgcagatttatatatgactgtaacaaataccaacacatatgttccatgctcaggacaggtgtgagggatgccttgaacaactcgtgatggggaccctggtccctatttctccaatattagtattatattaacatccatttgtgtaagtgagaacaacaaaaaaaatagagtcaaaatgaatgattatgtagagattttaacatatatgtgcaattcatatatcacgtaatcaaactcatccaatatatatgtaaattagataaaagccactctgcaaaaccaccttagggttctatataaacaatattatatagtttaagggttgaaagtctggtttgaaaattcaatgtgctaggtggattttcaatcaaagtttagggagtagttagaccttttttttttccttttttgttatttttttaaaaatctctaaccattattttaatacattctctttgagtggggagataaaattttccaaaaaaaaaatttacccttgtacatgaaatctaaaaatatcttacaaaattcaaaacctattccaaattgtgaaaataaaaatatttgggagggcaacataatgagaactgcaaaaaaaaagagtaaatagtgttgaacaacataatgcctagatttcatcaaacacgtcgtattccccttttccaatcattttagaataggttggtacatattactcactccatcttaaaatatactccctccaccctattttaagtacaaccgtgggtttttttttccaaatttaattgtctgtcttatttaattttttttgtaaaaaattaaaaaacataagtcacgcataaagtactattcatattttatcatctaataacaataaaaatactaatcataaaaaaattttaaataagacggacgattaaagttggacacggaaactttgaatgagacaaatccgagcatgtccagattcagtagtaaaatgtatcccatctaatattagggctgtgtttagatccaggggtgtaaagttttggcgtgtcacatcggatatacggacacatatttgaagtattaaacgtagactaataacaaaacaaattatagaatccgcctgtaaactgctagatgaatttattaaccctaattaatctatcattagcaaatgtttgctgtagcaccacattgtcagatcatggagcaattaggcttaaaagattcgtctcgcaatttacacgcaatccgtatagttagttatttttttcgtttatatttaatattccattcatgtatccaaacattcgatgtgatagggtgaaaaattttaccgggggatctaaaagggcctagattgctatattatgagacgaatggagtaataatttttgcattcagaattcattctaagatataataaattttccacctacattctatttccaactaataccaattcttttattttatttttttattaatttttttctcaatcttttatatgtaatttcatcaattttcttaatattcgtgtccggttgaacggagctaataccagtggtaccacgagtacggaggtttatgccaagcatgttcacatgtcagctgtcaaagacgagacgtgtagcttaccttatattaggacggtacgtcgtcctacgtggaatggaagcagagatggacctgtactgtacacagcacaccggagccgattagcagcaggccagtctagtgtactcccttcgtactacgaaaacgaattaaccaaatataacatattcaaatataacatattctaatacgataaatctgtacacacgtatatttagatttataatattaggatatgtcatatctggtaatagattggttttttatagaacggaggaagtaggcggtcagcgctgggcgcatggctaaattggctactcctagtagggtgggtggtccgccgccggccggcgactgctccgccggaaggataccgacacgaccggccaccgcctcaaaagccgcgcgcgcaactccccctaccagctaccagctacagtatttccccatactcgctgctgcgcaagcagttgtactatgcttcgtaggtgcagcccatagggagaatgtctcctcttttttagtcttaatattttaactgctctttgtctctcaaatgtggatcaaattctcatattctaacccatattttttttttcaaattcaaaatcagataagaatggtgccgaattatataccacttatctcattttatgtcccatattatttcctatgtattagatattaactatggagaaacacttaaagtgttaaatagatacaccaagtaaaaaattatacaatattacatttgagcttgtaaaatactccctccatctcaggaaaaactaacttttgaagattaattgtgacaagtatttatccagattcatccctaaaagttgtttcttttggagacggtgggtgtaatgattaacatatcttttattatgtttgtaatgtttgtaggtggagttataatagattgttcatatgtgtttcataacataggatatgagggcatatcctaacccatattttactgcgtttcttttttttcctcccacgttcttcctatgagtctcaggtcgagcggtcggtcggaaaatacccttcccattttcatccatactctccatcctaaaatgtaatagttcttttaactacattatctttccaaccaattacaatattttatctttaaataaatttcacaaaactacagatactttggttaaattatcacaaaactatagatttaagaagatgtatcacaaaactacagatttagtactaaatttctcagagaactacagatttaagatagggtattgcaaaactacagatttagtaccaaaattatcacaaaactataggtttagtgtcaattcaatcacaaaacttagacatttataactcaaatataacactagtgctaaggatttaaactccaatagttgtactaaatctatagttttgcgatactccaccttaaatatgtagttctctgagaattttagtgttaaatatgtagttttatgaaacatctccttaaatctgtagttttgtgataatttgactgaagtatttgtagttttgtaaaatttactcttttatcttttaatttcctcacttactttagtttcttaaccaatcatagttctttttcatttaattttatcgatttttttaaaacctagtttgagacggagatactagcttggtagtattatttggcaccgtaaaacttgtttagcgcgtcccgtttcgctgtttttttttctccttggtctttagtgtcgaccttagttttttttttttttaccttaataggaccttccggtttatttgcacctggaagatcgaagaaggccctgctgcctggtcgtacgagcacgacatgttttggtacgagtaataatctgttgttgcctgctcgtacggcgtgtgtaggagtaataatctgttaagaggtaactgttactagtaattctgtccactggattaggaccaaattaccacacctgacgaagacacaaatctcttttatacaggtttagtattaattagtactcgtaggacataatatacaaaaatacctacctctaatacttatccccgttattatagaatcatatttttttctttatttttaatccactctttattttttttctatatgtgcctcagggtggctcattctcttgtccagagcgtttaataatcttcaagtcccatttacaatgcacatattctacagaaatcgattaggtttttatctggagcaattttaatcctacttagagcttacaaacttattatagtcgtcatgataattatagttttatataaaataaccgcaaaaaatatacattcagaacaacatcaatatttctcacacgatgacacggataagaagaaaagaaacctactcctaagggcatgtccaacaaaaggagcacccccaacatcccacatgagcaaaagtgatgaaggaccagactagggatatgcctcacattgtaagccataccatctcatttttacaattcagcacctgtcagtcggtcacattttgtatttaaacccttggattatttttattcacatataagtccaatatttcaagtataccccccagaaatcataaacatataaaaacatcaacccctcctctcctcaccatatttccccaatttctccggcggtctcttccccggcttcgcctctctctccctgcacctcccctccccgatggcgccgcctctccccggcccggccttctctccccatcaccggatcaagcggcggtggtggcggatcgaggcggctgctgcagatccacgcagcggcggccgggatcgagacggtggccgcggatccacgcggcggcgaccgggatcgacgcggtggccgacccatcgacatggcggtgcttggtatcgatgcggcgatggccaggaccacatcccatcaatctccgatgcgccgctgcacttcttctcccccaccggttagcctcgagctcgccggatccacacggcaacgacggcctcgaccttgactgtgatggcaatggcgcgggagctcgagttgatggcgagctggagcgacggcatggggcgacacagctacccaacacgcatcctggtcgattcctccgagcaaaaatgcgatgcctctgagaagggcgcgtggacctccagcagcattcgcgcacccctacagggatgcggctccttccgaggtgacgtgaatattcgctttcagaggtgtgagaccacgctccagggtggagcgctaggcatgccctaacatgtcttctcttgaattatgaaaaaaaaatttacagggtgatcatcatctcaatatgctcggtcatcactggcttatatagctgtgggccaccggatttcgcgaaattccattttccaccggtgcccgaaacgaaaggggctgtcagaatcgtaaaccctggctgtggcaatggcatgaccaaattgttagcttgcagtctcaaaaaaaaatgtgagcttgcaataagccattaaaacccactaatccagccaagtaatgccgatttttaccccacctggacctggacaaggtgcccccagatggaggaagccagagcaaaccaaaaccaaagtgggcaccaccagcatcagaatgccctttattcaagggggccccacattgtcagcagctaggctagtaacaggtcatcatgcctgaataggaagaggcaacaaccaattgccacactttcttgcacaaaaacccctgacagatcacaatatcacatggcaagtgtagcccaagaaaacccacaagaatgccatggagaagaagcttctgctgcttctctctctctctctgtgtctagtctaccagcttgctgtatattattaggtgcaacagggcagcaggcagtggtggccaacaatagacaattggacaacctgtttcctcctcttcggctctcctcctcctcctcttgccttctcttcttcttgttcttgcccaatcctagtagaagcgcctaacttgtcgtttgctgtggcttgggttttgagagccggaggaggcaggattgatttttccatgattgggttttcttgattgattggcgcctgctgctgcggtgcggttggtccaagaaccgggatttcccggcgcggaatccggtcatccaagaggtgagatgatctttctttccttgccctgcttctctcgcggttctttaggcgttcttggcgtttctgttcttcaattattattattactatttgttaattttgaagaagtggagcgggattgttcgcctgttcgttgcttttggcgagtgtagaatcctgaaaattttaatgaggtggatgtgagagtctgttctgttggtggtgatttttgtcccggccgtgaagaacaaccgctgctctactgggtggttcttgatttggttttggtccgttctgccagtgttgcttgttctttctcaactgcgaggtgtgagcatggcgttaaattccatcttttagtgtttatcctctaaatttctgaatttttgggggcggttggatggttacactccatcccgtatttgagggcaaagacaacttctatgttaaattctgttttgtttctctgtcaattggtcagtcagtataaatttggcccgttcttcacgccagtgaggcgaaaattgttcaatcggttcaatcttcagagaatttctttatggaaaaatcacaacttccgattagtggatcaagtctctttctttgcggtttttcccctgcaaatttttatgtcaagttttgaggcggtagcagcagcagtcgttttcagcatagaaatatgcacattggaggtatcgaatattgtttaatttgtttggtagttttgctgaggatattcacccaagaacatagtcttcccggtcagaaaaaataatctgatatattagtggcagtcctcttctgaagtcatctcagctgaaatctagcctgtttttcttgcgggtattttgtcgctggagttttaatttagaagtttaaattaaagttaaggttgtttatatatatacgcttattgctcctcaccaattagtacagtgaattaacaagccttaatttctttattaatctgatatacattgggggtgaactgctaaactctggtcaaaggctgcttgcctgaccacacacttctttttttctgcaacttgtgacaggtcaagtagtgcatgttacacggtttcttccgagtggtgcaagaactagaccttgtttaggcttaacgtctgatttgtttttttttaacttagaaattaagctacactaaaatacctagtagtagcatgtttttggttttggtcggttgcacattgtggtgagacaggaagtgcataacacttttccattattagaaaaagattaggttgtttttggatgatttccttgattttgggggtgctaaatagtagtagtgctgtttgattacatttcgtcaaaattacttttttgacctgccttttgctgtgccatggccgatagccgtgcagggtttgtctgggctttatcagtgcacatatttttatggttctttaatctgtggttactctctgctagtggtttattacccagctgtaatcacctgttcatagcgtggagcgttttgttaatgcctatttaatggagtgattcattttactttcctgccatgtcttggtaactgcaagccagatgtagtagtatattaaaagtttcccctcctagttttgctggggaccaagaacattgtccagcttgtctaaataccaaaagaagtcttcccttgcaaagagagtggaagtgtgttttgcactctgaaagtctagctggcatattctcatgatacttttctcaatttctactccattccaggtgcatctgaatagataagaagagaacataatctttgggcattctctgtggttgatctctgaaaaaggtatcaaacagcctgcaaattaggtctcctgctctttccatcaaaatgtcaggtatcattttttttcttatcttatttatatatttgtgatgggttgctgatgaaatggttgctcattagtttactaatgggtgctattgtgctttgtgtgtaaagttcggcgccgatcagagagtatggagggcctgttctcgtttgacgagaggaaagatcgaaggtcagatgtggagaactcggaggacgagcggagaaggctatccattgggtcactcaagaagaaggcactgaatgcatcaaacaagctaacacattcactcaagaagagggggaagagaaaggtggagaatcggccctcattcacaatcgaagatgtcagggatgaagaagaggagcgtgctgtcttttccttccagcaggagctttttagcaggaacttgctgcctgacaagcataacgattaccacatgttgctgaggttggtgttggaacaatgctgaaagattgagagctactgaagcatgcagttgtttgtttctttctttcttcctttctttttttcttttgtgctgaagctctttctagttttatttgcaatatgtgtctaaaagttgtatgccttcattatctctataggtttttgaaggctaggaaatttgacactgagaaagccattcaaatgtgggctgagatgctccagtggaggaaagaattcggcgcagacacaatactagaggtgaggctaaacggctaatgctgctattaattgatacataaaaattgaaaatttaacttcgccagatacttcctgaaggatattcaaatatgttggtccatgtacacattgttttgtttacataaataggagattccatctggcatcttaaactaggagtgctttaaggtatagactatagagtgatgagtagtagtacgtattttatccccaagctcaaatcggtttattttgaaaggataactgatgtctacaaataaatattgcaggacttcaattttgaagagc

SEQ ID NO: 26181 - DNA, 546 bp, Oryza sativa
  unsure (1)..(546): unsure at all n locations
tttttgtcacttcatttttcatggcttattagggtataagtagaaggcctcctttaattccttcgtataggaatttttcataaatatccattccaaacaagtaattggaaatgaatcttatgtaatctccgaaattcaataaaaagtttctttgaatctttccctctcatcaaattatgtgtttttctgtggtctaaataaatggttattcttttttttcaattttctattttacacgtccatcccaatcaaaatcatgtgtttcttctattattaagttttttaacctactttccaaggagcctangtgagttcgtttgaacaacttcaaacgacaacttcatcatgttccattagtacacttcccaaaatgcaaagggatatgttctatggaaaaaattatacatgaaagtttattaaaaaaatcatattaatatattttaagtttataataattaacacttgattaatatatactaatggtttatcttattttacatgccgccaatttaccgagattcctaatgggcgatcgatcgccccgag

SEQ ID NO: 26182 - DNA, 531 bp, Oryza sativa
ttctcgatacatttggctagagtttatgagtgtacacaatgtgtagaaaagttcttatttatcctttgaaataatgcattggagttttctaaatctactactactttaaaaataagaggcgtttccatcgtctagtggaaaaaaaggcgagaaaaaaaaagagaaaaacaacttctaccataaaataaaagaaaaaaaagtcccactcctcatgtggaaaaaagagagagagaaaaaaccaaaataaaaacttatatcgttaaaaaatatgtctgacttaattccgactctccggtggagaaaaaagagaaaaaacttatacataaaaaataccgactcctaactactttatatatatatatatatatatatatatatatatatatatatatatatatatatatatatatatatatatatatatctataaagatatttttgtccgtactctactatgtcctctgggatggatcggcttttaaatgcgcgcgcttttggaaatataaatccgtatttgagtcggtttttaaa

SEQ ID NO: 26183 - DNA, 780 bp, Oryza sativa
  unsure (1)..(780): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnattcagttacttcctggaacagttcgatccaactcatgaatgctcgagagcttccacattccactccatccattcagatagtgggaagcgccttacccaagaaccccaaccaagacccgagcaaggaggtcatgattccaagaaccaagaaccgcccagccgcccacagcagcgagatcaacaagacaagaaccactcactcctgcgaggcacagccgggggcgcgaggcgcccgacctcgtcggcggcagcgacggttacagcagaggaggcgctggagttgctgccgccgccgccgcctaggcaggagggccgggcggcgaggagcggcgggcgggggaggccgaggaggctggataaatggaggagggccgtccagagcacgatgctcgaggcgacgcgcaccgcccaccggagcatgccgaccccgcggcggcggatcgccggcggcgagctcttgtgcctggccatggcgccttcttcctactgctactggtataagctacgctttgcagtgctccccactactagtggtggaagggcaaagacggtaagagcagtgtccgttattttgacttgtgcgtgacgtgacggaaagaacagttgggatttggatcgtgttagggtgattattaactgcaaccggaaagtttggtggcctttctcattgcaaggggactagtgtgccgtgcactagt

SEQ ID NO: 26184 - DNA, 8079 bp, Oryza sativa
tgttatgtacttatgcgggctttagtttcatgaaaatatgccggcattgtgacccttttgttagcttggtataatttacagaaagcatcgaacatcccaaagactaaacatgtgtatagcttggtgagcgctcttccgtaaaccgccaaatgacaccaggcactttcaaggtctggaactcttggagcacattaccgataagtgaaacagccaacaaaatgctgcagaaaacaagcaaacgtatgagatggacttgcactaatttcctttctgaagaataaatgtacagtgatgaactcggagagaggcaagaccctccgagttcattatatttgtacatgattttttttttgaaaaaaaaaatcagtaaggcatggccctccttgttccatctagtccctaaagtatgtgtcttttttggaagaaagtctttagatgccacagctgcagccctgcaactccaacgcaaactgccagcgatagcagggtgaacgagtgtattttcatggtcgtgtcttcgttgagcttttgcatctcaccctcgctggcagagaaaaaaaaaagagatcaataagcaacaatgttacattggaaagagaacttggaatagtcttcgagtaccgtacctccgtcggagagaaatcatctcttcatgtatgagccgagtagaaacctccaatttcttcaactctccaatcatcgactaggaaaggacattcgaaaatgaaaaaaaaatatcgtacaggactgattcgaaaatgaaaattcttataatactgcttttagacctcccatgagagaattaaatttaaaaatacactgttcatacaattttttctcagtattattcgacatgcaaattttttttataaaaatataccgtcggtctcgctcaaccattgcgcgaaaatgacatcgcggacggtatcgcgcagggaaagcgcgagaccgcacggtctcgtggaatggaagagcgagaccaaacggtctcgcaaaatcaaacaactatagtatccaacggctcgatttgattagggattaattatttaatatacaattagctaataataattagcggttaattatcctaatcagtgattaatcaaatcactaattaggataattaatcactaattagaattaaccgctaattacatcggcattgaaccgctatcgctcatgcaatgagcgagaccgcgagacatccctttcaatctgctcagtattgatattctaatccacgagatcgcgcggtctcgcgctgatgcccgcgcggctcgcgctttctgcgtgcgataccgcctgcgacgtcattcccacgtcgttttcgtgcaacggttgtgcgagaccgacggtttatttctgtaaaaaattttgcatcccgaatattcgtgagaaaaaatcgaatgaatagtatattttcaaatttaattctcccttgagattaaattacatcctactgagctcaacacaatgaataggcacatttctaatctttgaacgtcagctattaaaaaacagactaaattatagtaacctaaaatcagattagacacctctactacaaatctcgataaagccagtacatattcgtagtacggatatatcctatcttattctatgctgttatattttgagacagaggcactacatgctaccattgttcacctaattttgacttcaacttacagaagcgtgtgcatctacattcctaatccccattatgcttgtgtgaattacaatgaagtgaaacatcaaaatcacctgtacacactgcatttggcaccagaatcaccttcacgcaccacacggatcaatcacttccattttcattgaccatctaaatgagatttgtagttgtcttatttccgtttcataaacggaacacgcggacaaatttctaaacaaaccgctggacgaaatctaaaatacattaaacccattaattacttatagctttgtccagcactatatcgacacaaattttgtagcttaaattaaatctgatctttacactatctgatctagtgacaactaatctgcaagtagtagtagtggagagagagagagagagagagagagagagagcatacatcgatgtggccttccttggcggctgcgacggctggcggggagccggcaccaccggcgtggtcgcggacttcggtggtccactgcacgtcgatggagacaatggcgccgcgcaagtagcgtggcgtccagaagcaggcggtgtacctgccgtcctccgccgcctcgaacctgaactccccggcctccacgccctccgtcaggtgcagctcctcgccgcggggccccgccacgcgcgccgagaccgcggaggacgccgccgacgtggcctcggccacgcggtacgacgcgtgggagagcgcgccgcggcggagctcctcggtcaggcacttggagccgcccgatggcacgtcgaacaccagggcgtcgacgtcggcggcggtcgcggccaggaggatgacggcgaggagagacctcgaggcggtcattccacttgcgagatgagatctagctgccggtcatggaagtcactggaaggaacgctcgaagcatgggagggcgggatagctgtaactgcaggctgcagacctatcatcccttcgtgtcattttaggtgtaattgcggttttctttcttgaacatttgataatttttaatattattagatgataaaacacaaataataacttatttttaaattttatcatatttttttaaaataaaacttttggttaaacgttgggcaaagaaacctacaattacacttaggatagagagagtagaagaaaagcttacattttttttggaacataataaaaatgtatatactcataacacatgtacatccctataaacgtacacaccctactcctctaaacaccttcaaaagactggccattttttaaattgacgaagtcactacggacatctcgttgtcgacatttttttagattgacgaagtcactacggacttgtcgacggatacgtcgcctaccattaaaataataattagctataaatgagagcactcatgttaaatttaggatttgattgtgggtgaactggttccactataagaaacctaaccagttgtgctacgcttacttcacgaataaaagttgattgattgcatgtcaaatggctcattagcgatcaaataataatttataaatactgatccctcagtcccaaaatataacaactttgagcacttaggatttgttgcacaatataacaacttattcaccaacattcccttcacaatcaatcataatcttctgtcattcacttttctcacctacctccatttctcagccaatcataacccattcctatttaattctacatattttcttaataaccgtatccaatatattctgggacggagggggtagaacttatatataagatacttagcgactaaagatctgtttggaaaattgatgatgcagctgctggcttggtgtttatatgtttgcagcgcttttcgtgctggctgcgctataactatagccaaacagagccctaaaatgtcaatgctaaaaaaaataattaaatattatctttgaaaatatcctaaaaataactttaaatttaaattttgtcagcggttgatacattgtagagtaaaagatgagattatcaaattatattaggcttcacccaaatggcacttcgtaaatgttacccttaacccatgtctacatgttagaataccaccagagaccaaactagttttcggctccttcctaatcttctctccccataaattttactagttgccattcaattcatcgggttttttttttagaaattacctcaaattcacccttcttttaaaacgtgtcaccgaagtataaatggctaaaaggcccaaggcccgacaacctggcccacggcatggcattttggtccggcccaagcacggcacggcccgacgggggttggacccatgctggtccggcccgaccaccgggtcgtgcctgggcccctccactggcacgttgggctggcccggcacggcccgactactggtgggccgtgcctaggccagaggtgcaatccatgggccagcacggtctggcacgatgtgccgaccgggccgtgccagcctgatggctggtgggctgtgcctagccgtgcctgggccgggccttttagccatctatacatcgaagatgtgaatttctcgatttcgtgccactccttctgcccttccgcaccattcgtctgatgcccatcgccacttcaggatgccatcaccatgtgcgagccgccaattcaaactctttgtctgttgttgtaggctgacgcaactgcaatggcaacatatccgctgtctcctcctgctgctaggtagtaggcaatggaccgactgcaagcactactcgaggttgagcctgggatagctcaggcgaagactgacttggggatggcgggtagaggttgaaccaacagctcgagaacaatggtggtatcccggattagtggcggccaagctcgcggacgacgcaagcgggttatggggcaagcggcagctattgaccaagcttgggaatggcacaagctcagggaagacgcgagcggggtacgacacatgcagtggctaagcttaagctcaggtatgatgactcgttggcgtcgaacggttatgcacggatagtgcccggtttagatggtgaaatcttttaggatgggccaaaaaattttggcatggggccactttttgcgttttgtgaactaaacggggggcaaaattttttggcagatgtgcaattactgttcacccatggacgagtagtacccctcaccctgctcctcgtcgctccaccaaaatccccaacacagccgctcgccccttcgttcgtcccaccgctgctgcatgccatccctgacaccgccccctcccagatcgaccccctcctcccctacgctcgccctccttctctcagccgcctctcgccctccctaaaatagccagccgccgctcgctgtccgtgagacccccgccgcccagatccagcaggttctgctgctccggcattcgttgctcatagcggagccgcccgtcgtctctcacaccgccgcgcccaactccaattcttccaccgcttgtgtggtcgtccctcccccgccgacacacgtcatccctccaaccgccgccgcccacccttccgattcaccgtcggagcccagatccgccttcattcccgtgatggccagctacgggggcggctacaatggcaacgaaggcggcaaaggccacgatgacgacgtgtacggccacgacggctgcaccaaggacttccttgcgtccgggccttggtgcgcacgccgagggggcgcggtcggcgctgacgcggcgcatcccccgcctgattcctctaacggcaacacctcccgggtgcggttctagtctctcgacctcaacgacagcgacgggtggccagaaatggctacgtacgcgggcatgctgcaggccgacgacgacaacatcgaaattcctccaccgcccgttcaagttcctccccggcgaatatctcgcaccctcggaatccggcccactcgcagtgcggggggaggaggagtacaaggcgcggccgctggaggaggacgagcaggggccgcaagcgctggaggaggagtcgcaggcgcagtcgtcggaggaggaggcgtggccgtgagcgcacggcctgcatcacgcgcatcagtgtgccacaatgtctcggaccttgcggccgagcactccgatgctaacgacggtattccggtacgtacaacaattccaattacaattgattgcctgcttccgactagtttaaaattttgttaaatgcaaacttagttcacatgttcgatgttgttttccatgactattgatgcatttaggttaggaaagataaggcaaattggtcagcgagaaatactcgcaccttctgttccatctggtgccatcaaatggacataggaaactgtgttcgcggtattatgcaaaaaaatggctggagggacatcattaagaggtacttccaagccactggtttagttcacaacagggagcaattcatggggagacacaggcagcttaggaagcaatgggcattctgtaataagcttcgctccagctctggcttagggaggaaccctgatgggactgttgtcgccgaagatgattggtgggctgccaacaccaaggtaaattggtcatgtctctctaatgttgtgaacacatgttaagttcagcaggtcatgacatgtgctttcgttggacagggacatcccgattggaagaagttcaggaaaggcttgcctgaatatttgcctgaaatggacagaatgtttgagggtgttgcagtggatggttctacatcctttgttgcgactgccgaccagcctgtagagtgtgacagctctgatgaagcggatgatgatgaggacgacgatgagctgactcctcttagtgtcgacaacaaaaggacaagcagcacgagcaccacagcctcgagtccaagtaagaagtctaggagtccagcagtgagggtaatggacagaaacatgagtgagtacaacgaaatttcaaggaacaaactcagtgtcctgcagaccatgatgcaagtaaagcaggatgctatgcaagaagaacgcaaagctattgagcggaaggtggcaaaggttaacgagctgggaaaggagtgtggggtaactccctctgagaccccaacattgttcatgggtgtcctcgaaatcatcaagtatcaaagtgtgatggacttgttcattgtcaccgagcctgaaggaaggatgctcatcatcaagaaatatgcaggggtcgacaactagtccagctaatgttttgtcatggctatatttcctactttatgtactaatggccgtatgttcactcggatgtatggtgcatgtatttgtgtgtttggactatgttcccgatgtgtgttatttaaacatcagcatggtactactattgatgaattctatgtatgctgctgatttgaactatgtaatgcatggctgagaaagaaatgcatattaatcatgtctatatatttttcattgctaatattttgcattgcttgttttgacaggatgatgaccaatcaggttatgtagaggatgatgaccaatcaggttatgaggagtcgcgccgtcggcttaagcgttgggaggatgagatagacgagttgatcattgcattgatggatgatgatgacgacggttatgtgtacggtatgtacaagtatgccatgcacattgacaagcatttgactagagctgagtataggcaacctgccatgactggtttggaatgggtacataaaaaacttggggatagaaaggcctgttataacatgtttagaatgagtccaactatgttccttcgcctgcatgatctattggtacagtcgtatgagcttaaatctagtagcaagtcaacctcggttgaggcacttacgatgtttctttggatggttggtgccccacaatctgttagacaagctgaggacagatttgagaggtcaatggggactgtaagtaggctgtttaacaaagttttgcagtctgtcatcaagcttgccgttgatgtcataaagccggctgacccacaattcacaacaatgcatccaagactgaggaaccgtaggttctttccctacttcaaggattgcataggggctatagatgggactcatgtaccttgcgtggtgccaagtaacaagtttgtgcagcacttgtgccgcaagggcatgacaacacaaaatgtgatggctgtctgtgactttgacatgaggtttacatttgtactagctggatggccaggttcggtacatgacatgagagtatttgatgatgcccacacaacatacacccatgtgtttctacatccacctacaggtatatgcttgaatggtacttgttccttctttgttatttgaaatatgtcatactaactcatgtttgatgctgtagggaaatattaccttgtcgactctgggtaccctaaccggccaggttgccttgctccttacaagg

SEQ ID NO: 26185 - DNA, 701 bp, Oryza sativa
attcaaaagaataaagagcaataccggcttcagccaataggagtagagctattacctatcagataaggggcccgaacttgtataaaaatccttgtctccatctcttttaccacaatctcgcatataccctggtaccaacgatctccataccatgcaaataccatagtcgtaacctcaaacgtcgacaatatctagtgaaaatcaaataagtgaaaattcatgaaagccagagctaaaagttttataaatttatgaaaatttctagagatagttataaaaatgaaatacatattcactaaatgttaagttgaaaaccaactttatttgcgagtaaaaaatgataaatttcgggtgaatagtaattaaacgctattcacctgaatctttgtctcttttttcctctcaaatgaagttgagttcagatttgtaatttggtatgaatatattttatgcttatatgtaatttttttcataaatttagagaacttttatgtataatttttacgggtttttactagacattttcttatagacgtattggtaagtgctgctacctcttctaaactgactataaacaataatcgcttgtataggtgaaaagtcaacattattattattattattattattattattattattattattattattattattattattattattattattattattattatgattattattat

SEQ ID NO: 26186 - DNA, 568 bp, Oryza sativa
tatagataaaaagaaaaactaattgcacagtttgcatgtaaatcgcaagacgaatcgtttgaccctaattagttcatgattagccataagtgccacagtaacctacatgtgctaatgacggcttaattaggctcaaaagattcgtctcgtggtttccaggcgagttatgaaattatttttttcattcgtgtccgaaaagcacttccgacatccggtcaaacgtccgatgtgacacccaaaaattttcatttcaccaactaaacaggccctattattattgtatttcaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaagtaggtttgcagagtttaaaatgttggaatcttgtaattccagcaggttttaactcctgatactaattcactacttatttcagatcgaatacatcttaggaaaaaat

SEQ ID NO: 26187 - DNA, 6556 bp, Oryza sativa
agaaaagagatagacacaaaggacttttttccctaagaaattaaagctcatgttagaattcccctagaacttctaggttttgagccaatccaaaggaaatccgtaggatttttatagctattcctataacccaaatgtccatatagaaattattttcacatgattgaatttctctaaaattccttaaaaagaatcctttgttccaaaaaaacctttatataaaaaacttttacataaatgcatagtttagcaatttgaaaactatattattgaaaataagataattatagtttgaagttgatgtaaagaacgcacctaagtgtaatattttttatttgggaatggaatgagcacaaacaaaacaaaaggagtgcttgtctgatcgtatcaagcctgattattagaccggatacggttgccattgatttatttcctccgtcacaaaatatttttatgttccaagcaattattatatcaaagttgataaaatagaaacaaatatattgtgaccagataaagcgtgggataattacattagtattcgaaaagagtaaacggtattttagtgattttactttttattactccctccgtctcataatataagagattttgagtttttgcttgcactgtttgaccactcgttttattaaaaataattgtgcaaatataaaagacggaaagttgtgcttaaaggacttttgataataaaatatgtcacaaaaaataaataataatttcaaacatttttaaataaaacgagtgatcaaacagtgtaaacaaaaacacaaaatcccttgtattaggatccgtcccaaaaaaggcaaaccgtgggtttccgtgccaacgtttgactgtccatcttatatgaaaattttttataattagtattttcattgttgttagatgataaaatatgattaatattttatatatgacttatatttttaattttttttataatttttttaaataagacggatggtaaaagattgaacaactttttttttttttttacggagggagtacgtggggagagataagaaatgaacaacggatggagtatgcgcgaccggagcgcatcgatgcgcgcatgaacgcaagccttcctgcgcactacactgcgcatacgcaacgcgcagtcgcggagcagagaaaccgcgcggtctcccacgcgcgatttgaatcccgcatcgggacccgcggcctgcctacagaccaaaacaagctagcggccacacaaggcagaacaaatcgattgacagtagagggaagcagggttggtgacttgtgggtgtgcgcctgggcggattttaattgcaccgctccgatttcttttggatttgacgaccgatcggccccgccggtggcgccccagcatactactactactactaccactaccccgcgggcctaatccagcccaaccgagttcgctgctagtatacttttggataatggccattcgaacttggtcggcgccagcaaggggtgtcttctgttgtcgccgcatatgggtccggcaaaaaacttcgctttttctgtggcgagttcaaattgcgggtaaatggattgaactccgaatacggaagaaaataataccatagaacaaaatagtagtagtactactgcagactgtagattttgatttggaggaaaaacacagtaattttgaaggatttcaatcctataagaaaaaattcacatcaataccattgaatcaaagaattaaatcatatccaatcttttgaaatttctatggaattggacgatctcgtagagatttaggaggaaacttagcaagaacttaaagtcttggaaaatttcctttgagtctctctcttccaattcatgtgtattttcctacggctcagtcaaacaactatttcttgtttttcatgtgttttttaatcttctattttaccctacaatttatgttagaatcctgtgttttttctattcttttattttttttcattccagcgattcaaagagaccctgaaggcccaacccagaccatccaaaaatgtttgcagtgaattccctcggtggtcgttgcaagttctagagctgtcaaaaatgttcgaggctcgtaaactgcttgagctccaaacgagttgagcctgagcctctcctaaaactcgcgagctttgttaagtcgagctcgagcttccatcgagtttattatttgtttcctcttctattaatatgattaactagatattaattattttttaagatatcatcctcaaaatatatattcttttacttaaaaattaagcttgatagtcgaactcgagcttgatcgaactcgaaccaagctgtttgaaagatcaaatattttataagctcggttcgaggttgtatcgagcttatagcttaggcgagagctcgctcgagatcagctcgttcacagccctacttgcaactacttctcgcggctcgctcggcgcaagactgcgggccacgcagctgccaggttccagccttggctggcgactcgtcggggtgtggccgtgtgggctgtgtggcaagtgaccatatgtgtgtatccaccgcgcgcgcgcgaggcgcagccgtagacaacagcatgctcgtcgggcactcgggcggctgtgcacgcacgaccgtgtgcacgcagagaaggttcgccgcagttcgctcggcgcgacaaggccgaggaggcagatcggcggacgatccaatcctgatctttaacccacatgaaaactgggcgagccgccgtagcagtactgatccacactaggacaagatggtgtgcacatggcgcggcacatgcgacccgctgcgcacgcccagtcagcccagaggccacgggccaagttgggagtcttggggagagacagcaccatgataccgtatcacaccctgcttatcctcggccctaccacgctttgcccacacctgtgcgcagcagcagcagcagcagcagccgtggcccgtggccggcgtgcatatgcggcagcgctatctgcaatgcaagtttgcatcttggactgcactgccccggctaggaaacaaaacccagcagggctttgcccctgtgggcccaggttcgggaccgggagcgggttgacagactgatgtgtgggtccgacgggcttgtgccgggccccgtgtcctgtttgccccagactagcaaaggatcattagatattattagcttaggcacaacagcacaagctaatgcaaacgacgtaactagaggagtagtagtacgtgttagtgagatcctagtatatagattagcggcggagatgtgggccgtgggcctgggctccaagatctggtcttttgctttatttaggtttgactgcaacgctgtccaaaagaatactgccccactactgcattgagggagaaatttcatcgagccccttgagttttgcacttttgctactcctggtagagtacccagtacctttgcccgtgaccgagaggctctctgtttatttattccttctcggaattcgagctctgctttccaatgtcgtgtcttgccaattgtttgttcattgggtaaagatttgcctgtgcatgttcagggtccagcaaactttacaggcttttttgttgccagtctacagtgtaaagcattgaaaaaagacttgtggctggactctcgctttttaaaagtcctctttgcgaaaattttcggcgagtacaaaagtttcataagctgtttcccaatacgtcctggctccagattaggaacgatgtataggaagtaaataatattttgatatcaatatgtgtataaaagaaaggattataaaatataggaaaaatatatatataaagtttaaataggccataggtaaaacattgcaatctgatgagaatgataaactcaaagaaaaaatttcataaagattgaagctattgctaactttcatttgaaatatacatagtacattaaaaaccactccttacaaattctatagtaatagaaaaaatgctcgtgcgttgcaatgagtgaagattattttaatcttattattgttatatggtttagttaagctgaaattcactttgttaaatttgcttgcatatatatttgttagaaaatcatgagctgcaattaggagtccgaccgtctcaaattagcatgcgagtttttagaagaaatttcttatatgattcattctgtatttccaaaaacgaacgaatttaaaaaccgactcaaatacggatttatatttccaaaagcgcacgaatttaaaaaccgatccatacccagatgacatagtaaagtaccgacaaaaatatcttcaatatatatatatatatatatatataaagtagttaggagtcggtattttttatgtataagttttttctcttttttctccaccggagagtcggaattaagtcagacatattttttaacgatataagtttttatttttggttttttctctctctcttttttccacatgaggagtggtactttttttttttttattttatggtagaagttgtttttctctttttttttctcgcctttttttccactagacgatggaaacgcctcttatttttaaagtagtagtagatttagaaaactccaatgcattatttcaaaggataaataagaacttttctacacattgtgtacactcataaactctagccaaatgtatcgagaaaaatcagaataattttactcgaacttggaaaaaaatgaaacaaacatgactggcaggatgaagagaattcctcctacgtaacatcccacctaacgtagtcaatgaatgtaaatgatcatatcctctgactttacattagaggatctcaatccacatatcctaactcatatctgaaagatatatgcactagagttgcccttgtaaggggggattggaagatctataatcctaagagtgtggtgattgttttggtgattaataataacccattgttggaactaactatttccatgagttggtgagattaggttaagttccggcatcgagtaagatgggcatcttaccttgatgaggagcaagtgaatacagtgatgatgcggggtatgaagtggctatctatggcaaaacggtgaagggaaaacaaggctcggctacaatggaccatgcgggggtgaagggcaagcaagaggctagcgccgacgaaccaaatccggtggtgaagggcgagtgaaagctttgtcattatggaccgtgcgaggccatttgaagctatgagtaatccgtatcaattataagaagaccgcaagatagaatgccgaaaatcaagaggaagctgttctccgatgaacatcaagtcaaaagccaaagtaggcattgatcaaggcaaaggtataattgatttgggactaatgtgcttaactagttgtagataagaatagtcccaatggagaaatggcgttgacgttggcacccctgaaggcgaagcaagaagatggcaagaaggcattccttgcatttgagtataggaataccatactattaagagggatgcaacattgatatgtttgtttatgtctcggtgataaaagtgacctatgcaagtgctaccttgagagaaaccaaagccttaacctaacatatgagtggttttagagcttgtttctagttgggttgggtagccctctcaaaaagctttccatagagcccaagtttaccgaaaactgactctggagcaaggagttatgaccgtttttgtgaagtgctgtcagggtagctcggaagttccgggccctgggccaggaagttccgacccgatatctctgttcgggcgaggagggtgccaggaagttctaggtctcggggcaggaagttccgggtcctgttatgtgagtaacggctagttttttgggggcttgggtttttaatccccttcaccctcttctttgttggctgctaattttgggcaagaatagacctatccaaaaccaaatagcccctccgaaacctcctaccttagtggtagatctttgtgagtgagatttggcaagagatttgagagattgacaggtggcaaggttgggattgcatctatattgctctctctagttctacttggacaaggggacatctatgtgtataaatataagacccccctagggagagggaacaacaacatatcaatatagatcaatacaaaccaacatgcgccaagacaagccgccgaatattgacatcagagataagcctagacaaacccaatatggttctgcggaagccagcaggagggatctagcgctatctttgatctcgccgagtgcggattcgaggaagaagactaccctgtcatcgactatgtattggttatccatgccgccaagtcgacaacagttagataggctaccccaaatattgtactggtgtgattatggtgaataagagcaataccggcttcggctaataggagtagggttattacctgacaattcaggggcccgaacctgtataaaaatcattgtctccatctcttttacctcaatctcgcatatatcctagtactaacgatccccataccatgcaaataccggaatcgcggcatcaaacgtcga

SEQ ID NO: 26188 - DNA, 9688 bp, Oryza sativa
tattttgaaatcatgtactgcatagcatgcaacaatctattattacatttttcttatccttgtatttaagcaacgtgtggtaaagactcttgtaaaacaactctactctaaagaatatatggaaattttaaaaatgatttgaatcctccaatgtttgtatgaaaatcatctgttaaaatttttatgaacaagaagggggtttttccaatcttacaaaaatctcagcagcaattctaccatccaaatgactaaaattccactttgaaacaatggattgagaatatggaatgaaatttcctttagagattttgaaggaaaataatcatgaggtttcacctcaagtttttcctataactttaaattcctatgtatcaaccaaacgataggtttaggaccttgtttttagaaaaaaatttaatgagaacgtcattctattttacaatcattcatttagggccccctttgattcaaagtaaagttagaggaattttggaggatttcattgctatggatttttttttcataaatggccctttgaatcaaaggaatggacaaaattgaatgctataaaattcctatggaatgcttcatgccatgcaattttcaggaaatctaacatgaggtagaacctcatggaaacgttcctttgagtttttatctctcttataatttctgagtttttcttgagatccaatcaaacgattattccggtgttttttctgtgtttgacaatcctttgttttccacttacattcctgtcaaaatcatacgttttctcaatcctgcgattcaaagtggcctaaaattttcggagctcacaaaatgaggcaagggttgtgagcgtcctaggactaaggaatattttcctatagtacagtaaagttctttgccttgttcaaattcaggaactagggcctctttgaattggagaaaaaaatacagaagaagcaaaggaattggaatcctttagaaaaggttaatgttcattcctttggttcttaagaatgagcaaaagaaaaacacatgaaactcgcatttcctaatgattctgaaggcactactatagaaagtgtcataggtgtcagttaagaagcctctatacgtgtggattttctagccagcaccacagagacggcatagatgaccccgagtcattggtgtcatttccacaactaacacctttgaggcactcgctaagcgaaaaaagattggctcgatgcatcggctcgaatcgaggttctcccattgccccaaatccaaattcaaatccccgaatcaaaattagatcgctaccaagattgattgacatcacaaaatcatgaacatatatagaatcaacaaaagaaaaaacatccaaatcagcaaaacccgtcggtatgcacttgacgacattgagataaggccgacgccaccacggatatggtgtagggcaacgacgcccccggggggggggagcagatccggaggccctcaaggttgggcccgttggatctgtcatcggtgccaccaccctcgccgtcgctgatgaatccactggctggggagaggccggccgttacctgctagggaaaggtgccagcgaagagggagagctggaatgagaggaaacggtgctcgcaagagaaaagaaagagggaggcgtgggcgagagagagaacaggctaagggataaggacgggagagagagggtggctaaaaaaatttctcgtcctgatggtggctcggctcagtttttctaatagatgttggttgttttagaaccgactcctatactacatgtgttggtttttatctagaaccgacacctataatataagtatatatgctattttttttaaaaaaaccaacacctatactatgtgtgtcggtttttatctagatttttgcctgatagaagtgataaatggaaaataggtgttagttttaataaaccgtcacttagagccgtaacctataaggtattttgtagtagtgagggaaacatagggcatttaacatcgactataagctcatgtttttttttctagctcacgtaagatcgaggcaaatctagggcctgtttgggatagttttacattctgagaaacagccaggggcggatccaacgtgggtgcaggggggactcaaaacccatggatacctcaggagcacccccttcgattttttcaccataaatgataaactaaaggtctttaaatagctagaggttgaagaaactgtgtaattgagcctccccaattttttgttcctggatccgcccctggaaacagcgagaggggatttagcttgtgagagtatgaagaatttgggaaaattagcttttgggtgtgtttagttccacggccaaaattagaagtttgactaaaattgaaagtttgaagaaaaaagttggaagtttgtgtgtaggaaagttttgatgtgatggaaaagttggaagtttgaagaaaaagttgggaactaaacaaagactttgtcttctagtttatttgctgaattcaacaactacttgttctcaaaacctaaggccttgttcggttactagggatttaatccccaaggggaatcaatccagggagggattgagtgaatccctctcatgtcactcaatccctgttggggatgaatccctccctacccactaatccccctctcaaatccatgtgttcggtttggtcaagatcaacaatagcaggattggtgctttcctgcttcaacgctgctattgagttgatgttcagcttggcagtttatatgcatcaacttcagagcatcaaatggaggaagcatcaaacatagcaacggaatttgataatatcttatcgtacaaacaaaatatactcagtggagtaattactgtaatctccaatgaacatcaaatgtcacttttgcttttcgtcgaaacatagcattatctaatataagttagaatatcgatcagtcctagcttctacagtctatgcttgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgacctgtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacaccaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacatgtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggtcggcgagcgtaattaacgcgcgcacgatatgatctatctcgacctcatgcaccgcaagcgggcgaatgggattagtggaagcgtgggcgcgagaaacgagggggcgaaatagtgggcgcgagaagcgaggagccgggcacagcgttggcaagagtataaaggcactgaggaagggatttgtttccttcctttcgccattattccccttgtcttcgccgcttgcgccctaactccttctttcctgtgccctaccttcgccacacgcgctcgctcttaatcttctcttccttccggcgccatggcacggggctccgctctgctcgatggtagcgtgctgccgccctcccgcatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccgccattttcttcttccttcatggatgttctggagttctacgatctccagatggcgcacctcacccccaacgcgatgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgccgaaccgctacatcccctgcgccctccgcaagaagtgggacgactggaagagcgactggttctacaccccccttgccgacgaagtgcgcctccgacttccgagccagcccccggctcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcgaggcgcctgggagtacaccgggtccgaagacttcatgaggactcaccagggagtgagatgggactgggctcctgaggacttcaagatattggtccaacgggtgctgaatctcaactccgtggaggcggccctcattccccaaggaatcctccccctctgcagcgatccagaccgcgcctccatcctgaccattatgatggcggtcggggcctcagaggagcgagctccaaagggccacgacggcgcaggcgggagccgccggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatctcgttcgtcttctggtcttttcttttgtttcagcgagatcccgtcgcgtccctcccgccattccaagtccggccagcctgaggccgaggatccggcggccgcagaggcccggaggcgggaatctgaccggcgagaggccgcggatcgcctacgggtagccgaggaggccgtccaggaggccgcccgggctcgccaggccgaggaaaccgctcgggagggagccgcccgggcctgccaggccgaggaagctgcttgggaggaggccgcccgagcccaccaggccgaggaagccgctcgggaggaggctgtccgagcccacaaggccgaggaagccgctcgggaggaagccggatttcgccaggacgaggcgatggcaacttccgaggcagctcgcgacgaggccgcgggcgcgtcgcttgggcccactccctcgggcaacgctcaggcccaaccaggtccggaggacatccccgcgtctggcacgtccatcggcgggccgagccgcgtggcatcttctccgaggcggcttttccccacgccttctgctgccctactgagcgcagagccccttctgcaagccttggccgccgcaaacaccacggtgttggatgggttaagtgcccaggtggaggccctgcaggcagagcgggcggagctcgacgccgcgtgggcgcgcgtcgaagaggggcgacgctcggtggaggccatggtggaggtgggccgtaaggctcaccgccggcacgtctcggagcttgaaacccgtaagaaggtgctagcggagatcgccaaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggtggcgcgaagaggcccttgaggcgcgcgccatggcgctggaagagcgcgtctgcgtcgtggagagggatctggcggaccgcgaggccgccgtcaccatccgggaagcaacgctggcggcgcacgaggctgcctgcgccgaagaagagctcgcgctccgcctccgcgaggacgcgctcaccgagcgggagcgagctctcgagggggccgaggccgcggcgcaacagctagcggacagcctgtccctccgcgaggcagcgcaggaggagcaggcgcgccgtaatctggaaggtgcccgcgccgagagggctgcactgaaccaacgggccgctgagctcgaggcgcgggagaaggagctggacgcaagggcgcgcagcggcggggcggccgcgggcgaaagcgacttagccgcccgcctcgcagctgcagaacacaccatcgccgatctgcagggcgcgctggactcgtccgccggggaggtcgaagccctccgcttggcaggcgaggttgggcccggcatgctttgggacgccgtctcccgcctagattgcgccggtcggcaagtgggcctctggagagggcggatcgtaaagtacgccgccaacagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggaagagttccctcctgggaccgaggaccgcgcgcgtgcaagtccgggatgccgccgaccatatcgtcgacagcttcgagggctcggcccctcggctcgcgttcggccccaactccgacgaggagggcaatgccggtggtgcagacaacagtgacgacgaggccggcgacccgggcgcatcggattgagcccccagacccccgccattcttcagttttttcttcttttctttcttctaaggccttcgggcctcttttttgtatagatcaacttaatctgtaatcaaaaatgaagaaatttttgtgtcaattttatcttgctgtgtatatgagatgaggatgatctgtgccgtggtccttttgtgtcttagcttgattaagggttcgtgcccaggtcccagtcctcaaaaggcgcgggtcggggctagtgcctgggagatccacatgtcgagactggccaggccgggaacgtggtgaccgagggttatggatgacccgattgtgggtttttgccgattcccccccggagttcaccacgccccagggcacggctcggttctgggccccgtttggcgaatttagccgacccgagcccccgagggcaggattgagcacgagtgacctatttcaagtcaagattcttcaaaaggaaaaaacagcacagacacagcctttaggaaattgaaactgcttttattgaaatactgaaaaaaaaaagaaataagaatgtgcatgtgtggcagcccccggccaaccctgcacgcccgagggggtgcggggttggcccgagcccgaaacctgacacccgaccccccctcaggggtagaagcgacgaaggtgttcgatgttccacgggttagggagctcagtgccgtcgcccgtggccagccgtatggagcccggccaggggacgccgaccactcgatacggaccctcccacattggtgaaagcttgctcaatccagcacgcgtttggacgcggcgtaggacgaggtcgtcgatgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggctcgaggagacctcagggtgagctcggatgggagaactgcttccgcgccgtagacgaggaagaaaggcgtttccccggttacttggcttggtgtagttcggtttgcccagagcaccgctggcaactcctcgatccatgaatcgccatgcttcttgagtatgttgaaggtcttggttttaaggcctttgaggatttccgcattagcgcgctccacttggccattgcttctggggtgggcaggtgaggcgaagtagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgagcgcatcattgagagctgtcggccaatagaaaccttggcgaaaagctttaccaaccaaggtgcgcgaggcggagtgggctccgcattcgccttcatggatatcggcaagaagcacaacgctttgttcccgaggaatgctcttcaggaggattccattagccgcgcgccgatagagggtcctttctaccagcacgtagcgtttggagatgcgatggacgcgttcactccctt

SEQ ID NO: 26189 - DNA, 5394 bp, Oryza sativa
gcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctggctcgcgaggacgcgagccgtgagagctcgtcggccatcatgttatcccgtctgggcacgtgccgaagctcaatcccgtcaaaatggtgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtctccactcggagaggtcaacgtgacccccgcaccggcgccctgaagagacagggagccgtcgaactgcatcacccagtgggcggtgtgaggcagctgcgaggggcccgagctggcttcggggaccgagacgagctcgggagccggggtccattctgccacaaagtcggcgagggcctgactcttgatagcgtggcgtggttcaaagtgcaaatcaaactcagaaagttcgattgcccatttcaccacccgtccagtaccctctcgattatgcaagatttggccgagggggtaagacgtaaccactgtaacccgatgcgcctggaaataatggcgcagtttcctcgaggccatcagaataacgtaaagcattttctgggcctgagggtatcgggtcttggcatcccggagggccttactaacaaagtagacgggccgctgcacctttcggtggggccgatcctcttcgctaggggccgcatccctggggcgctcttcacccaagcggcctcgcggggcgcactcgtcttctgtgccgacgacctcgggatcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcggccttcccgcagtggcttcggggccgtcctgggggtcgggggcacctggcaccgtctgacaagcgggcagagggcctgctccggtcgtcgggggccttgggccaccgtccggctcgggggcctctcctccctgctctctcccgggccaagccagcacagggtgggggtgcgcggaatgaggattgtcctcatcgcactccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcttcgggcagagaccaagaacccgagaagcttgcccgcaggtataccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaactaggacctgcattttttaacccgaagggcattgttgtataacaataagttcctatggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaatgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgtgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgcgacatcaaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaacgatggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggtcgggcgctccctgctgggagcgccggcctccttctttttgtctcccgcaggcctcccctttcgggtggcccgcggagcgccctcgacggcgaggacatgaccctcgtcgtcggtatgggctgacctcttcttcctcctcctgtcacgccgccctgtctgagcagcggatccgggggcggctgaagctgccacaccggaaccggaggggttccaggtcatgcctcctccttacgagccactcggtccgcgagctgaaaaagctccgaggtagtctggggctctttggaggcgatcttttcgagcatacggttgtgccgcacacccccttgaacgcgtaaatcaccgcgtgtgcagggatgcatggtatggtgttgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacaaccgacaccaccaaccgggggcacggagggctggtccccgcgtccgtgttgaggtgacactctggacgaggaagcgccccctgttgcgtgggcagcacgtcggtcattacgccggcgctcgatgctggtgcgggcgtccggccccccacgcagatcttccgggtcgaaggagtcgacgaaggagtggctgccgaatggcgaacagcgcctgccgctcgtcgtgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcctgcagcttggagcgcgccctggggcgtgctgccgtcgccgtagacgaggagacgacgctccccatctcgccgcccttctccacctcctgtggatgtcgaagtcgtggatccttcagccctctcgagcgccttttcccgcctaggactttggcgtggagggggcggtggagtacgagctcgacggcgtgggtttggctccccatcgtcaccgctcatacttggggagaggtcgcgcgcctttgctggctcggccattgggctgaacaggaaaagcttggtgcacacgaaggagtgcgagagctcagaagatcactcgcagagtcccctacctggcgcgccagatgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctttctgtggggacttac

SEQ ID NO: 26190 - DNA, 6149 bp, Oryza sativa
gcctgtcgccacataacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacaatgcttaataaatattttagacatagtgaaagaagtgcagtgcagatgcataattaatccttcagcgcccctgcaacaaaaagatccttacagccttccagttccataatttacaccatcatcaacatcttctccaactgtcatcacaggagaattacgaaaaattatgtaagaccataatagagctgattgaggatatgtatatggtaatttaaaattccagcaattgacaactacttgtgggtaaccccaaagaaaggtagattataacaactaaaaattaagcattatctaatatagttttgtatggaagaccatacaaactacttgcaattttctgaagtttaaccatgttcagaacaatgatccagaaattaagcaacattctcctattcccccatgcatccatatggtgacattggtatacacaaataccattaactttaatctacagtacttcgaggaacttatgcaagcattgccttttgccatgccacacaaacaaaaaaatgattttttttcttctaaaaatagcatataagctagttgtaaatgatcatcttcatcatgcatgattaatattcataataacactttagacagaaacaaattgatagaggaattattatattcacatcacaaaaattaatatcttgtcaactttcagcattcttaaacatgttgcacatgacatgaagtataatcttatgaaaacatgttgaactgaactaatgcaacattccatttcttgttgtacatacataaaataaaaccagtgaacattataatgcacaaagtttcagactcaagtgtataacaaatatatggtgaatgtagaaaaggatgaccacctcaaccttcttctagtttctctctctagaaattagaacgtgtggaagtacaattcagccttgaaaacactaaacacttgcttgctagctactggtaatagagtgtgactctgaaatctgaacttactttgtagacagatccaaaaccaccttttccaagcaaactttcacttgagaaattattagttgcatcttttatgtcatagaaatcatacagtttaaagcccaagttgccctcttctaacctccagagagttattacattctgcattgccatggacagccttcgcagctccgatcttactcaccacgagtaagaactcatcgggaaatgcagcaatcaagaactcaccatgcccaaatcaagaactaatgatatggtttaggacgtgcggcagcggcggtggcgaatcaagaactcatccccacccaaccaagaaaaaaagctcattccccatctgatcaagaactcactaatcctcacccaaatcaagaactcactagatcgagcagaatacgaggaggaggacgacgaatcgcgatgacgacgggaaagggagaaaagaagaaaaccctaaccctagctttggaagaggaggggagaggggaaaatgctgcgtgctcaccggagagaagatggcggccggaggagagcgccgtgccgtcgccatcgccgtcgcctccgcgtcgcgccgcccccgccgttgcgccacctcgaatcgcctccgcgtcgtgctgccgctgcgcgtgttgcgcgtcgcctcccgctcccgtcatgaggaatttttccacgccacacgagaagctgattttttcccgggcctgggtgagggggaaaggccgggataggccggggtaaaacccagactgggcttaaccgaacacacaatttcagatgggccgggattgtttcctcgccggggtgatccacggggattgggccccgatcccagccggaaacggcccaaccgaacaaggcctaaatgaaaaactaagactatttgggggttttcgattctgaaagcagctacagctttcacaagcttcccagacagcaatagtagctcttggtcacttgtctattcaattagggtgggttatatggatataagtagataagtaacccaatttattcaataatcatttatcattacaaaatttatgtgtttttcaatcatctatgttgcacgtatgctcgtattttattcctttgttttttcctattttttaatatttttttcaatcaaacgttttaagaaggggcccatagtttaatttcggagaaaaatcctgtaaaatttgaccatctataagactataatataaacgaggcagcaaagcgaagcactgtgtgatagtactgcagttcctagtgctaccgctaccccattatctaattacccgtcattggtgattgacattcaatagcattgtgcgttttgttatcagaaaagaaaagataaagcaaatagtagtaaaagtaaaaaaaaaaaaaaaaaaagagtacagacaacagactgtacagtgccatgcatgtggtagtataagcaatcgctatggtttgctaggacgtaaagtcaccatgacatggtcactgacaggtgggcccgagagcggtggggcccacatatcagccaccatgctagctgtgtggtaatagtatagtacccatgtataaaatcttggggacgcactgcaaagggccacatgggcatggcgagccgtgagacccacacaggtactggctttttcaaaccggggaaagctacacgtacgctgtaccaacagccgtaaagccaagcagaagcttttgctgtgcgtgcgagaaacatgtatacggacgacggaaacaccggtcaactcctgtgcgcatatgcaaggcaaacgcagcatcacacagacagcttcacgctagtacctttcccagtacagagtggataagcaaaatggattaattgggtagaatggtttatgagtcaaggaggtgagaaagagaaattgctagtgcctagtggtagagcattgttgacccctagaagctagaaccggctcataaaatcggatactcccttttccctgttagatcctctattttcaaagataccatatctttatcattgatatataagtccaaggtttatcgggtccacatatcagtatatcagtgacaaagccaaatgcttttgaaggtggaggagcttgatccaaattgtatggtccggttttggatattcaaaggaaaactttatggtatgagaaacattttatctctttatttctttgccttttacatttccaaaccctaattaatattctaccttcgtctctatagcaattgaagacactctaggtgccctgccgattctagagcaagcctaggtgcacctaccctaacggggttcctcctgagcgggggttcgtaggtcttcaagacgattatgtgagaacaggtactctggtttccaaaacagggtaatccgtaatcggttttctcaagaagcgttacgagttgatctaattgcaatccacacgttgtagtgctttggtgttttgtctatctcaatgtcaacaagcatcacaatgcccatttaccttcttggttacaggcaaagaaaatatgattacatggcatgtactcgatcttctctgaagattcagacccgatatctcaatcttcataatttcggtcaataagatttcttgaaccgacaattggttaaccgatatgacggtgtatccagtcttagctaacttgaccgaacactcccgcgtaggcagactctagtgtaggggatggcaattttacccgtgggtgcgggcattcgctggtaccacacccgatgggtatgggcatgtgtacccaaatatttctattcatacatgatttttttttaaagtgtcaatactaactaaaacatactagctgtgtaagtgcaacaaagtcatatatcactctagcttagtcatttgtctttttttttcttggtgatgaaataatttgtaattgtagaatttatggattttggtccgtatttaatactttgtgattatacttattgagtaaacatagatgtctaattgtgatagtttagatatatatgtatcaattgatatatcacatcatgttgttgaaaaatccatggatacccgatacatgacgggtattgacatggattttattttacgatgaaagcattgggcatgggtgggcgagaactttgtcgtcttgggttgggtatattcttactccacccgaaccaaacttgatctattgccatccctacttagggcccctttcattcgcaggataggaaaaacataggaattgaagtagtatgattcttcaatcccgtgggaataaaaaacataggaaaaaatgaaatgtgccctttgatagtgctataggaaaaaacacaggatttcttttccaaagaggtcagacctctttctttttttcctgtgaaaatgaactaaagggatgcaatccttaggaatgttttctttcatttcctatgaatcaaaggcctccataagaaataatccataggattgtgaatcctaaaagatcctataccaatcctttgaataaaggagcccttaatgggaacttgagtctgctggactctcctgtgacctgtcgtagcgaaggtggacttaagtttggccgtaataatcggtttgctcaggtacctgaggaacacgaccgaaataacgaaaaatagatcggatactttggtctggctcctgtttttttttccttggttctttctgcacaccccaaaagacatgcctatctttgatccaagtcagcttgctttcaagatttcaccaaacctcagcatgatgaagaataactgtagttctctgcagctcagtaaagagtagggacttcagacaaaaaaaaaagaaaggtatagcgttcaattttgcagaaagaaactttcattgcctaaaattttgcacaaaaaaacatttattttcgaaaattatcaccaaactatatattcatcgtaaaatttattattcccccgtccacaacaaatataaatattcttagcactgctattcttgtactagtaacaaaaagctcttcttgagttctgagctcattccaacaaaatggatacaaataaagcataatattaagaaccaaagtactactccattgtagtaatactctctccatcccatctcattttaaatacagtcgtgagtcatgagtttccatgtttaacatttgatcgtctgtcttatttaaaaaaattttaaaaaattttaaaaataaatgtattattcatgttttatcatctaatatcaataaaaatactaattatataaaaatttaaataagacggacagtaaaatattgtacacagaatcccatgtctttacttaaaatgagaaggacactacagcagaaacaggatgtagagacggttttcttctcttgtagagacggttttgcccgtctctaggtgtactagagacggccctgtgtagagacgggtttcttctcttgtagagacggttttgcccgtctctaggtgtactagagacggccctgtgaaccgtctctgaggcgttgccattgctcccgtctcaataaacaagagacggttttgctagccatgtctactaggtagagacggtccatagagacggaaaaaccgtctctacatatattttccatattttgtagaaatatcataataaatacactagacacggcttcggaccgtctctacatataaatttcttagatacagaaacaaaccttctcaattctggcatccacaattttatttggagaacatcagactgcatcacactttagcattataaataaaaaaacaggagggacttgtcgaaaaatcacacatttcactcactgaatggtaatttacatcttacatgaaaaggtgaacttctggaaaaaaa

SEQ ID NO: 26191 - DNA, 3880 bp, Oryza sativa
tcctaaaccaatgtatacctatgtggattctcaatagaaagggagaacaatgaaattaccttttctttgatgaagctgtgcaactcgatctgattcctcacggtaggtcaatccgtcgtgctagcactttcaatcagccaatcaggggatcatactctgaatcagccaaaaatcagagtctcatccctccacaaatctgctccccacgtgttcatctacctagcgactcgcaagatctgaaccgcgccgtggtggctgcaatggagtggcagcgcagtggcgataggcagcaacggccagaaaggagaagcgagagtgtaggaccggagcggcggtggtcagcggtggcgcgcgatggtggtggaggaggcacaccggcgatctggagcgggcgcgcggcggcgtgcgactccgtcgagggtttcgatagaccaacgattgtaccgagcagttccaaaaataaatagtgattatccgattaattaataattttaaaggatattatgatggtgggtgcagttaagtggggaggtagccacggtttatctctccgtctcttttatccgactctaggtgaggggggatttctcgcacgtacgttgggatagtttagtagcaacggtttgatgacccgtagtattttagtcgtctctagttgcctgttttgctgtagtgggaatagcatctattcacagtaatgtcgtaatgtcgtactataacaatcacaggttgagtttaacaaccacatgttgagtttaagctaaacagtggggggtaagtgggagacactgatctgttatctcaccataatcacctgatgtaaccgcacggccaagtaggaccttgcggccagtaaaaagcttcagagaccactgcaatggccatgtgcccttcgtcagtttctgggctacccctgtcctgctgtccacatatgacactcttacagcttgcaggtagtactgttgctaaacatgtgaacgtgtggcaggcacttgcctccaggattaaccacagaatcagtataatatacgagtagttgttatacatggaagaactgggtaacaacatcaattgtctgatggcagtagtaaacaaaataactgctaactgccacatagtactatattctctagtataattaggcgcaccactaaattatttatatatatatagagtagtattatatatagtagtatatcacaatacttcatatgctgccactttttcttccataagggctaatggcatcttcttcttctcgtgttgtttaatggagctatccactaaaaggtgagagaagcttaaaaacgaaaagaaaggggagctaaacatcctaaaaactacgctgacactccactccttttttcccctatattccgataacactttctttgcttcatgtattcctgcacagaaataaacaccaaaagaaagaacgcaaaaatggcagcataattagatgggtagaagcctaataattgggaaacgtagtgggaataaagcagtgcttactatgatttctggagagggtttcagccacttccattgtggactactttacatcccgatcgccccgtgctcggacagcctgctcattgcatttgatcgaatcattccaatcgcaagtgatcacgaaatgaccagtacaatcaagtagtaatcaactgctcaaagtagtggcatggccaaacctgggcatggggaaaaagcaggtccttggcgaaggtatgtccaatgtgggaggccggagagggttggcgctgccgaccgcactgccaccaatattgcagctactaccggtggtgaaatctccctcgctaccaatggcagtggcagcggttgcggtaaagaatgcggtcgacttggtagaggaagcaaacgggctgtctggcaagttgtgctcaccactgctcaaaatacatgcacaaacaatggtgaagcaaactttcagccacggaataattgcagatttgtaggcttgttgttcatgagttaatgacattagtctgagaatcatgagcaagcagaatgccaataatggtaaaaatctacctttggtcactatcggcattgcgggtaacctcaccggcagaatccgccttattaccaccattgacaactttcccctccgatggagagccgcagctcgccatcagttgcccagctgacaatgtacagtggatattggcaagttaagagaacttgattgattgacgtctaaagaacgagttcgatcaatgctatctatgcttactagagctaggcggtgactcgacgattgtggtggcaccgggttggccggaggtgaaggcattggtgatcggagtgggcagagacattgttgtcgtctccgccgcatggacagcggcagaagacttgaggtcgagcagctggaggccaatgaggcggcggctatggagatcaatagcctgctgcagctccgccgcctgttgctgctcctcgagcttccgccgcagcattagctcgttcgcgctgttggagtgctgcagcatccttgcacctgacgaacaccaaaccaacatccatcaaaacttacagctctagcaagcaacattgaacatcaggcaaacagggcgtccaaatggtaggagcaggtaaaggttgaatctttttataccgagctggtgaaaatcaaaggggtccctggcgtctaaccccgtgggcgacatgcagcagaaatcgccttgctgctgcttcctgaggagcgacgaacaacaaattcacatgcatgcaggttggtggctagcagtcgtgacaagcaacgtagtagtatactactactactaatttggagcgcttaacataatcgcgcatgcatttcttcattcaagccgcgtttcgaacgtacctgtacttgtcggggaccttgcccttctccttgtagggcttgacgagcacgcgggcgtcgcagatgaagtgcgggttgcccttggccaagatcagcttcaccgtctccgggtaaacgaaggtgacgaacccgaacatgcgcttctgctggtacgggatgcgcacgtcgtgcaccggcccgtagatgctgcagcgcggcgcgttgccaagaacagcaatgcaaaaatgccaatcagatcgcgtcctaccgagcccgccatgaaagaaggaagaagcatcattgcaacatcgcattatatacctgaagtagttggagacgtcctcctcgcggaacgtgctgtcggccgggaaggtgaggtaaatctggcgcgacccggggttcatcatgctggcgaaatcgacgcggtccaggcgcggccgccccatgaacttgtgcgcctcgtcgccgccggcgagcatcagcgcggccgcggcggctcttcacacgcgcaagcaagaaacgttttggaactttgaaatgccttctggcttggagaacgcatggaggttgcgaaggcggtagtacctttggttgtcgttgtgctgctgctgctgctgcaggaggaggctgaggcacttgctggtggcggatggcgaggcagggagagagcctgtgggggtgaacgggaaggcggcggggccgaggcgctggctcttggagcggaggaggaaatcctggcactgctgctgttcggcggtggttgcgtccatggcggcgtcgtcggagaggccgccatggacgaacctgcaggtgctgccgttcttgcagaacccgcgcgcgtagtacaggcaaggtttccacccgaagccgtcgccgccgaggcagagctcgttcaccgacgcgctgcggcggtgcccagggccgccgttggcccaggcgaggccgtaggggagcatcccgccgctctcgccggggccggggctccggcactccgctccgtcgaacgcctggagagcatgcccggggttcacg

SEQ ID NO: 26192 - DNA, 3057 bp, Oryza sativa
catgctgttactcctcgagaacggctgcgcctgcgcccacgactacggcgacggcgcggggcagcggccggagttctgcctcgacagcaggaacggcgagtgggctgccggcacggtgggcgacgacgacgccgcctgaggcggcggcaggagggcgagctccttgcgcgcctgcgccatgacgctgtggagcagcgcctcggggccgaaggcgaggcgtatcatctccttgtcgccgtggtcctggatgagcaggaggcccatgatcttggcggcgtggtcagggtccagcgcctggatccgggagaacaccaccttggtcgcctcgtatgcatccatggcggcgcccaaagcttctcttctcctactcctaccttctcagtcacagcctcacaggcgcctttgcctcttggtcttcagttcacccttttaccacactactactagtatctgtgttggactattggtgctgtgtttacacttattacggccttaaatatacaggagctagcgaagcaagctcgatgctagtggtagatagagcaagatcgaggaggcagtacactagctagtgcttcttggcgtggtccggttgctctcggtagcctccgcttcccggagctgcggccactgagccactgagcagctccatttcccaaaggattgagagtgagtagtcgcgagctcgctgcgcgcccctttcttgagcacactggcctgagcatggctttcttgggccgggagtggactggtggagtgggcggtgcgcaaattttctgagggttttggggtgatgtgcacatacgaccagtttcgtttgagatggcccacttgtttcgaaacgtactccataattgtaaaaggaaatacaggaatattccctctgtactcataaaatcgttttgcacagcgacgtggtctccaaaacataattttgacttttggtttctataaaaatatttattgaaaaatgatatatgtatattaatataatttttacattttcaaattcaagaactcgagagttattcatgatatatatttctaaggtttgacttaaacattgttctaaacgacttctaatacgagtatggagggagtactcgtactaaaaagcatatattaaggtttttttaaaggaaggtcttcttcgatttatagaaaaatcggaggattttaattttattagaaaaattcctattaaggtcttcaaaataaatgactgaaacatgttgttccctttggaatgcgcatttttaaagaatttattgaaaagtgagcctaaccattctcttagaaaatttcttcaagtctatctcattttatttctatgtttttttttctacagtctaatcaaactatcatttctatgtgatttgtcaggttttgaaactcattgttttgctcttgtagtagcggttaaaatcctatatttttcctctttttttcaatagccctaaacgaacatcattctctttagaatacacaggattttaaaacataagaaaaattgaggtaatgtctttggacgattccaagcaaatcaaagcacatgactggaagttactcgaggaaaacaaaggaagtagagaggggatgaaagagtggattagacttctcaaaggggaaactcctatgttttaattattttccttttagaatccaggtgcataaataatactaccattttataggatctcaccaatcatgtcacatgctccttaaaaacttgagattgagaaaataaaggaatagaaatgcccatttgattatatcgcagtaaaaacacagaaatttaagagcgatgaaactcagaggaaattttcggttagtacatgattaattaagtatttgctataaaaacacaaaaaagattaatataaattttaaagcattttttctatggaaaattttggtataaaacacacaatttaacaacttgggaagtatgcacgtaaaaaatgtgagagtaaaagttgggaacctgtacttccgcgatggggctcctctaaagtacgttagagcatgtacaacaggtcaacagcatattttaagcagataaaagatgggagataagagcaacgagctacatatttgtagccagcttcagcacagactgcaagatacatgtgtgtatgacaggtgcgaccatacattaattttgtagtacatgtttataggtaactattatatgaattggctattaaattgattatagataattttgagctaataattggctatactattaaacttgctcttagatggatgtgcctctcttacttgtggatccataggagtggaccccacctgtcaaggattcacgttactttctctaacctcgcttcaaaggagctgcttcatgtatttatgggtgtgttccgacttgaaatgaggctcgtatttgtgactaattattatttcaatgataactgacaattatcgacaacgatgtgtccaaaatgacttcgttaattttaaaatatgccaactcgtcttttagaagtgcttttttttaagaaaatggattaaaatccagtctctatatccacaatgaatatacacaacccaattcagaagtgctattggaaataaaaagtgtgtatatgtgtttgaactgtgttttagaaaaattatcgtaacaaattaaatattaactatattatactaaatagtaacaaattaaatatcaagtatatatattatagtaaaagtataatcaaatatcgtttttgagggtttgttcggcatccccttttcccaacacatctctctcgtttttcacacgcacgcttttcaaactattaaacggtgcgtttttttcaaaaacttttgtatgtttctatacaaaagttgcttaaaaaatcaaattaatttattttttaaaagaaattagctaacacttaattaatcacgtgctaatagaccgctctgtttttttgcactctgttccggttgggaacatccgctagcgcgcacagcccgagtaaagcctggagcattcacaggtaagatgtactactcacgttgtactagcagttattttcagttgacttg

SEQ ID NO: 26193 - DNA, 6084 bp, Oryza sativa
aatgatgcaacaaaaagattcttctgcccatctcctccaccaccattccacacaccaccaaatgtacatttcatgtgagtgcatgctggttcgtcaactttgagagctctcacagcaacagccctgcacttggaataacttgcaccagatgacaaacctgatgcttcgaatatatcgtcaccatatctgtattgtcctgtgtacaatttacaaggacaattagaatccggtaccatctttccaagaaaacgtaaattgatacaactgaacaaaaaaaaaaggagagaatttcagaaagctacaactattttgttaaaattatcagtatgttacaaatttaaccaagcatttcagataactccaactatagcatatatgattttatcaaaaagctgcaaattttatctgtttgacaagtttgggcccacctgtcatatacacatgaaatactcatgctgttgtaaattggacccagatgtgacacgcacagagtgaataaaattgcagtttctgatgaaattatttgttgttattgcagctttgtgaaatacctagttaacgttatagcataatgatagttttgaacaaacaattgcagtttgtgaaatttactcagaaaacaattatggggtaaatggtgcgtgtgtgtatacatattttctaaatttatacattgcgaccataatttgccaatagaatagtcattcttttaccaaggccttcagaatatcgaaaatgatcttaactaatattcgatgattggagaatttctcaaggaaatccaaatgacattctgtatcttggtttctgtttcaataatgagcttttgctctttcatgttgacatagtttcaatgaagttcacaggaaatctatttaaatttccaagcaggcagatgaagataatatcatgttggctttgtggattaaagaagatgcgggcaaccataccatgatgtccttccaacatacagttgcggtaatcattgccttcacctgcttttaaaatctctgctctagccgccagcaatccataacgcaaataactgtagaaagcaatgtttcttgttattccatgatcttttacttgtgatgttggttccaacatttgttcatcaaaatgtggtaaaaagaaaatgttccatttccatgtcagatttagagtaacaaaaagaagtgatagattggaatcgcagtgtaaataacagtgcagaaatcactttgcagtcatatgtacaatcttcactgatttcatagatggaatagattttgcgatgccagtgccaacaacagttcatcagaatattgtcaacaacattgttcatgtcccattgaaagtaacagcaagaagtaataaaatcaattgaaggacatatgtactgacatctgcattgcaaggaaacaatatccttaagttactagttcaacttctcaactttcttttagcccaggtgtgctttattctatttctgtaatgatcagcttctagttgcagcttcctaaataatgtcagggttcctctctttacagttctaaaacacctaaggattgagattaaaaaaaaattacaagatactgcaaggcaatcctactagaaataaagactagtcaaaaattagtttcgccaatatttcaatacttatgacagattttagacatcattagtacgatatcttggtacaaataataacgatgtaaaatatctgtaaaaaactggaatgcaacaaaccatttgacgtgtacctgtgaacataaagataatatgttgttcccttaagtagaagctccttcacatatgaatcttcaccttctgcaactggaggagcctttcctgcatccttctctgagatggcataagccatttggacagaaccaccacctagatcaaccactccaaccgtgtgtgagtaaggctttcccaaatttcccaacagataattgatggtaacctaaaaaacagcaaagaagcactcatgtaatcatgttgatttttttttttttttgtatggagtacaaaaagagcagcatatggagtacggacaactttgtacttccatataagaaggggcaagcaggcaagtggtggcaatgaacattgctaaatccaaaggaacaccaatcatagaacctttttatatttgctaaaatagactaaataagataatgatctggggcatagaaacaaattaactttccatacccactggaatgcaccttcctgagatccatctagaacggtaacccattctggttgggatctgaaagagctcttgtcttgaagaagatcccttacctaaagaattcaatgaccaagtaacaaaaattacaagagagtacaaagcataataaatcttacaatctcaagtgagattataataaaaaaaggcagtccaatcttgacaggaataagatatgctacagctagcttatcacaaggacaatttaccgcttgcaaaatttcttcagacttttcagtccctaatgctctcaggcctgcagtagcctgcataagggtgaacatcacttcacagaaaaaagatgttatggaaagtcaaaaaaatgtgtttttcagcttccattccatagagtgaaatagaatggcctccacccaccccaaccctgacaggagtttgctcacgtaattccacaggaattactttttcagcttcctctagaagagaaacaagtgacttagcagcttcttgtgggtccatggcataggcactgaggcctggttttttctggcaagaggcaagagaaaaggatgaaggttcagataaaattgtacattcccccagttctatccttcttcatttatatttagaagttaggagtctccgcaacaactgtatgcatgaaatttttcgagaagtagaacatcttaatcaaggaagtaaactagtggtgcatacttctctgaacaggatgtagctcttggcaattttacaatgtatctacctagaaatctataatcgacacatactttaaagcttcagataagctttacccggcatatatagcccaaggcccagtgcctgtcagcaatttatacaaatttcagagaacagttatctacagtatataagaatgttcatacactctcagattttaattcaacgtccatcttcaaataatataaaggggtaaactgatcaataacactagaaagatcgcatgttgtaaaatcacattgatatgtcaatgacatatcgaccttggtcccaattctcacctgaatgctgttttccaatctatacatgtttgcaaattgcattgttcctagaaaattttcccaaatattaatgcacttgcaaaaatattggagcatctggatggcatccacatatatgtgtatttgcttgccactagtttcagctagtttggaaatacaacccagttcagtactaagtagtcttaaatttgaagttaaaaaaattcacaaagattattttctacaccgtatcttttgtctcaatactcttacaaaagaccagctaattatgtgtcacacttacaacgttgcctggctgaatatgaagcaatgcatctgatcacaggcattctaaacttaagcagtgcgcctaattgcagcaagccaggcataataacaaagacaggttaaattgttaaatagctgtgaacatcaataggtggtttcatggttttaacggcttgctgtcaccaactagcaatgtcagcaccaaatgctacagttcagcatttcatagtatgttactcacatgtgcttgctttgcagaaacgaaatgatcccatttcaaattctaaccaggatcaattatccctataagcatgctaatataagatcataacaagacctatcccgatcggatccacctgatagcaccccatatttcacaactaaagataatcaaccaaaaatgaaacgcggccaattcacctgcttgaacagctcgatttcctttccaataggcagcagatccaggttcccatcgaagcagtacacgtgcacgcggctcccggagctcccggcatcaaatatcacagcgtacctggtggatccgtccccaagtccgctgacggcccgggggccccacctccgtccggcagcggcgacgagctcaccggcagagccctcgacggtagcggaggcgggcgcgcgaggcatgagaaggagcacgagcgagatgaggagcaccggcgcgagcaccacgacgaggaccccgcggaagcggaggacgcggtcggacacggcctccccctgctgctgctgctgccgcgccccggcggcggccgagaagcggcgcatcctcgcggcatccgcggcggaggggccggcggcggcggcgaggtcatcggccgggagtaggtcggccgccgagggcgagcggtagcggatgcggccgttggtcggggacggcttcaccgcctcctgctgcggcggctccagggcggcgggtcgggtgcggccgcggcgcgcggcctcggcctcgtgggggcgcgtggctggaggtgcggctgcgcgagatctcccccgtcgcggctcacggcgaccggcggtgcgctcggcgccggggcggcattgcgtgcggtgcgagcgatcggagcggcgaggtaggcggatcggtggtggttcgatcagggaggacggattcgtggtggagtcgcgcgcgccgctcggggagagcgagaccgggacggatcggacggtgcggttcggctcgggagtcgggacgaggtggtttgtctcgctcgctcgcgtcgcgtctccggggacgggaatgggaacgggaggtgcgccttgggccgcggccgccacttggctgcacgctgcagcctttggctctctccgcctccggtggtttttacgtacctttctgggttgaaactgcgtgtcacgccaataatcgtgctctcatcttcttcttctttttgtctttttgtcataattgtgtgcatatttatatgagcgtttacgtttgtactgtgttttgtaagtgaatagaagaagtaacttatgttttgaaaatatgtaaaaaaaagggggtaaaatgatctcatttggcgtccgataacacggctcaaccggttagatttttaatggtgcaaccaacccattctggttcacatactagatttgacgcacgtgcttctattttcgactaattgtttatttcagtggcaggcaacatacccggacagcgcggcgcacgttgtgattttgtcaatcttaagatatatcagcaaagcgtctgtgatgattttgtcaatctcaaaatacaccggttcagtctttcggatatgctcatagggatagggtgtgcgcgtgttcataaaggagattatgtgtgtgttacgggtacatgcttttttattatgcttctaaaaaataaaaattttaaatttgaatacacatctaccaggggaaaagcattactaggaaaaagaacccggtctattgaaggatatcgagcttaaactgaagggccgttagtttggcgcattattttgttgggcctttgttggaaattaagagagatgatgggtgggaggcgatcagagtaaatgggccagaacattactctaccggggaaaaagtgcaccgaaagtccctcaacttgtcatcggggtacagaaacatcctcaaaccacaaaaccagatacgcgggaaccgatcatccgaggtccttcggtggttttgactccggttttgtctacatggcagctgagtcagtgtgggacccacgtgtcagcgtgccacgtcatctctctctttcccttttctttttttctcttctttttttacttctctttgcggcaggggagtagcaagaacgggcggcggcgggcggcgaaggcggcgtgcgagcgcgcggcggccggtgagcatggtggtcgtcggcgttgccatggtggttgtcggcgtcctcctcgtctcctcctcctccgcgtccgggtccagccgcggcgcggtggccccgccgcatcgacggtgtgccccgtttctccctccctcgccagccgtcgggacgacccgcagcgcttgccgcgacctccacggccacctcctgcgcggccgcgagctccgcgtcggcctcgccgaccg

SEQ ID NO: 26194 - DNA, 2531 bp, Oryza sativa
cgcggcgatggccgtgcgcccgtcgacggagcggactgccgtggcggtggtcccggcatcggtcttctcggcagacggccgccctcctcaccgcacgggacagcagcaggccagcagcgccgccctcctcccgcctccgcgccggccgcctctctcatctccgcacgcgtacgcttgcacggtcagggacccggagcacccgtcgctggcgtccccgacggagaactccagcctgtacgaccgcccgggcacggtgctcacctcctgcaccatcgccgtctccatgccggacaccagctcaaccgcgcgggcgccgcccggcaccgcgtcgatgtacttgacggacttggtggtcgacaggatcgtccacggggacagcggcgtgtggtcgtcctcgtccatgggcggcaccagcacgccccaggacgtgttggggaagatgtacgggccctcctcaaagcccccattcttcagcatgttacctggttcagtttgttcgattatttcactgtgagcacatcctaattgtattcaattttgtagagatgcacactgatagcagctttgtggagaggttagcacccggctcaattagttaattacctttcgttctttgaggaggttgcggggtcttaatggcgaacgagtcgatgagggggccgcgagcttcgtcatcagagacaccggggttgtggacgatgaacaacacgacgctgtgcttggccttgaaggcccaggagtaggagtcccagccgctcggacccgttgttgccgaccgtggccagctcctccttggcgagcatagcacgcagcacgacgcccaggtcgtcggcaagcttggcgaggaacgcctagatggagtaaaaaaaaggaagagaaaaaagaaaggggaaagagagatgacgtgtatcatgctgacatgtggggcccacgtgagacccatgttgactcagccgcctatgtaagccaaatccggggtcaaaaccaccgaaagacatcgggtgaccggttttgtatagttaagggaccccgcgtatctgattatgcggttcaaggatgtttttctatccagatgacaagttgagggaccttcggtgcactttttccctctaccggacattagaggtatgggctttttgcataggatccgataacaacgtgtccaacaccggtccgtctaaaataaacacgagtaacaggattatactaccctctcgatcatattatgtttaccaaacatgatgagtaaccgggtactacttcgtaaccaaaatcaaccctagtaatatttcgtgaggcgaaaatttgatgtaaccaaaagtggtaagataaaagatgtggaggtaatatttattcgaaaccactttggtgtagttgttaaatgtataaattttcagagctaccaaaatttagtagcataatgatagctgaaatatattcgatttatcatgttagggttggtttggacaacaaatcaaacacgctgttaagtttacacgttgtattaggggccgaaatggaccagacatgcacatacagacccgctattatattgttttatttagtacagtatatattttttcaagatatccaggtggttcttctttcatctatactagccacgtaatcatgcttcgtgcaacttttaatcccgtataataacttttgtatacggtatattagttaattgaaggttttagcatgagttattttttttcaaagtatcaattggcctacctaactatatatatatttagttactatataagaaatcactataagtctcctaagtttttctctttgttttctttgccccctctcttttttatcacgtgtctaagaggaaagcaatagaatcctcgaaaattcccatacgtttatccatttgttgtttctgttaggaaatgataggcgaacaaatgataaaaaaataatagatcaatcacagaatacatgagatttaacgtggaaaaccctctcaaagcagtagagacaaaaccacgggcgccagccagcaaaattcttcactatatctgaggtaaggttacattgtcgcacgacggcttacaagaggtatatatatatggtggaaccctaaaagggatgacgatccggcccaagcctcccggcgacaagcctccgctccactacgacagaagctggcctttattaagtgcaaataaatttggatcataactcaacattttccaatgcatgtgtacctttttatccactctttatcccttgactaatatgtcttgatgagatgtggcgtatcctcgtagtaaaaatgttttatgctttcactggataagataggataagatattccatataattttaacctagctactactatactacatatttaagtttaacatgtaaaaatggcactcacttctttttctacgcatgacaatattagtccaattttaaaccaactaacgtcatatattagataacgaaggcagtacattaatattatccgtgagcaattattaattagatcttaaatttgacataagcatgct

SEQ ID NO: 26195 - DNA, 2402 bp, Oryza sativa
tcctgcagccctatttgtttttcaaaagcaaagctagcgcatatatccggattatgcagacgaagccatgcattaggatcgcttgaatatggacagagacaaataacactagtcccataaactaatgggagacaaatgcaacgaggcgttgtcacatctacctgaaagcctccatggccgtgatgcatgcaaggacttgtctgtctgccttaggaaagggctttgttaaagactgttgaacctgagtagtaccagtattattattcgtgaaaacagagaagaaaaatggaagcgacgcattgcagccttcgcatggttcatgaaacgcgcgcgaattaaagatgctcgatcgctcgtgacaacacagttcacgaccccgcggcatcaagaagccgcacgcatgcaagcatgcaattatgtactcgtatcgtgttcaaaattctagttgtactcttacttttcttgatttctcaaaaccccgtgccttgattagttctcaaatttttttcctaaaaatgtcacataaaatctttggattcatacatgaagcattaaatatagataaaataaaaaactaattgcacagtttgcatgaaaatcgcgagacgaatcttttgagcataattagtccatgattagtcataagtgctatagtaacccacatgtgctaatgatggattagttaggctcaaaagtttcgtctcgtggttttcagacgagttatgaaattatttttttattcgtgtccgaaaaccccattcaatatccggtcaaacgtccgacgtgacactaaaaattttccttttcacgaactgaacgaggacttagctcttccttccatgatacagggcaccgcgcgtggatgtgaacaggatgccgagataattttttaccatgtcaagtttttttttaaaaaaaataaaattttatacttttaaatttttaatttttaatacaaacattttcaggacttgattttaagatctaatttttttaaccacatcagtcgagccagcgtgaccaacaatactgtcacaccgatctaaataacgtggcagagttatttagcgcgtaggtttgtgtcagggtcatggataccacatacccaatagtaatcgactaagctcggcagggcccatcacataccatgtcttatacggaaacaaacctcgtatatagaaggagttctggataaggaatgacgagtagagttctatatgtaaacgacaaggactactcggatcatatctatatttatctccctagtcttacttggataagaaggattctatgggtataaatacaagcccccctaggaaaagaggggacacacccaccacaatctatgaagcaaatacaagccaatatgctgccagatctcgacatcagagatgagcctagccataccccatctggcacctacaggggccggcaagagggatctagcgccatctcttatctcaccgagtacggattcgaggaggagattaccctgtcgtcgactacgagttggttatctagccgccaagtcgacgacagttagatatgttatcctaattattgtacttgtgtgattcagatgaataaagaacaacaccagcttcggccaacaggatgtagggctattacctgtaagataggggtccgaacctgtataaaattatatgtctccatctcttttacctcaatctcgcatataccctgataccaacgatccccatacatccaaataccctagtcgtgtcgacaatttgctggtgtggtagtgttcttctcctaatgtattaggataaaactatatatgacacccgctgcatgttgtatgataatgttattttgggacgttggggtgattggcttgatggaaaggttcatatttttaaaataaacttgaaagttcatttttgaaattgtgtgtttatttcacactagaattgaaaatttggttgaaattggaacgatgtgatggaaaagttgaaagtttgtgtgtgtagaaaaattttgatgtggtggaaaaattgaaagtttgaaaaaaaaattagaactaaactcagcctaaattaaaaggtaaaaaaaaaatcgatcgtcgatcggctatgcccgctagacgagaggattgctcggcgcctgagccgtgaaggtaggggatattctattgcaccgtgatcttgtgctgcctcctctcctctcgtgctggtccttgcggtaccacatattttggcccgtgcctctgttggatcgctcgcgcgggcgcgacagtctgcggctgccaggagcgcagctttgactagcagataacaacggcgcgggaattgaaggagcaaggccggtgggtgggagtcactgatcaccatgtgcctcttgctccctcttcagatgcctaatcgggagtactccgtaat

SEQ ID NO: 26196 - DNA, 3105 bp, Oryza sativa
aaaaaaaaacgacgaaccagatcgctgtagctccacgactcgtcgtcatcatccagtctttcgcctccatgcctgcgcgctgcgctgagctgcatgcacgcgattctggccttggtggcctagctacctctgaccctccttggattctgaccctttttcgtgcactcacatgccatgctttccccggtttcccccctccgaaaaaccaaaagcgcccagccaaaagtgccggatggacgcatacgtaaaaatggccgccccgtggatggatggatgcaattttcacttttatgattaccgcgcggatgcgcgaggacacgcgctgcactggcacgggcacatcagcacatggctgtgaacagcggaacccggtcatggctgacgacgggacgaggcggccaggtcacaggccatgctgcgcgcggcggaggaggcaggggcccctctccctcggcccagcatttgcacgcgctccgcgtacgcccggcgtcccgactcccgcgcgtgccgtgcgtttcgccgccacaccacccaccaccagtccaccaggttgacgtgatgttaaaggcgtgagaaagcaacggaggatttcggatttcgatctcacgcgcacggagagaacgagccgcagccgcccgtccgtgccgccggccgtcgtcgagctcggtgagacggtgtgggcatgtggagagaaacacctgtatctccccccgaagcctgaccgagacgtgtcacaagagtggcaaatagttaaattagccaaagtgacaaataaacggatcctgtcatctggttgggagccatcgagaaactttgttttcccgtctggtcactctagctaactgctggaaaagctagcgaacgtgcatggagtcctcgtgcggtcctaagagaaaaaaatcattgtcttgtggtgagattgaatcccatgattcccattcgctgcggcattagtggacgatgtactaccggagtagtatacgtgcaacgagagaatgtttcactgtcagcaaaagcggggaactttgacgcgaataattgcgcctattaatgagagaggatataacaaatgatggatcctggatgatcgagtgcgagaggtaggtgtgttggttgcagcagttatttttactctaagaggaactcttgtacgttgatctaatagctcaggctcccttcaaagaaaattcataaaaatttttatggatttcattcatataggaattttttctatatagccatttgaattaaatgaatgaattctatgaaattccaatggaatgcctctttacatataaattttgcaagaaatttaacatgaggtagaacctcatgttaagtctttatctctcctcaaattcctgtgttttttctacggctcaatcaaatggttatttctatgtttttcctgtgttttgtaatcctctgtttacacttgtattcctatcagaacctatatttttcatattcctttttttttccattcctgttattcaaagggacccctcaaaagttaaattttctggaacagagatagtatagcgagataatattgcaaaaaagtggagatagaaattttgtcaaacaaataatactattagaaagtatggttataaaggagataaatatttttatactgtagacaaataaaacattttttatagcgagataatactgcaaaaaagtggagatagaaattttgtcaaacaaataatactattacaaagtatggttgtaaaggagataaatatttttataccgcagacaaataaaggagataaatatttttacaaagtatggttttggaacaaaaataatacccgagataatatttttattattttcaagcagaaaagtggagatagaaatttcaaaaagacataattgcacttagccttatcgaaccatcgccctcagtccaactggcccgtcaactccttccgatccccatccaaaactctaaccctaggcgatgggtggcacgaccgatggtggcggcgccgctaggagggagtgatgatgaaaccgtgaagttgatagtgccgagggtaattttgtctttttaaattgctctatcatctttttgcccataaatgataaaatattgtctcagggtatcatacatccaagcacacagattttgaagtgtctatcagaggcatcagtagcgatacgattttgcggtttctcttagctaatcacataaaatatagatgttcctatagcaaattttaccatgtttgttgctaaaaccgcatatgcaaaacaagtgttactattgtcaatattagctagagatgtgatcccacttagattattatgtaagcatcctattcatgtatcctcttctcgtgatttttgtactcatattgtaactattaaaaaaacatggttaagtaagaattactttctcgtcccaaaatataaaaacttataatcggatgggacattttttagtagtacagatctgaaccggaaggagtaatcactggaattttgcaatggatacgaacaaaactatcatctctcaacatgatctacccttggaaaagcatccttggcaaagtgacgaggtgcgttcgttctgggggattgggtgagaaagggacatcgttttccacgcgcacgcttcccaaactactaaacggtgcgttttttgcaaaaattttctatggaaaagttgctttaaaaaatcatattaatctatttttaaagtttaaaatagttaatactcaattaattatgcgctaatggcgcacctcgttttgcgtatctttctaattttttttatctcctcctcaaacacagccgaagaggacacacttacagtgggtctagggatagagatacaacgcctgaacaggattgggagaaagagaaagacggattgctcaatggatgaggttggtggttacggatatggtattaagggaagctaaacacccgatggcccatcgccggcagcaattagccatttgaatcgcaatgatagatatcaaccgtaccatgcgatctttccagctagacagatcacatagctcagtgtctgagttgtagttaagtaagatttaaaacctgatattgtgccagattagtccaagtatg

SEQ ID NO: 26197 - DNA, 5359 bp, Oryza sativa
  unsure (1)..(5359): unsure at all n locations
nnnnnnnnnnnnnnnnnnnnnnnnnnnnnnnnnnnnnnnnnnnnnnnnnnnnnnnnnnnnnnnnnnncctggacctgcatgtaggcgtcggcgttgaagaaggggtcctggaggaagacggagcccggggtgaggtccagcttggtccacagccggctctccagctcctggaacgccgtgccgttggtcacgtccccgaagaacggcgccctgaagtacatcaccccctggtacgggtacgcgcacgcgcagctctgcgggctcatgctctcccccaccgcgttgcacgtccccgagaagcacttgacaaggctcgtcgagtacggcgccgccgcggcgcgctgcgtcacgttgcagtactgcgtgttcggcagccggtcgcacaccgggttcccggccagcctgatcgatgtacagggagttaggcaaggagaggcagcagcgaaggccacggcatcattcggagatggttggttcaatggactcacgaaagggtgccgttgtagctggcggtgaccgtgacggaggagagctggttgtccttgaggctgacgatgctcagctcgctgctgatgtacttgcccatgtcgagggtgccgttgaacgcgttgccgtcgaggatcctgcagcgaatggtgagcgtcacaagttgttgaggccattttgtcaggcggattactgcacagtgaggctggtttgttcagtgagcttacacttgctgcaactgtgggccgctgaacagcctcatcggcaccgtgccgtaaagcctcccggattgtatgatccttgatgaacagcatcacagagatgatcaggtcaggttttttggttatgccacatgtgagagcatgttctgaagctggaggcactggagaaggagaacacttacagagctgagagctgtggcagcctccaaaaccattgtgggctaggagaagggtcgaacgtgttgttgctcagatccctgtggtaaaattggaggagatttcaagtcaaacatgattgatggtatgtttaagttagaagaagaaattttgtggaggagtgccagtatcttacacataattgagttgggtcatctgagatagatcaggcaatgggccggtaagctggttgttggctaaattgctgaaatatgacaatagcttgtttagtgtgaatattccatctcacatatacaggtgcactggaactgtcaatggtatctatgcaattcttgaacaacttacagctcatttactttagtgaggttattcagattctctggaactggccctgagagcgaattcctatcaagccggctgttcaaacaacaaacagagcagatgaatgttttatgtaatccgacataacaaaaactgtttacgtagtttcatgtgaagcttttgtttgtggatggacacttacacaacttcaagtgtagtaacaagcccaagagagtctgggatattaccagtgaatttgtttccatcaaaaagcctgcatcaaaactcctaacgtgttagttcacctttttagctgaattgccaactgaatcaaagaagcaggaggtcaggaacttacaaatggatcagtgtcatctcaggactgaagagggcatctgggattggaccggacaattggttcttgttgaagtggctgcagagagaaccagaaacatatggtcagtgctacatttcatttagtatggcctcttgaggaataggaatgaacaaacttcttaggacctacaagtgtttggttttgaaaagcttgtctaaacccattccaccatttgtcgagattggtaagggacctgacaattgattgtcggcgatgtcgaaccaatagaggttggaaagattgcccatagaagctggtatttttccagagaactgatttgagttcaatgccctgaaagacagattatgtcagtcttcttctccagacactaagttgcagaagtctcccaattgtatgtctactaattcaccagtgagtaattctcacatgtaagacaattttggcagactccctagctcatccgggatgttgccatggaaactgcaaccggccagaatcctacaaaataggcagcacatgagcatactaacttcttagatggcagaaacctgaaagagaaatactttcagaacttacaaggtggtaagctgcttcaagtttccgatgtttggagtgagcacgccgccaagatccttattaaatgacatgtccctgcatacatgcagttctctcatgattcaccgttgcaggtcggaacaacatgaggtttcagaaaaaaagatcaatcttgaacagtgtgctctgctgctacatacagggattgaagctcggtcagttgccctatgtcagcagctagaactcccttgatgcccatggtagaaattttactgaaacagtcgggtagcagtgggtaaacgtaaaccttgtagttggaaacatgcagagttatagaacagagcagtagagcacttacatggagatcactctgttgttgctgcataccactccatcccatggcgaatcgctgcatgggtcgtcagactgcccccacgttggcggcgcgttctgccactgatccatcaacgcgcggagaacagatgctacaaccaaatccacggttcatttcattcttcaagatatcacacaataagatcataaatacagagcagcacgagcttcataaacaaggttatcccactccttcaagattggacaatcatggagacacgcctctggtgttcccttccaatcatcgaagaatatacagaacatttgttctttccctcctcaaaatcaataaatccaatcgttcaagactgagaaaacaaaacgatcttaacactagctgattaaatggttgggtcatatggtactcactgtcctggctatccgtcacggcatggcttgctcggacgcacaccgagagcagcagcacgacgccgagaaccacccgtctcatcctcgcacagcctccgggcaccggtgccgccatgcatgcagacgacacgatgagctgcgtgcgagctgctgctgctaccagaggtgcggttttaggtcgccccggccactcaggaaaaggctatagctgtagctatagctcgggagagagagacagagacaaagaacgcgcaaggcaactaccagcaccacaaccgcatcagcatgatgcgcctcatgatgggatgtgcattcaagaagccaacatgacatgataagcttggaggttagagatacacacagtggaacagagtgtggtgtgtgtgtgagagagaaagacgacgacgacgacttggcttgaaagcaatgcaagctcctggcccggccgcctgggtggtgtcgtggtgagctcgcgcgcgcggtgtccgcggaagccaccgcgcgaggggtcaaaaaaaggaggaagaagacgctcgcgcgggcgccctcgtctcatcaacatatccctcgttccacggcaagtcctcactcagattccctgtaccgtggcagcgacgtacgtagacgtggtgctagtgctagccagattgagatcatctgacgtaaagttagaggacgtggttactgatacatgatcctatcggatccatatattagtgatcatgtcacggagaaattcacgtcggagaagctgcttccatgctaattttggtggtggactggtggttcccggtgtctaaagaaaaaaaagagaggaagaaatggtttgttccatagagggttcttaaaggtgatgatggggagcttagtgatgatgaggggtgtgatctaaggtacgtcgacgggtggacaatttggtggggattaaacaaaattatgtccatgatcaagtgctgggactttggcatgcactgggagaaaaaagtgtggacagattgacagaaggaatgttgttaggatgttttgtaggcttagggtgagtttgggagggggattgggaagatacgcaaaacgaggtgagccattagtacatgattaattgagtattaactattttaaattttaaaaattgattaatatgattttttaaagcaacttttctatagaaaatttttgtaaaaaatacatcgtttagtagtttgggaagcgtgcgcgtttaatacgatgtccttttctcacccaatcctccagaactcatcacaacgaacgcatccttagtttcagggagaagtgaagaaccgattgttgcaggcaatacatgttcgatgatgctgatttgatgcaagaaaactactatcccttccatttcataacatagtaattcgtaattttttttaagtcaaatatttctaggtttgataaaatttatagaaaaatatagtaacattttcaacacacgctacatttaataaaactaatttagtgtggtagattttgctagattttctataaacttagtcaaaactagaaaagtttgactagaaaaaaaatcccaaaagtgagttatgatataaaacagaactacgatatagagatacacagagacgtcagtgtcagcatggtgtcacggcctaactaggaacaataagcaagactttgtcaaatggacttcactgatgttggtccgtgtgacaacagtgaaatgagtgagactgtgagagtgatgcctgctgcaagggaaaaggacagccagttatacataaaaacagagctttgatctgatatgcttttttttcccatcagaatatatactcagttggaaacgagacgattaacgatggcttgctacatggttttgaaaacatatgcttttttttttttgaacattgaaaacatatgctctctcttgttttttaccctcggtgctgtgaaaattcagaagtgaagctcttctttttaccggctggttcatgcgttttagttcatgatggtggttgatgatgatggctggctggtcctgaatcacgttagcgggataattgtttcgaagcagattaatttcatatcatgattgggctacttttacagcaattttacattgtaaaattataatttatgaaaaatacatcaagcaacatggtttcaagtcttctggaatatgctccacgcagttgccaacctgcggtgagagctgccaagtagaaccccatcacgaggtctttacacggcaaactcgtgcctttggctgcgatgataccggtgttgaagacaacattaaagatctactagtagaattagctagaaaaaaaactaaacgaaattaggtcacaatcacgagtgtgactgtcctgtctaggaactttttgcccaaaggtgggaggaaacgcatcgaacaagttatgcaacaggttccatgaaagaaacctcgacatcaagaagtgcacatagatgttaccttgccatattttacagaacgaca

SEQ ID NO: 26198 - DNA, 862 bp, Oryza sativa
cttcttattagtattattagtattatgtttcttttttttgaaaaaaacttgaagcgagctgtgatacacaatactacccgcttgcgacgcacgcgcacatccattatgatccttgactatctcgcgggacatgaaaatgttcgtgtgaggcttgttgggggtgtcaacctcatggtttacaaaactgacgataaccgtgtggttatcgtgtttactgccggttacgataaaccatggtaagctcattaaactgaaataaattttaaaagtaatttaaatttttaaaaaatattatacaattactgcgagtaaccatgcagtgtgcggtaaacccacgccgatggtaaggaaaccctggtgaacccaacacaagcaatgcgattagagcgtatcaacgagaacacacgcgggagccacacgaggcggagtactacacaccaatccctccatctcataaaaaatctaggaccggatactactataaatctgaacacatatatatccaaattcgtagttttagaatatgtcacatttagtactagattgattttttaatggaacggagggagtacacaggagcacgagcagcagtggcatctttgttcttccgttccgtgtcgtgtgcaaaactaaaacaacacaaggagggggaggcaggaggcgcacgaagaaaccggccgcggctcgaggaaaatataaaaggaaccatcaccgtgcaggggaggggaagggaatccggcgcgtccgccgtggctgcgcggaaacaaacacccagcgcacggtcacccacgtacggttctggaatcctgcctcggaagcggcgaggctactccagaggccaagcgggtggataaattcaccg

SEQ ID NO: 26199 - DNA, 3651 bp, Oryza sativa
  unsure (1)..(3651): unsure at all n locations
ttatgatgggtctcgtcgtatcctatctcgtattattttggaacagaaggagtattcccttcatcccataaaggacttgagggatagtgaaaaaaaaaagaaaataaaaaaaatcttgagttaaccatttatatgttcacctctctctcattataatcatgtaatactagaagtacaagtcacctatatataagaaatgttcaaccaagcgagagtcggctacaaaacaaatattcaaactttaaaattcacatttcaaacctttgtgtaaaccgtgcggtacatttcctaaaagattagtggacactatcctcccctatcgttttcctttcatttcgctcaaaatcctgcctcgcgaatacttcacacaacttatgatttctttggaacgcatgaatcgaaaaatatagaaataacaaaaacaaagtattaagtgtcgtgacttgatgaatacatcaggaactaaaaccacaataattctacataataattacaggaaaaacacatgaaatttaatatttatataattgatttactagatagaaagaagagatacacagaaagtgcttgggcttctcaaataaattctgttaacacgaggtgagatcacatattagaattcctctaaaatttggaagattttttactatcctgtaatattactctgaacaatttcaccatctaacactactgaaaaactgatcttcgatgggtcaagcaaaatccacattagtcccggttcaagtaggaaccgggactaaaaaatatatttagtcccggtttaattttacgatctttagtcccggttcaaaataggtcagacgtcccactatctttattcccggttgataacaacaagcacttattctcatctcctccccccccccaaacaaactccttctcatatctgnatctgcaattcctctctctctctctctcatgctcatcctctctttttttccaacatcctcagcgggcggtggccgaggccagcgtggcgccaggcggcgggggccgaggcccacgccaggggcagcgtgctagcgccggtcagcggcctgcccgcgcggggtggcggcgggctgtgcggagagcagtggcggactgtgatgtaaatttgtgaatttgttcatactgtagatctatgaatttatgatgtcaatttgagtattttcattcgatctgtgaatttgtagatgattttgtgatgttttgtgaatgggaatgattttgttgtagagatcagtttgaaatcaatataagtagtaaaaaaactgaagatgagaagaactttggccacgtggcgttccgatccttagtcgtggttcgtaacacgaaccggaactaaagatacccatctttagtctgggattcaaggtcccagttacataaacgggactaaggggcttacgaaccgtgagtgaagacactttctccagcagtgtaagagctcctttaattcataggatgggtaaagaattttcgtaggatttagattgttgttgattttttcctacatatccctctaattcataaaaaggaagaaaaatttgtataccaaccaagaggtgcgacctgtttgtaaactttcctttgtttttcctattgcgctcctattatattatcctgtatttattttattcttgtaggatttgaaaatcatactaaagtttcttctatcctacgaatctaatgagacctcttatagaaagttttgttccttcgcactagatatctctaattttctacaaatttcctccattctaaagagccctacacacacgtcattattcatccccacaccgaaattgaagttgatcaaattgctatgatagcgatagcgctcgccaaacaaccccaaccggtggacccctcgtcgagatatgtagtactcactccgtcccaaaataagtagttttgtactattcacgttcaacgtttaaccgttcgttttatttgaaattttttatgattagtatttttattgctattagatgataaaacataaatagtactttatatgtgactaaatattttcacaatttttttaaataagatgaatggtcaatcgttaggcacggatatctacggctgcacttattttgggacggggtagtagtacatattgtactatgtgtcttaaggacacccacaatgtatgaaaaagatagccttaaaatattgattgtacttataaaataatccataatagtttattatttatgagctcactcttaaggttgcactacatcttaaacaatgatcttgccctaacacaatgtctaatgtatctcatgcatgtgtagccgcccggacgtagcgctagcccgatcggttccgagttccgactacgactttgcgagacggctgcgtctgcgttgtactttcacgccacacccgcgcgcaccacagaaaactcacgctctcagcctccaagcctccggcggcgcgtcggcttgacggactgaacatgaacagagaggcaagcgggggcgcagccgcgcaggcagcgcacatccgcaggcgcagggggcgcgcattgaagcgttccgctgccgcggaggcaatctacggggcccaaacggggcgcggtggcgggggcgcacatgcatccgctgggcgcggcgcgcgcacagccacaacaaaacaaagggggaagggaaggacgtaacaaaagctgcacagtgcgcgcgtccggcccggcgtccgctgtaggcggcatgcattgcctgatggatgaacaagggggtggggtgtggtggattggtggggtgccggccgggggtccatgattccgtaggtcggtaggttattgttgccgggcggtgggtttttgttcaagtgttggtcctttggggtttcaggtttgactccgtataggtgacgtcgttaccgattgcaccaaaccttggattacatgtgcatgcgagagattgtgtgagcctactactagtaaggaaaacaaccgtgcagttctatttcattgttttagaaatcaagagcatgcactgttgtgacttgtgcgcccttttgctcacgaagctagtacagcgttttctcaaacaaggaaaagagaaactgtactcctacactctacagctacgtaggagtagcaaagtactagcacggctagtttagcaggtctacgacaagaggaattgcgctacatcgtggctgctgctgcaaccattccgtacactctccgtagcacagagacacagtcacgcagacaggttggcctgcgaacgggccaaagccacgtactgtcgccgttggactcgataaaagcctgggggcgcacagcctgcgtcgcccacatgggcgtgacgaggcctgctactgtgggcccttaccttggggcccaccacctctcgctctctgtcaaacgccctttttaccccctcgcgtatctgggcctgcggcccacccttgatctaccgcacgtagtagtagtacaactagtagtaacgctgttctctctcgcggtgcaacggacgatagagacttgatgagtgagaggcatcatggtcatcaggtatccgtcgatgtgcacgcccaaaacgacaaggcaggttgcagcgtttacttataggcaaagtcaagacaaatcgagcgatcatcaagttgatcaccatacctaccttgttatag

SEQ ID NO: 26200 - DNA, 5733 bp, Oryza sativa
  unsure (1)..(5733): unsure at all n locations
atgaacaactgggtaaacatcaactatatatgttgttgatggcagttgtaattgagtactactagtatatctaatattataagggggtaacactggattgcttatatatattaagtatctcacaacactgcatgtctgcatctactggctttttttccnnnnccggctaatggcatcttcacttgtggttttaatagagctacccactaaaaagggcaaccaaaaagaaataaacaagggagctaacactatgctgacacttcactccttttctcctatattccactatcgcttttcttttgcttcttgtgttcctgtcacagacaaatagaaaaaaggagcggaaagaaaacaagacagcaaaatcagaaggtgaaaggcttattattttggaagcatagtgggaataaaggaaggattaagtgcttactatgattaggctgggggattcactcatccattgcagagaactttacatcccaatcgctccgtgatcagaggccagcctgcttattgcgttcaccaaatcatttcaagcatcgatcacaagatatcggatccatcaatataatcacagtacatgccatacctggaaaccgagaagaagtctcttggcgaaggtatatccaaagtagagggccgcagatggttgattccacctccagcattagtgcccgcgctgatgcctacatgagatgcactgcagctacttgtcgcgacgacaccggtatcagtggtggtgaaactttggtgagctgagacagaggacttagtcggcgaagcaaacgggctgtccggcaaattgtgctccaagctgcagaatatccatatcaaatgaaagccatgagccactgaagcagcccaaccttttcagcttctatgtgcatcaaatcatgaaagctaactgcaagaataataagcaaacagaatgatgatgatggtctgtctagtgtagtttagtaagatccacctttggtcgctatcagcattcaggctcgcctcaccagcagattcttccttatcacctcctccgttgaccattttcctctcttctgtgaagtaacctgttcccttgagctgctcgcctataaacgaccaagaaattacaaggatcagtagtgtcgaatgagtggatgaactcgtcttacaatgcttgacaggcagaccgaccgaagtaacacataccagaatcaggcggtgactcgaccatggtggtggcaagaggctgactggaaccgaaggcattggcggtgggaattgtcatcgccattgctgttgtgacagcagctgcggctctattcttgaggtcgagcagctggaggtccatgagacggcgactgtggagttcgatggcctgttgcagctcggcagcctgctgctgctcctccagtttcctacgaagcatcatctcgtttgtgctattggagtgctgcagcatcctcgcacctgccaggcaccaaacttcacatcagcagatcgctctaatacaccataccaaagatcaagcaggaaggcattgaggctgttcgtttgtgcgacttgcagctgcgttacagctgcagcaacagtatccactatgaaacaatgaactacagctgtgctgccacagctagcacaaacgatcggagcgagctaggatatttttaccgagctgatgcagatcgaatgggtctctgccgtccaggccagtgggggtcgtgcagccggagaagtcaccttgatgtttcctgcaagatgagtggaaaaaaaattataagcaaccaggaaaactgcatgcacggatacagttgcagtttaaagatgcggaattaaaacgccggagcgtgttccaagcgtgcctgtacttgtcggggaccttgcccttctccttgtaaggcttgacgagcacgcgggcgtcgcagatgaaatgcggattgcccttggccaagatcagcttcaccgtctcagggtacacgaaggtgacgaacccgaacatgcgcttctgctggtacgggatgcgcacgtcgtgcaccggaccgtagatgctgcagcgcgggcgcattgccaagaacagcaaacatgccaatcagatcgcgttctaccgagtccgccatgaaagaagaaacatcattgcaacatcgcattatacctgaagtagttggagacgtcctcctcgcggaacgtgctgtcggccgggaaggtgaggtaaatctggcgcgatccggggttcatcatgctggcaaagtcgacgcggtccaggcgcggccgccccatgaacttgtgcgcctcgtcgctgccgccgagcatcagcgccgccgccgccgcggctctgcacacgcgcaaccaaacaacaaaggttggaactttgaaagcttcgagcttggaatatggaggttgtaaaaggcggtcggtacctttggttgtcgttgtgctgctgctgcagcaagaggctgaggcacttggtggcggcggatggcgagccggggagcgaccctgtgggtgaataggggaaggcagcagggccgaggcgctggctcttggaacggaggaggaaatcctggcactgctgctgctcggcggtggccgcgtccatggcggcgcccgtcagagcggcggcgtcgtcgccgtggacgaacctgcagctgctgccgttcttgcagaacccgcgcgcgtagtacaggcaaggcttccacccgaagccgtcgctgctgccgccgccgaggcagagctcgttgaccgacgcgctccggcggtgcccagggccaccgtttgcccagccgagaccgtacgggaacatcccgccgccctcgccgggaccggggctccggcactccgctccatcgaacccctggagagggtggctggggttgacgcccccctcgttgaggaacgcgagctgctcctgcagctggaagtcgtccaggagcacgtccccaccccgaggaaagaagggcggcgcgttcgccgcggcgcctcccccgctgttcgccgggctgattagctcctccccagcgcccaccacctcatccacggacccattgctcctcgagaacggctgcgcctgcgcccacgaggacggcgaggacgcggacagcggcgacggcgacggcgcggggccgcggccggagttctgccgcgacagcaggaacggcgagtgggccgccggcacggtgggcgacgacgacgacggcggcggcggcggcgggaggagggcgagctccttgcgagcctgcgccatgacgctgtggagcagcgcctcggggccgaaggcgaggcgtatcatctccttgtcgccgtggtcctggatgagcaggaggcccatgatcttggcggcgtggtcagggtccagcgcctggatccgggagaacaccaccttggtcgcctcgtaggcgtccatggccgcgcccaagaaacgcccggagcaacaagttctccttctccttcttcttcttcccctcccttcgccccacgcacacacacacacacacacacacaccgctgctgctcacgagcttctcgcttctcccctcgccttcacctcacacacctttacccctccttttccgctggtgttgtgtagtgcctacagccttaagtagcgcagttgccgcagcaaaaacaaaactagctggcgctgctttggctcggtccggttgctcggtagcctccgcttcccggagctgcggcagcgagcagctccatttccgaaactttggtgcttagccgcggcctatcaccacaccgtgcacctcacgctccctctattaagcaaagcaaagcaggcacagcggatggcctggcctcttcgcctcgcttctcgtctcctctcttctcctcgggggtcggttgacaggggacgggggaccggcgagggtgggtttcttggggcttgggactttgtactgttgcgggacgagcgagtacggggctgatggggcggtgtgtaattgccattgttttttaaggggttccggggcaatgtttgcttctgaaatttggggtctagtagtatcagagaggaacaaattaaatgttggctccatttccccaccggttaaccacacacaccgcagctccctccttctccgccccccgtcgcttttatgtcgtcaccgtttccctaagcacacgacttcatccgtcacgctttgtttcgaccctcagcaattcccgacgtaataccataacttagccccttttattcgtagaaaaattataagatatttggaggatttcaatccttcgaaaaaaaattcctatgaaactcctattgaatgagtaatgctatagagattttgaagaaaagtttgtaacagattcaacctgttggaaaattttctttgagtgtctatttcattcgattcctgtattttttgtgatccaatttaacagttattcttgtttttttgtttttttctagtattttgtaacttttacacttacattactgtcatagacctccggttttcctattccttcgtttttccatttctacgattcaaatagccccttaaatgtattttatggtagatatttgacaaaaagaataggagtatgtcttactccctatgttccatttttaagtgtagccatggtttttcgcgtccaactttaaacatccgtcttatttaaaaaaatttgaaaaaaaataaaaacataagtcacgagtaaagtattattcatattttattatctcgtaataacaaaaatactaattataaaaaaataatacggacgatgaaagttgagcacgaatacttatgattgcatttaaaataggacggagggagtaactcttaagaaaataatggttttttgccataccataatttggatgttattttactatgactttggcaatataaatagggatcaaaagtcggcaatatatcttacacgtgacatttgtttcgaatagtagatttttttttcatattaatgaataaaatgccagctaacataaattcagcatgtgccaaatttattgaagtattacatttaaacatgagctttgatcattggttttattgactccctccattccaaaatttgatatttaaaagtgtattagggttaaggattggggtaaaagatctacttgtctctaaataatgtcatataggattgggagatgggaattaaaatagtcttgttggaaagatcaggtccaccgggagctgtttggaaagtaatgagagaaaagccattttttacatgtcatgtgtacttttatttaggacaaaaaagctaaaattagcttatttggggataaatggattgtcatttatttgttaggacttatttttaccattaaaggtaaactttgcgtatttataccaaatatttctaaactagataaatgataaagtattatgtgaaaaagttaacaatatcatatattaaaaaacaagtccaaaagttcagtagcttcgtataatttaaaacgaaggccttgtcgacaaattttttatatttaatatatgtgctcttttgagtaagtgcaatatagaaattaacagttaactataagattaaatatgttgcatcaggcccttattttttcatgttaagattcagattttacctcgatttccattatcacgcttttaaaaataataagtggtgtgttctatgtgaaaactttctatatataattttctttgatattatatccatttgtcaagtttataataattaaaacttaactaattatgtgctaatagctttttctttttgcgtgcgccatcttcatct

SEQ ID NO: 26201 - DNA, 1081 bp, Oryza sativa
gggagggcgggcgctgcctcgagacggagcgcctatgtgacgacgtcgtcgtcgctgctgccgctccatcacccactccctgcacacagtgcacacagccgaacaagggagagagggaagaggaagaagggaaggagagaggatgacatgtgggcccacatgtcagtggcccataatttttttgaatgataaatgggtccatgtattataatagcataccatatcaatgccacgttggacgaagaccaggtcaataccgccacgtatgcgccacgccagcgaaacaaccctctaaaaacgtaagggagtcaaattacaccggttttaatagttggggcgtttggggggtcgatatatctggtattgcgattcaaggatacgaatcaaatttggtcattagtttacggagtgaaggtggactttttcctaatgaaaatgggttgcaagaatcatcattattcatgacctttggcccaagtgtggtactcagtttcatctcagtagagtacaaatcgaatgggttaggacgtgaatgttaatatgagcgttgccgtttcatagactgattcaagaaagcagagtcttaaaaatctaactcccacaaatccacgaggaaagatagtattaattactaggttcataccagaacagcaatagtgttacataacatggggattatacaagtatacaacaatgggagaaacaaagataaaaacctgacgccttcttttctgttaggtttcccccagcatttccagaacaagggagaaaaacactaatctaaataagccgtatacaaaatgaatcagaatcagatagtggcagccaatcatggtttccatggtgccggaggcggtgggggcgaagggaacatcggcggcacggcagaaaacatagtgttcttatccacgccatggccttcacctgacaatgctactaatgctgcaactagaccggcattgccagctagagttgcttccgtgtagttgtaattcttgcaaacatccttgaagccgtcgtggcgatcagggccagctaccatcgctcccacgatgatgttaaggtttggtttcttggtttc

SEQ ID NO: 26202 - DNA, 4776 bp, Oryza sativa
tccctaaatgtttgatgtcgttgacttttttaaacatatttgaccgttcgtcttatttaaaaaaattaagtaattattaattctttttatatcatttgattcattgtaaatatatttttgtgtatacatatagttttacatatttcacaaaagtttttaaataagacgaatggtcaaacatgtttaaaaaaatcaacggcgtcaaacatttagggaaggagggagtagcaaagaattttagctcttgaaggttaagaaatagcatatacacaaaagttaccaggttctatgattcaacgggttaaactagagagaagtgtgaccaattcttttgacacacatagttgaaacctaccagaactggttatttaaaagatgagcccaaatgcaggttgcatgctgaaaacaattgttatcatgggtcacatttttaggaaattccaaagaacaaaaaagggagacaggacaacactgacggtgttccaaaccttaatatatcatacaagttgtgtacctctttctctataattgttactaatgctctacatttcaggtcttgatataccacataacaagttgactccacacaagatagctactgcaactaaaccacctcacatattatatacaaaattggtgattcaacagatagtcctatattataatgatcagcatgttagatacggaatattcatgtcaagcatcaaccaagtaccaaattaaatgccaatgggtcaacctggggaatgtctatatcattacttaaacagaagagaacaaatgcaattacctgtgcaccagtaagcttattgtcccagctgaatacaccgtagtctggaccaccccagtaagcaccagcatgctttgcaagcttggggtgtgttgccaactgcaggtacgatgaattgccggttgcgagatacatccatgaaccaccccatacaaactcatcccagtagctggttgagttatagaattttgcagcatcggaaccacctgcactatatcttccacggttttgccttgcaaacttgaagagggtggtagcaccatgtaccagcttctgcgagtacgccttattgtccttgaacacaattgatgctgctgccaatgatgcagccatctcagccgcaagatctgaacaagcatggcactcaactactgggcgagggtagtcaatgtcctctggtctcatccaacaatagtgatcgttcggttgagtcgaaccgggtgatgttgcaccgctccccacctgcacccaccataaaatctcgaattagcaatggctctgatggcaagaactacaatccctctgcacatatccatgtttgcatctttgttttacctgcataacgacacgatcaatggtatccgccgttgagttgaaggtcttcaagaagtaatcggccccccacttgatggtatcacggatatggccaagttccccaactgcctcgtatttagcactgtactcgatgacgctccagctgaggagggtcatggagaaggcagctggaaagttgaacttgacggcgtcgccggcgtcgtagtaccctccgacgaggctgcgcccgactgccggatccgagagtccgtccttcatgcacgagttaccacgccaatgcacattgttgttcttcggaagctttccagctgcagcaaatacacaaatgggaagtaccatcaaaatgtgatctttaagttggacatattattcttctagataaactcctgtaatctttacggatggatctgatggacagaccggtttggggcctagttattcccatttcaagcaccggaaaaataaatccaagctaataaaataaaaatcccatctcttgagcccgcgtctcaactctcaagccatcgtaactctcggaagaaacccgaaaccaagctaaagacttgaaacttcctgtccacaagatcaccgggagaaacaacgggaaaatccggtcttgcctattctaccaagagaagcatgaaaaaaaaatcgaatcttcagaacttggcaaagctcaaacgcacaataatcaaatcctaaaagctcccgaacataaatcgcccagatcgccaaaaaaaacccaccatttctaatccagcacaactgagaactcacaaaaaaaggaaaaaaatgatctgatactccgacgcgcgaggcggcagggagggaagcacactcacatttctgggcattgaagaacatgagcgccttgcgcagcgcgacggtgaagtcgtccggcggcggcggcgggcggtggtgcctggggatggccttggcgatgccggcgacgagcccggcgaagacggcggcggcgaggagcaccccgaccgtccacacgaagagcttgcggctgacgacgaggcagccgaggtcgacgtacttcttcttcttccggccctggtcccccggcccggccagcagccagctctgctgcgtctcgtccagcgtccgcgacagcgcccccctgtccaggtccaggttccggctccggtcgtcgtccgtcgccgagtcgtggcatatctccagcggcccgccccacgggtccctcccgtacatgctcatctcgccgcccaacctcaataccccctcgcgattcttgcaatggcactggctgcggcggcggcggcggctgcaccgagtggttcttgggacggacagtgaggaggactggaggaggaggaaaggagaggagaggcttttggcgtgtgtggggaagtgggatttgttagggatggataatcaggtactactactactgttgccgttgtagtgtggtgttgggtggggatagcgatggacgcctacgagacaatcttatatgtggatttttgtttgtttttgttttgatctttggtcgtctgggtttaggaagggcagtttcagttgtgccgtgcggatctttagtttcagctgttttgtacagagtttaatattcgtagtcagtcactgtgtttatcaaccactgttttgtacagagtttactttactttagtatacgactgttactctcgtactaggatagattatcttcagattatttttattctccgtagtatgtttatttagaaatagtttttttcagttttaaacatgacctgggagttctgaaaaacgctgttttaaaaaactgtatagtacatgcatgtgagtttaacatttgaggggatggagtcatggagcaggtgtgcttcaccaaagcacctgcaggacacctcgctcatcaacccgcatcaaactggcctctcggattgatctcagttaagtgcataatctggaagcatctggatttaactacaattgattaggtcacttactgtgctggaaaggaattgcacgcagctaataaaggcgacagggacaacgcacagacccttccatatgtcgaaggacgaattaacagtggatcgttatgtggatcgagatggagcaggaggattagcaatataaggattctcttacaaggcaaggtacgggtgtaagccgatgcgactttgttagttgttgagagtccgaaagcttagcgctttctagattctactttgtgggcactagctggtagcatgcaactggtatgctgaacagtgaagcaattaaccttcaggctcaagctaaccaagacaagtcatctcttgacgatcatgtatgtatgggctcctttttgctggagcaaaagctctagatttccttttgtagctcaaacataacagttcactactctctacgtaccgtccttaactcttactggcacgaaagtatgttcaatacattacctattatctctctgcgtgtaacccgaccgaccttctacaagcaactccgtgtacaagactgaaatggagagacacaatttctacaaattctgaagccacggtttccggaaaaatttccagcttggtccttgggtgcaagtgcaacgggggccacgctacgtacaaagcatggccaccttcattgccacacgacacgcgacgacggaccggacgccgatgatccagctgtctcgacgtgaacgcatcaacggatcgatgagccggtttcgccgtgtccgcggtgtgcatgcccgcaggaaaacgcatacgcatcgatctcgtgctgctcgtaggcggcgtgtggctgtgtgccggggcgcccgggggaaatgcgtgcatgcagctggatattgcgccgaaatggtgagcgtgtgccagccaggaaacggcgcgtcgcgacggggggtccccagcggcgaaatgctttggactggtggcgtggcaagggtccaccggagttaacaggagcgcgtgagggtttgtcatggttggcttcacgtgtccggcctcggaccaaggctgcctgctaggattaatgtccgtccacgagataggattccgtgtgggccgtcggcttgtcgtccaatattttcgtgttggttgaccaagcgttaggtcgtgtcgataaggatgaaactggacggttccctaacaaaaaagagaaggcctatgcacgagaggatgctgaatgaattgggctggaaaaaatggatggctattgcaaggggataagtctatttcgcgtccctcaactcatgccccttggttgaatcgcatccctcaactgtaaaaccgggtacaacccgtcccccaatttccaaaactgtagcaaattgactccccagacggtttcgtcctatgtggcacggttgacttggtcttcatccatgtgacatcgacgtgacacttacatcgcactaaaataaaaaacaaacctaaatgggccctagatgtcagtta

SEQ ID NO: 26203 - DNA, 551 bp, Oryza sativa
gccccgtaccaacctcatctccttcctcgaccgcccttgtgacctcctcgccgcacaacagcaatggaggtgtagacggacgccagcggcgatgaccttgtagccatacaggagcagtgccggagcctggaaaaggccatcaacttccacagggagacgcatatgggcctcgtcccctcactcccaccaagagccccgccgccctaaagccccaccaccgccgcgtcctccctgaccaggtgtgctccacctaccgcaaacctcgcccggattctcccttgcctccgtcaccgctggggttgtgcgcgccatggttgtcgtgtgcccctacagctcgtccccttcgccgagatcaacgctgccgcgctcgcgcaccgcctgcaacggagagctcatctactagcgagggcgagcagactgctcttgctgacctagccgtcgaactcagcggcccggcagcctccgccatagtcctcgccctccgtcgtgctccatctcgctgttgccgccatccaccaccggtctctgccatcacctgcgagagaaatggt

SEQ ID NO: 26204 - DNA, 1127 bp, Oryza sativa
acacttggcctgcattgctagccattgctatactatgggcctgtttggggagctttagattctaagaagcagctatttggtagccagcttttgagaatctggaaaagctctaaaacctagcttctccagcttctgacttattagttcatttttcagaatatgtaactccatattctcagaagctgtggactgtttaggatagcttctagcaaaagcagctttttccaaaagctgccgctgagacaagcttcccaaaacagggcctatatatgctgctggtttcctggtttggtggtctcatgctcatgcatgcacacgtccatctgtgtgaattatgaagctgcaagaacctctcgccgtgctgcatcggccatccaccggcgacctcgtcaccggcccgcgccactgccggcgtcagcgatatggtcagcgaccgatatgtaagtgtgctgctgctggtcagctctgcctgcatatgttcgatcgatcgattcattgctgacatgattgattgaatgattgcatgcgcatgcaggttgagattaaaaatggcatctttgaggttacactgtccaaccccgacgggatcgtgaccggcgtccggtataatggtgtggacaacttgatggagattcttaacaaagaagacaagagagggtacctacctgacaattttgcttacgctttttatcctctctttgatatgtttaactagcatagtggctcacgcagattgcgtggctagcatcgttacatttttttttctcatttaatagcttaaatattttcacattttattattaaaatatattaaaatgacaacgtaattttaaactcttggttgaactaacaaatgtgtgatatttttattgtatggtatacgtgatagttatttataaattatatttatatatggactcaagaataatcttttaatattccttagtttttaaatttcgaatttcctttgttcataaattctattcctatatggattctagactactcttccaatattcatttttctaaactctgaattttagttatttataaattgtatttctatgtggactttaaactcttctttcaatatttattttttttaattttgaattccaattattggt

SEQ ID NO: 26205 - DNA, 1925 bp, Oryza sativa
aggatccgtgtgcagtggatcttgctgccacagctaaaacagtccagctaccatacatgaggttgagcgtgcaagtaccactgattgcacaaaatagaacacatgttgaaattaacaagagcataaaaaaagataaaacacatataaaaaataccactctggaagcaatcaattaaaataatgccttgagtgcatgcaattatgtagagtgaactaacctgctgtttcttcctgccaacagttgagacatgacaatgtgataagtccttggaaggtagatggcagtatattaaagtattgaacatacgagagatcccatatgctgtttattgctgctgccagacctccacccattgtggacagcatcaggaagctgaactggcaggattctgtttgtctaccaaccagatgatgctttttcttgcacatcaactgaataaataggcctcagcacaaagctagactcatcaaaccataagttacatttccttctcatctcttggatccaacacaaagaggtagagttctagcaacagacatggctttccaccaaagatcaattagcttgccttcaaggcctctctccaaggttgaagatgagttgcacagcatagaggcatacgtctcatcaccctccaagaccaccaagatgatctctgatggtttgaggaggcttggtgacacatatagctccattgaggagaccatgtgcctgcctagcaaccaagtttgctcatcacagcaaacgaagttgtttgacagagagatggaatactcccttgagctactggatctctgcaacactatgaacgaggtcttcaccgagttgaagtccatcatccaagatctgcaagtgtctctcagaaaaggagatgatgcagttggtttcaaaaaacccaagatccagtcatacattcggctggtgaagaaggcgaagaagcattccaagaagactgtgaacaaggttgcctcagacatggaggactccaagaaggtcaagctgttgagcaacgctagacagatcactacctctctatttgaatcaacactggacctcttgtcaaagcaaattgtgttgccaaaattgtctctcatctccaaggcgttccaaagaagaactcggtgatctgcaatgaggagccatgttgccaggcattagagtgctgcatcggagatcttgaggctggagcagtacttctgttcaggagattggtccagagcagggttactctcctcaacattcttagctcatagatgagtcaagatctgacactcttaagaccctgcgatcggcatctgtcttttaaaggatttgctgatccttcccatttgtatatgttataagctcactgtacaaaaaaaaaaacacacatgaaagagacaaaattttgatctaattcttgccctgcactcagtcctgacatatctctgagatacatgatgtgattatgcaagcgatatcaatattattgcctttgggattaatatactttgcatgacaagggcatggcacataaataataaatatatgtaacgatattactttgatttcttttctttttacagtcaaattgatctatggtataccatggggcaatgaaatggccaagtgggtcatgtcactacgatgacatttgttgcctcactagcaagcaaaggatccatgtaaagtggatcttgctgctgcagctaaaacaagccaactacaatacatgagattaagcgtgcaggcagcatggatctagctgcagcagctaaaacacgccagctaccaaacacgggactaagcgtgcaagagcctctgattgcacataatagaacaatcagttgttaacaagagcataaaaaatagataacacatgtaataacaataacactgttgtagcaatcaattaaaataatcccttgagagcatgcaattatgc

SEQ ID NO: 26206 - DNA, 1013 bp, Oryza sativa
cgttgggggaggagcgcggcaagctccgggaggaaggtcgggtccatggggaggtctcgctcgtcgacggcagcgcggagcccccacaggatggcgcgcacggcacgacagtcctcgtaggtcccgcagacgacgcgaagcgacgtgtagtagagcaacacccgcggcccctcgccatcgccaagcttgctccagatggtggccgccgcgggctggaggttgcggaggacgcgcagcgcgcacgcggcgacgcggatacggtggaagacgtgcggcggcgatggggagggggaggacagcgcggcatgcggtgggtggtcggtgccctccgggacgagcaggtactgacggtccttgatccgtccccgctcccaaccgcctccgccgctccccattgccgtctcccccgcactccggccaagagaaaggcccaagggggagagagagataagggagagagagggggaggaagaagggaaggagaaggaggatggcatgtgggtcccaaaatactttttttgtgcgaatgacatatagatcccacatattttttttatttttgtttttattctaatgccacgtaagcaccacgtagaacaaagacttggtcaaaaccgtcacgtaggcgccatgtcagccaaaaccacttcccaaaccaccgagtgatattgtgtacaccggttttaatagttggaggagtccatatacccggttttgtggctaggggacatgaatcatactcgggcgatagttgagggagtcaaactatactttttcctttagcatttggcccagtacgcaagagttggccactagctcattgtagaggtatataaggctgagaaatgcagaggatatttcatcaaacaaaatgacccccattgttagacaagtacagtcagttttgtattataagacgttttaaatttattctaaattagtttttttagttagactaaattcataaaatatataataacacatataacacacatattagttagtccttaaat

SEQ ID NO: 26207 - DNA, 1191 bp, Oryza sativa
ccggctgcaatattaaaaaaaaagaaaatagcggttattaaaaaaaatagcgaatctattccttcccgattcctagcgcccgccgcccacaggccccacacgcgtgatcagaattcagaattccgcgtggctctctcctcttcaccctagcccctagcgacacgaacacgacgcgtcaacgcgatctcatctgatcacacggcagagcgagcgccgcgccgccggcggcccacgcacgccgcacacgagtccgccgccgctgcgccgcactcacactactgatctgttgtgctatagtgtgccactactgcgaggagccgacgtcgagccgatcaaccaggtaaaactggaagacggaatcacggactcacggagacttgcctccttgctgcagtgcgcagccgttgacgcccagcccacactaacaattttaggttttctgctttaaacttctttaaatcaaaattttacttggttactaattttatatgatttattaatatatgatggtaaacttttggtgatttggtatattatattaatctatacatgcattgcatatattagtgttgttagatttactgtgtttagaaaaaaatttaggttgaaccacctatatcttaaattgtagatccaccactgatgacatgtactatcttcaaaagctaatatcatttgttggtttatcaatcacatctaaaatttaaatcttaaaacttaattttaaaattgattttttgggtcttttagtctatttttaagcacatacttttaggctgctaataacacagataaaaatatttttacctataaattcttttatttgcctattcattttgctaaaacttatctggcatgagtcaaccaaataagagcctaaatccaaagagtaatactattgataatcagtttaaatgcatctattgtacgtattattattgtgactactgactatagcggtaattcaaattgaattttacgaagggatccgttctatcccgccaatcgaaatttctatagccatcgtagtagtccttccttttctttttctttttttttttttgtcttttcttccttcccctaacataagccagtataactgattgcgtttgtatcaaacactcttttttctctaatatattaatgtgtaatttttttttcgcttttgtgaaaagacgggatccgttttac

SEQ ID NO: 26208 - DNA, 6572 bp, Oryza sativa
gagagagagagagagagagagagagagataagggagggagagagagggggagaaagaaggggagggaggatgacatgtgggttccactttttgtgtgaatgacatatgggtcccacattttttttttgttttttataatctatagaggcaagtaagcgccatgtaggacaaagacccggtcaaaaccaccgagggatattgtttgcaccggttttgatagttggaggagtcgatatacccggttttgtggttggaggtcatgaatcatacttggacgatagttgagggactcaaagtatactttctccaatgctaaatgatggaggaaatgggccaagttctgtgaggcccatgcttgtagtcttgtttagccagaggataagggcttgaaaggccaaaaactaagaagggcctttttgtatgtatctgctgtgaaattggacctgaatccacgtctaatttcgacctatacactcttgcgtggaccagtgtttttagtttaattttccaacatggcacccataatttaataaaccaaattgactacgaataatctgcccgtttaaatgtttccttaattccctcaaaaacaaataaagaaaattcaaaggaatattacactactactccagttgaaaatttctttttagagtgggagcaagagtccttcgaacgtttgattgaaaaataggaggaggccaatgtaaaagtttcatttatagcaggggccattatactatttgagtaatactctactatagtgacttatgtactttaatgcaatcctctcacttgctataaaattatatatcgcactaatttctaaagcttaacatacagagatgtcatatcattacttactaacaattattacatttaaacatcatgttatattatctataatttaataatttattaaattttagagatttaaaatataagcatgttaaatcatcccacataattcacataatatttcaatatatctctccatcatttttttaatatcctataaatctatatagttcatcctcactttattccatgttaattttcttttctctcattaagtcatatcatataaattggttttagtcctcaaatgatgaacctatggttcaaattatctctcttctttttttctctctcactaagccatatcatcttagttctttgtagttcttagatgtatggtctaaattatcttccttcttgtgttttcttcataaagccacatcatcttaattttatatttgatccaacgtaggtgctgagtgactgagtccttctaataagagatggaagggagaagaagagggatatgaggaatagtgtgggttgggtgcagtgcgagtgcgggggctgaaggaggaagaaggagatgagtctccctataatctagttcgagatccctatttggagatagggtgtacgtgcgtatgcgtttgaacaacgtttctaaaaattttgaaaaattttggaaaatgaaaagggccagaaaatggtataggaccaatttgccaaaaacgctaatacacgactagtcgcgcgcgtcccttcccgcgtgacgagccacgtggcgcgcgcggaggagttaggttgcgttggttttttttctggttttcttttttttcgttcgtttcgttggttttttttccggttttctttattcgttagtttcttccgttcttctgtttttttgtccggttttctcgtttttctacgttggtttcttccgtctttgttcggttttttctctcccttttcggtttttcagtagcaagtttgtatacacacgtgtacaaagtttgtatacatacatgtatatattttgcacgtatatacagtttgtatatgcacgtgtacaaagtttgtatacgcatatacaaactttatatacgcacgtgtacaaagtttgtatatgtacgtgtataaagtttatatacatgtttatatttttacatatatatatataaagtttgtatactcccgtatacagagtttatatacgtcgtgtataaagtttatatatatgcacgtatacaaagtttgtatacgcatgtatacaaagtttatatacgtataaatgtacatatatggcaacgtatcctatgcacacgggcatatagctgcactcatgcacacgctcgttccgagcccttcgatcaagatcctgcggctaactctccaagcgttgcatttttacaatttaccgcccgcctcctccactaagttttgcaaaacacccctccacaattctcatcttccctcgagcagtccatattaacaaaaaaaaaaaggttaattggatccatgccattacaactttgcgaaattaaaaaaatcccactactattcaccatatcagctatatgcaactgaaaattcctaaaatggaaaacatgccacggcgccccttttcccatctcctatctaaccctgtctcgttccccccgacagaggtggggtaatctaacaccatctccctcttctttcttcctgcaagctcggcggccacggcaagcgctcgcgggttgaggaggtcggcgtcggcagcgcgcggaacttgctccaatccccaccgcctttactgacatcgtcgtcctcgtcttcctcctccaccagacgccggcaatgccgccggtcgccgccgccgggctggcccccgctgccgcgcgcagctgctcgaagaataccacctgcatgacaacgcggagcgggaggcgattgttctgcgccgcgtggatgcgcccctccttggacagcttcttcacggtccatgacgctcgtgatcttccgatcctcttctccgccttgggcacgttcagatgcaactgacaagtgacagcagattgcaatatgttcatgtcaaaaataatagtttagaaatcatatacaaaatatattagtagtttatacttaacatggtggatgaaaatatacatcaacatgtacaataaagcaaattcaagaaccaaaaaagatgaaaaatgatcactgttttgcatcatggtcattgtcaagcaaatataccttgagaaagacatcaatgtcggtgtacagtccatcatgggttgctcttgctgcatcacgcaaggaggtcggagaggaagacagcgacgcccgcgggggagtagaggagggagcggaggaggtcgcggaggtgcgggagcgtgcggcggacgacgatgaggatgcgggcgctgcgcgtggacaccacgctcgccggcttcgacggcctccgcatccgccgggccaaccatttgttcctcttcttcggcgaggaggtcgacgccagcggccgccaccttcccccgggctcgctcctcgtgctccaccgcggcaggagagcgtcggggagtggaagtcgcgggccgacggccaacgctggccgtaagccacgttcgagctcgccggagatgacgatgacgacgaggacggcgacgaggaggagttcctccccctggagatccgcgacgatgacgaagacgacgacttcatggttgccgacatctccccgcccccgtcgcgccacagctgctacatgcccggccggcgcagcgtggcgccgccgccgtcacacatggcgacgccgccgtgctcgacgatgcgccgggcgagctcagtctcgggagctgccgccgccgccgtcgtcctccacgccgtccgcggcgggagtgctcgggagctgccgctggcgtcgccgccgctgtccttttgcagttggagggagagagaaagggagattgaaacgattaaacgtgggaaggagacggcgtgagagtggggagtggaatctaatccctcgagggatatccctcgtatatctttttttcttttaaattcgatgtaaatagttgtaaaaaattctgaaaaaaattgacaatgtagagtataatgatacctactagttcatcaaaatttaagtttaaatttgatctgcacatcgagaaacaaaaaaaagacaaatttagatataaacagtacgctactatttatacgctgaatttatcttttttatatctcgacgtgtgagttgagtttggacttaagattttgtggagttgtatatatgtgttgtatgaatgttgtcaattttttccagattttttcataaccgtttagataggttttaagcaaacgagggaacatccccttgagggattagaatagtttcccatgagagaggggatggaaaaagggacggcaatggtatggttccaattttagaaatttttagtggcatgcagccgatataacaaatagtagttgtattttttaaatttcgcaaagttacagtcgcatggatccaattaaaaactcaccctatctggatctagcactagcacgccgcatgcgcaacatcggcgagggtttgtgttcggaggcagcggcgacaatgcttcaacggagacaacgacatcaatcaacgaagcgctggcagagacggcgatctcgagcggcggcagaggctgctgctgctttcaccacagcagaggttctgttcaagtttagggggaaaaactaggagctgcatcatgaacacgatggattgatggctgaatatcttctatgtaatcccatgatttttccaaaacattactagttttgctttggacgcagatttgaaacagtcaggtggtgatgaactcttaaatctcatgtgaataagaagagcagaaattcggactaaaacaacaaatttctccgaagaaaaaagtggtaaatagttaaatgccccccaatttgccacttttacggccgcgcgcggtcagtcgctaatcaactcttcccctaatttatgagatattgaattatatgtaaaataatttatgagatactgaactatatacaatatagttaattgacaaatttaaaaatgacaaatagttaaatgccccctaatttgcccccacccgcacacggccggtgagcgtgagtagcagtagcccaaaaaaacacaagcaagggaaaaggacacgaggccgagggagggagtttggcagttgctcgctcgccaaactgccagatccggatcccgcaccagatgcgcccgacggcgatgctccgatggcccgccgccgcggcggcgctcgcgctcgtcttcctcctcctcatcgccgccgcgccccccgccgcggccttctacctccccggcgtcgcgcccaacgacttccagaaggtccgttcctcctccccctcctcctcctggtaatggctcccgctcctgcgcttgctggatctcggcgatcccctggtgcagatccggctccttgagtcctcgtgctctagccttttcggggttgtccgtacgcgccaaatcgttttggcttttttttttctttttttgaaaaccgaagccagcaaagctggtgttataattttggcgtgatcgtcgtcctgttcttccacacacacacacacacgtaggggatgctgtttcgtacgcgtttctgtggatgttggtggggtttggttgatgagtgatgaatctgtgtgccgcttgtcgccaatgttgagaataaactgtatattttcagtgctgtttgatgtaggggtgtggctgatcagtgctaaaggcgtaccgacatttggttagggatgcctctgtcatgtggttctagttgcatgcctctggaattctggatggacattagcatccttagattagatccattgtttcgcaagcctcagtgctgaggcagaacatgtttctaaccgaaagcgaagcaaagcagtttatctctttgagtggaaaaaacttctgcaatgatcctagcatatgcatttcgtattatccctctgaacattttcagaacaaattatattgttgactatagctgtattctgtaattttttcaagcttgcgcattgagtaaacacgctccaattttcaacatcttctcagcctctctataccgtaccctgtttatcttctctcgtcaattgttgccagttgtgcgtgtatcctcaattttgtcacttacgaatggcatgcatgtccttgcaacacctgcttaatcacccttttacccttaattttttttgctctctatcgttcagtcattagttttaagaatgactgtgctactaggcattttctaggttattacatgtttattctgttctgctacgtagagaagaaaacatcatgaaggtgactgaaagaaaatatttttgagtctgtgaagaaaaaaaatatctagtaatcttaaaaaacatacatttacatttacctgccgtactgacaatatcttaaaaatatctagtcatatgttttggatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtggtcagtactggtctctggtttacagattatctgagcgcactcgcatgttaatgtacctaattatcttctattttacttcttgggact

SEQ ID NO: 26209 - DNA, 12595 bp, Oryza sativa
  unsure (1)..(12595): unsure at all n locations
tggttctttgctcaagtaaacaggtgatgttttcatctcatttgaatacaactgattgcgcagagttacatgatctgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaaacacaaaaatacttagattggccaatgtccattcctatttcattatttgttatcatcattcaagaagttgatcctaaatacacaaaatgcttgtattttcaggttcgtttcaacgatcaggacagaactgctcctcacttcacaactgggttgattgggaaagacaacacgattgcgaggcacgggatccatgggctgtactggctgttcaacatcgatgtgagtggagcttggcttgttcaagggatgaacaccatctacctgaagcagcccaggaaccagagtccatttcagggactgatgtatgactacctaagaatggaaggtccttctggcagctaaggccagtctttagctagttaaccagcctcacatgtatcgctagtaatagctgtactatgcctaggtatgcagtatgattttaaagtttaatcttattttaccaaaaaaaaatcctgggttttgtctaacccggatttagcttatctgatttaggttagctggtaaaaatgtaagctgccgaaatttctcagagcatcagaattttgaaaacgataagatataatctaaattggtgatatgtattggaaaaagaaatatcatttcctcttttaactgtagtgtaacgattagaaataatctaaattggtgctatgcttttgtttttcagaattatccgtatagcttgaccgttttccgtttccgacggataatagccttactatatccatattcgtctctgatactatctgaagttatccataaatcaacacagtctatttccacgcaagtgtctggacagtccgaaactatatgaaccaatttcatcactacctgtggatatatattataactaagcttttttttggatatatattataactaagctttttttttctttctctaaattagttccgaaagattgacctggcgatagtagacctttttgtgcgttgtagcacgtagcatttccacttattgagaagatatcattttgtacataaattattcaagtcatatgaacacgagcgagtgcatataatacaaaaagaaatgttttgagtacggatcgttatccttttagggtttcacattcatatatacttcttgtaagttgtcgttcggcgttgtaacctcaccccgatacagtgaagatattaatttgctggctggcacctatggttttttctctcctgctttgggaaggtttttcacgttaaatctcgtgtcttctgtgattgatctattgttctttatcttttatttgcctattgtttcctaacgcaacacacatatattttgctagtttaattaaaataataaacgttttaacacaattacatatgcattgtggttaaaagtagaaattatgtagtcctcgtacagcataaagaatagaactaactaacgaggactagttaaagagaaaatgtaacaataactattaagttagtgctgaaaaaactactccctccgttgcagattacaagactttctagcatttctcatatttatatagaagttaatgaatctagacacacatatatctagatttattaacatctatatgtatgtgagcaattttagaaagtattacattgtgaaatggaggaagtattaagttaagtataatcagtggcatataagaaatttgtctatttttttactagaaaatggctagccctattctattgaaccagatacgtgtggaaagcataaatttgattagtacgacgtccaccggcccatctatgctgcagtcctttacataatgggcttctataatagcccatgtcccactataaaccaaccaatggcccaactacttaattgggccttccacaatcaacaagagcagcccgctgtagagagggcanaacctaactgtccaaatttgcgtgctggtttttaaaaataaaaaaaccttattgaactcaatcaattaatatcagtgataaaaccatattgaaaacattctcggcatttgcataacttgaatacacaaccaaaattttcacgcacatagtatcacatagcaatacactcttgtgtgtgactatatgtgtgcagtgtgcgtgtgtgttcacgtgccacattatatttctatcatttgagccattaattgttgtaagattttcacaaatgttatgttcagacccagccaaaattgcagtatatatctggcaccaatttgatatgcgttatcaagatcactaattcagtgtgacaattgtcaccacttaccaaaatacggagtagtaaatgtacaaattaaatcccagccagattcaattaaattttgtagccacatcacatacaaattgaacatcaaattggatttggttcggccttaattcggtgttatttttgatggcttgcgtggctagcttcatccatcatctctctagaacgagaagaagctacactgcatgcatgcatgactgatcagtcattgacaattaacatgcattatcaccagttgatccacctaaattaaataatcaaaacaccacattaatccaccattaacttgatcatctcatcgatcgatcgattgattagctagttccatgcttgcatgatgcatcgatgaaccctaataatctggtggttaattaatataataattaattaattacttcatctcttggtccagtgagccggccatgcccatcccggcggcgccgccgtgccgcagttgaagccccggcgcgccgccgctcacgccgaggaagtccctcgtgctcagcttgccgtcgtccacgccggggaagccgccgccgacgaacaccgttccggcgccggtgccgcccccggtcgccgagagcgtgttcatcatcagctcccggagctggctctcgttctccgccgtctgagaagcagtgctcctcgacgagctctccccggacatgatgaacccggctgctccggcgggcttaccgttcagagcgccgccgccgccgccgcttccgagacctctgagtagcgagttcacgctgccggcgccgccgctgctcgtcgtcgcgcccatctgtgcggccttctggagaagcgccgtcgccgacatctgcggcggcgggacggtctggtcggacgagctgtacaaggacgagaagccgccgccgccgcccatcatgttcccggagaagatgctccccgagtcggcgttgttaccgctgttgccgtgctcgccgctgccggcgcgggcgccgttcccggcggcgacgccgttgaactgatccgggaagacgagtcgtccctcctggtggtggtggtggtggccgccgttcccgccggagaagtagctcaggttaaggaggccgccgccattgctcccctgctgctccggcagctgcattaggccgtggaacgccggcttgccgtggagcagcgaggtgtgggcctgtccgtcgtcgccgccgccgccgaggtagaacggcgaggaggacgacgacgtcggctgcgcggcgcggaacgcaggggagccggccgcggcggacgacgtggccatgaggtggtcgaactgcgcggcggcgttggcggcggtggtgatggcggaggagtggtcctggaacggttggagctggtgggaggcggccatgccggtgaggccgccgatggccatgccggcgccggcggcggcgtacagggcggcgcccatgggtggcataatcctgccgctctcctgcgccagcgcgtcgcagaaggcgcggtgggtgatgaagctgtccctcctgcatgtggtacaaagttttttttttcacggtgatcaatatgatgtgccacttaattattaatctttataagcaagatatatactccctctgttcttaaatatttgatgtcgttaatatttttaaacatatttgattgttcgtcttatttaaaaacttttgtaaaatacgtagaactatatatatacataaaagtatattcaacaatgaatcaaatgataggaaaaaaataataattacttaaattttttgaataagacgaactgttaaatatgtttaaaaaagtcaacggcgtcaaacatttagggacggagggagtatacaatttactcctagctagagataataatgatactgatcatgatgctatacacaatgaagttgggaagaaatacactacttgattggttttaaattaattacttgccgttctatctttatcctcggtctcaaacatccatatatttgaccatcaatttttaaacagttgtatagtttagcatcagtgtgatttatgcatgttttcagatttaccttgaaaaatatcttcataatataccttgaaaagtacagtttttctagaaaccaatggccaaattaagataaacatatttgacttaggagatcaagctaaaacaataagtaatttgaagggtagcaggttggtatatgtgcattcacatgttcacctcaaattcactttcttcttttattcacttgtcatttaattcactcatcttgtatatagttgtttcgttgtgcagccagcacaacatttatcttttaattaattaagttgatgtgaaaacagaaaatgtgaacattatgatttggtttacagatcaatatatacgttcaacttgtcactccagttatctttttttttttaaattcaataataccatcggttatgagaaaaaaacagttcgccaaattaataaatgaagaaatgtctaaaagagcaattaatcaaactagaatatcaagatccattgcaatgctaaattgagcatatagctttcgagacatatatcatactgctgtttaatagcacacgaagttttcccccaatttaagcactatctaacttatacacaaaattacataaacatatatatggtaccatcaaatatcctttgctaacatatatagcaacaaaaaaattgttgaaaattatatatctatttactaattaaaaaccatactaatgtgcatgcatgtcaacatggaatttatttgtggacagaaaaaacattggcttaatttcactagtagtacatgcatgcttgattgtctttgtaccaatatatccaaatatatgcggcagattgtgcaaactgcgactgtagcccatgatcaaaaagccagaaatgggaaggcaaaacaaagggaaagaaagaatgtcaatgcaacaatacccaaattaagatgcatggtgtaactgtactgtaccctctctccaaaacattcatacacaattgcaagcaaggttccaattttcagatggggatgcaagagcatatctgcatatgtgtgtgtgtgtgtgtatacacatgaaatggttactaattacacatgcatgtatgagcagatcgatcaggtcgccgagtggcatcatcaaatgtcgatcgatccgaatgcaacaacaagtggttcaggctgaatagtaaggccaataggactaaaactttaagtctctatcacatcggatgtttgaaaattaattataaatattaaacgtagactattaataaaactcatccataatcttggactaattcgcgagatgaatctattgagcctaattaatctatgattagactatgtgatgctacagtaaacattatctaattatggattaattaggcttaaaaaatttgtcttgcaaattagctttcatttatgtaattagttttgtaggtagtatatatttaatactctaaattagtgtctaaatacagagactaaaattaagtccctagatataaacaccacctaagctaacgcagctgctcgtgctagtagctagcacagtcgccatgaaaagaatagagctgtcgtctctgtagtctgtatgcatggctccatgcatcgatcgcatgcaatgcaatgcaagagagagtagtactgatgcatcccatccgtcacaagagaacaagccatgaccatggccatggtccttgcttacattgctgtagtacgagtatacagagagtactagtactacagttgcagctagcaagggctcttgtcatcacgtgaacacgtagggacgatgagagagagacagagagagaaggatacttgtatcaagatggtgcggattccgagtcgaaaaagatgactggcttttgtttttctttctgaaccttttcaagaggaggaggaagaagatgaccatggcggcatgatctgcagtggcctctctcagctggcctgcctgcctgcctttgtgtccccctccggacaagagcagttcacgtgtgaccagctaagctactaatcctatatactctctctcatggaatgatcaatgggaaaagttaatttgttgtaagaggagagtaagcaaagggaatcaaaatcaaatttccaaacaagaaagactcgagagacacaaccgtacaaggccagtcacactgttactacctactgttcttcactgcagcatgcgcgagtggtgacaaccctaaccctaacacgtagtagtactcacccgggccggccggcgacctagctagctagctagagccatctgcttcaatcaaatcaccatcatctccatctatcctagtatctaccaaagctattcatctcgtgcctttcagtgcccggacctcctcctcatgagtgtgttcatcatgactcaatcatatgatgaacaaaatatataaaagtacatgaaaaggaatcatcccaaatccaaacaattctctaggttgccacatcttgcaaactaatggaatatctaataattcaagacatactacacctccatctcaaaatatatacggtaacttctagctatacatctgacacaagacgcataaccagaagttgctgttgagaccacagagggacatcacaaacaaaaaaaaaacaaagaatttaagagatattatctccgttctcaaatatgaaactttttaattatacatctggcacagtcatgcacatataccagatgcatagccagaagttgctactgggacatacggaagggagtatgattcgcaatagaaagacgaagatgacgacttatattttgagacggagggagtagtacataaagagtacctggagaagagggtgccgcagtcgcagcggtactcgcgggtgccgcaggtcttggagtgagccttccagtcggactggacggcgtagcgcttgttgcacttgtcgcacttccacttcttctcgccgtgcttgcgggagtagtgcttcttgatgccggtgaggtcgccgagggctcgcgacgggtcgtggtggacgcaggacggctccgggcacaggtacacccgccgccgcgtctccttggggttcttctgcttcagcttccatggcaggttgtgccctcgccggtgcagctgcaggttctgctccctctggaaccccttgttgcacacctcgcacacgaacctgttcgtcgccagcagcgtgtgcggcgacagcgccaccacctccgcatcaggatctacgtacattatcaattcatcattgaattaattgatcatctgcgaaattcattcagaggaattatattaaatgagatacttgcttggattcccgggctgattcctcttcttcttgggcggcggcgtggccgcgaccggagcagccgcgttgttctgcaggggaggctgctgctgctgctgctgcatctgcggctcgccgagaccgaagtagtgtgcagacgaggcggctgccatctctatctctgatgatagttaatcagctcaaaccactgatagactaattgtcttgttctgttaaattgtggctgaagaagaagataggcatggaattaatccaatccaattaagtcacactcttcgatagtagtatgtgtatcttggacgctagctagtctaccagctgacttccaatcctcttcgatttgcacgacctgaaaattaatcaagacaaaattaagcagagatccaagaggtaattacatgcgtggatgaagctagctagcatggaagatggtggatggatctgtactgtgtgcagccataggacagacaaactgactgacctgcagctgatcgatcagatcctctctaataacaaagcaacaaattaaatcaaaaagggggaaggaaacgaaaacgagaggggaatttaatcaaggaattaataagagaggaattaattcacaagctaattaatccaaagttccaaaaaaaaaaacatgcaatcgtacgttgcacatactcacaagcaaggcagctagaaactagctagcttgaaaaaaggagactggtcaataacatgagataaggcatggagaccgaggtagaagaagaacagcacacatgcaggagaaaaaaccaaaaaaaataaatcacatgtcatcgatctgagatggagatcgagaaccgaacaaacaagttaaagaaaacaagctaggctccttgttgaaaaaaggaagaggagaaaactctaattaaggcgatggagatagaaatatatagagagctagcaaacacgaaccggggttataataaattcgaaaagccaaaaacgagactgcagctatctcctcgtcttcttgctgctgggctagctagctgctgcaatctatactagctagtacacgtacgctccaaattctccaagttttgtttggagctagctatagcacatgatgacgacgacgacgacgtaactggtataacaagctagcttaggagcatatgctactatatggcgcctgtggctggagaagaagagaggaagaagacgagagagcgagcgagcgagaggagaggagggagatcgatatggtgtggatcgagtaatcgatcgactcgagttgggtggttggttatgagcgagcgagctagctagctctcctccggcgccggcacaagggtggggcccacgtggcgccctctatgggcccaccatgacatagacagatgctctcgtcccttccactccaccccgacctctccatcctatactagctcatgttccctggtatatatggatctatcatctatctatatctccaattcccaatcagatgtacatgtacacgtgaccgtgtacgtttagggaagcttttagtagcggcaatttcttttaaatcttgagctctcttaaatagtttaattagattctcactccaatactagggattctctgtagttatagaattcagaaaattaactactaaatagaagtaaaagattaaaaacacagtttgcttcgtattctcactagccaaggctactcattagtttcttcctagaatctcaatctctccaaacgtggcctaatatcttgagatttctcgctcaatctatatatgtgtgtgtgtgtcgctttcggaggggtaaaacgcttttcaatctattgtattattaaaacatcattaaaaagcgacattaagtgaacgatggggactataaattctcacattaatcaaagaaaagaaaaaatagagttaaaaagagttcaaattatagttcccagcggtaaagagaattagcaatagccagcggtcggggcgtagaagtaaggtgacgatgtttattaggacttctaaaattataacaagggaaggacgagacaatgaactctaaaatagtacgatttcccaagacaacgagatattttttaatacattttaaaattatgtgtaattcttttataattttatgcgggtgctaggactgctagcctcataattgtacggggcgcggactactccaattactggcttaaaaaaacgattgatcaatcaaatttgaagcgctagctgttgtgagtggggagcctttttggctggatgttttgcttgcctgattaattatacttgcagtggctgctgtcaggggcatgtgtgacgtgataacaaacactgaatccgctgtagagcggctcatcaatcatcaggccctgaatgttgcggcacagagcatgcatctacagctagctaggtacatatatccacgaccaagttccatgtgatcattgctcatcacatatgtaaacgggataaagatatatatatccatttatctaaacataatatatactatatgtaattggcttagttaaataaaaaaaatgttatctaaaatttaaagtccaaaaacaattatatcaggcggcggttgtgcatagaggtacatacatgaacatatggcacgcgtgtagattttttttcttcggcgcatgcatatagcgaaactaagtgaaaaattaaatacgaaaagcatatattaatattatatgctcctcatgcaaattgagaaaaaatatctttgtgctaaaagattagttttggcatgcatatatatctccaagagtttcatgacattctttgtcacatgtactttgcttgtcaagtgcttggcagcaggctatggctgtgttcgctgctggcggttcccatgcggaaaacggaacagtctattagcgcgtgattaattaagtattagctatttttataaaaaaaatagattaatatgattttttaaacaacttttcgtatagaaactttttgaaaaaaacgcactgtttatggcaatttgaaaagcatgcacgtggaatacgatggagaggggttaggaaccctaggttctgaacagaccctatataacacaataaaatactacgctgttgaatagtaattcctctacgaggcatgcataattgcatgtgatgtgtattcgagatcaaaagtacaggacaagttcaaacatatagaaaaatcaggaacagatacatacttgtgtgtatatgcagatgtgctcacatgtgatatataattagctgatcatttcatctccccagaaattccaaagtagcaaagtttaatttagtggattacgatgtataggaaacagcaactatccacagagaggaattacacaatggcgactaaaggacaaagccgtgtattgtcaacagcacgaagaaaaacaaaattcttgtcacgaggctgactgtaaagtacagcatatatactacctgtaaataatccctctcaattaaattcaaaaataacacatgtgcatgagcaagatattaggtcgacgattcagcatcgggtataaaagggcatccaaaaccttaaaataatcaaattcaagctgttccaagaaaattcaaaatctctacacctgatatccaaaaacctcccatatgcctcaaatattaattattgaatcaattagacatatataaatcaaatgttacgatagacgacacgagtttgatgttgacggctagctactagataaacttgatagcagaagaaaacacaacatgccatgttgccatccatatgaaccaatcatatatctcttgttttctcaatcctcattctggtttattagttttacatagtagacaaataaagagtaaattgtgccggtatatctgtgatggtattttgaaactcgtcgacagataaaactaatgatatgggggggggaattctatagtgttattcttgttttgattttccatgcatgcatcatcctgatcactactccaataatgtcaatactaccaataataatgtgttaatttcctccatatcttatatgctatctacttctcatcagtactaccactactagaacaacgatttttgcaggtagccaaaacgaaacagcagttggacgtggtggtggtggtcatcattgcagggaggattgatgccgccgtcgccatcgagaagccggctttccatggacgccgcttctaccaccacctccagcgccaacattgtcaccaagaccaccacgaggaagatgacaacaaacagcgcgaggagggtgcgcccttgccaccatgatgaggaggaggccaagacgagtcgttgccagatccgccgcctccgcctccctcatcgccggatccaccaccctcgtcggagaaccgtgtgccacggccgggggagcaccgccgctgctcccttcccttccaacactaccgagccccgccgttgctgccgttcgggtgaggaaagaggagctcaagagaggaaaagggagggagttggggacttagaaaaaactggtgtttcagttttcttttgcgtctatttaaatgccacaaccaaatttcaccggatggcttaagaggcccacctgcaaaaataagggtattattgcaggcagcccttttaagccatctgcctgcaaaaatgggaataggatattcccaggcggtcggccattggactcctctccacacaacgtacaactacacaggtgggcaatcgtagtcgaaaataagatctgcctgtgaaaatctatgtgtttcattgtagaaattcgtttttctagtagtatgccatccatcatcagccgcaaggagagagatgaagcaatgagcaatggatgatcttcttccaatggggctgcagga

SEQ ID NO: 26210 - DNA, 1205 bp, Oryza sativa
tccaatagttctgtatgattattgtggagaattgtgagacgaggatcagaatccactttgtattttgccgattttcaagaaaatttatatcgtagttcttagtttataaaccacttatgttcattcactataaatgagatgatacatctttgatatgaggttatataaggctaattacgattgttaatttcatatggcagagcatatttctcaattcttatggaccactgtatacattcattttattatatacggttaccgaatgctactgttctctgatcatttttacccttgcatgatgcatcgtgataatgtcattggtaaaatcagtatcaccagcagctgcaatatttagtaacaaggatcaaacagttggttgcaatatggcgattgacgtgatttacttggagaatatctggaagtggattgtaagggtaagaccatgtcatttttatttaaccggaggaatggtagtattggtggaggactaccgtggtgtttggatccagggacttaactttagtctctttatttaaacattaatttagagtattaaatatagactacttacaaaactaattccataaatgaaagctaatttgcgagataaattttttaagcctaattaatccataattagagaatgtttactgtagcactacataggctaatcatgaattaattaggctcaatagatgttttcgttctcgcgaattagtccaagattatggatggattttattaatagtctacgtttaatatttataattagtgttcaaacatccgatgtgatagggacttacaagttttagtcccatctaaacaggatctcaggtctatcgatggctagctaaaacagccagtgcactgttctttttagagctatgcgccgtggtgtggagagaacactatgcagggttgtccactgaacagtgaacagtactactagctagacagcggtctagctagattgatcgatccatatacactggtgctgatcacttgtggatgtcaggtcggtttggtagaactcaaacttctaaatttagatttagaaattggatctcaagtaaagttgtggaacagatcaactaaactaaacccagcttcacctattttataaaaacactctatttatctccactcttattttagatcaagttaaaactgtttgacaaagctccagtttctagagttggggtgca

SEQ ID NO: 26211 - DNA, 7713 bp, Oryza sativa
ttgttctccactagaggtgtagcaatttctcacactacatccacttctagtggttgagttacgactactacatggtcctcgaccagtggtgtagcgattctcccactacctttacttcaagtggtcgagttggggctacaactcatttttgaccagcagtgtagcggtcctcccattacctctactccaacaaagttgatatcaggtacacaatatcgccaagtgttttacccagagatcccttaccacgacgacacttagagttgaaaccaatcctactgtccctttatgccgccctggcaaggcctccgaggaacctaagggaacttcggctgggcacgcctagagcggataaggccttgtcaggtaatgcagagatgaacgaccatgtaagatctggtcatgtaagagttctcaccgtgcgtattaaccaagccgtgtaatcggaaattgggttttccaacttcacgactgggggctagggtaagcgctttttcaaccaaggcaggtcaagggtccaagagcattctcctccgagaacttatctccgatgacaaggctgggggctagggagagtgtatgactcaacaaactgactgattgaagtcgataaaagagaagacgcttgtacacaaaacattggtctgtaaatttaattaatttttagtttttcatacatattataacatgtcaccctttgagcattcgctcggggggctatttttatctaatattcttttatgagtattgatttcaggaaaattctattcgacattggcgaagactccatgtctctatggttctacaccaagattcactaaggcgagtacgacaaatgttgacaaggcttcgtcgcagactctgcgccttctcgaccattcgagaacggttggtggatctcgacaaggaatacggaatgaaaagatggtatacccgccgagataaaatttcttgacttcaatccaaattctcgattacagcaagacgggagacttagtcgtatgctctgtaccttcttggttgacgtctgagatttactcagacaaaccctatacggtgcccacacgaggctgataagggaagtctaatgttatctctgaactcaccaagaacgatcacgtgagcttgacaacagttattccgaggtcttcggattaagaatatgaactcgttcatttgcattgaagtcgggggctactgtcagggttatggataccacatacctaatagtagttgactaaatctcggtaggacccaccacataccatgttttatacgaaaacaaccttcgggtatagaaggagttccggataaggaaagataaatagagttctacatggaaacgacaaggattactcggattgtatccatattgatttccctagttctacttggaaaaagggaacacctatgggtataaatacaagacccctaggaggagaggggggacggaacagtagatcaagacacaagatcaacatacaagccaacatacgccaagacaatacgctggatatcgactttagagataagcatggctagtcgcctgcggtgtctacggatactgataggagagacatagcgctgtctttgaacttgccggatgcggattcgaggaggaaggctaccctgttgtcgactacgagtcagcacttcagaccgccaagtcgacaacagttagataggctaccccaaatattgtactggtgtgattatggtgaataagagcaacgaccgggttcggccaacaggagtagggttattacctgacaattcaggagcctgaacctgtataaaaatccttgtccccatctcttttacctcaatatcgtatatatcctagtaccaacaatccccatactatgcaaataccgtagtcgtgacatcaaacgtcgatagatagatagatggattgataggttagataagtagatagatctatcaatagacagggagggattcaaggtaaggatttgatattttcttggaaacggggaaaagtatttggcatggattcaaaggaaagatttgaatttcggaattgatataggaagttgaatcggaaggggaatttcgaggaggcgatttttgattttgacaggagggaacaaggaatttaaactaagatccatggcacgacttagactctcactcaaagaacgaaattttcgcaattaggattttattgatttagtttttaacgtctcgcgaaaagcggggcgttacagatgctatatcattacccattaacaattattacatttaaacatcatgcaagcatattatattatctataatttaatagtttattaaattttagagatttaaaatgtaagcatgttaaatcatcccacatatttcacataatatttcaatatatatctccatcatctttttataatatcatataaatctatatatttcatcctcactaattccatgttatttttcttttctctcattaagtcatatcatataaattgtttttagtcctcagatgattaatctatggttcaaattatctctcttcttttcttctcccataaagccatatcatcttaattctttgtagttcttagatgtatggtctaaattatcttccttcttgtgttttttcataaagccacattatcttacttttacatttgatccaacgtgggtgctgagtcgctcgagtccctctaccccactggataaccattgatagaagaagacataaaagggagaaaaaaagggatatgagaaattgtgggggttgggtgtgggggccgaaggaggaagaatgagatgagtctccctataataggctatgttcggcacgcctggttcccaacatgaatagtgtgtacggaaaatagagcggttcattagcacgtgcttagttaattattaactaaactttttttcaaaatggattaatttgattttttaagcaactttcgcatataaatttttttgcaaaaaaacacaccgtttagcagtttgaaaagcgtgcgcgtaaaaaaaagaggaagaggggtaccgaacacaggcataatctagttctagatcctatttggatgcgtatgttacgtgcctcttgcgtttgaacaacgtttctaaaattttttttaaaaaaattggaaaataaaaaagggcctgaaaatggtataggaccaatttgcccccagtcgaccggtgaacgtgagtagcagtagccccaaaaaaacacaagcaaaggaaaaggacacgaggctgaggtaccagttgctcgctcgctcgctcgccccagatccgggggaatccccgcaccagatgcgcccgccggcgatgctccgatggcccgccgccgcggcggcgctcgcgctcctcctcctcctcatcgccgccgcgccccccaccgcggccttctacctccccggcgtcgcgcccaacgacttccagaaggtccgttcctcctccccctcctcctcctcctcctcctcctggtaatggctcccgctcctgcgcttgctggatctcggcgatcccgcggtgcagatccggctcctcgtgattctagccctcttcgctcttcgggggatgctgtttcgtaggcgtttctgtggatgttggtggggtttggttttgatgaatgatgaatctgtgtgctgcttattgccaatgctgaaaatgaactgtatatttcagtgctgtttgatgtctgggtgtggctaatcagtgctaaaggcgtaccgacatttggttataggatgcctccacggttgtagttgcatgcatctggaattctggatggacattagcatccttagattagatccattatttcacaagcctcagcgctgaggcaaaacatgtttttaactgaaagcgaagcaaagcagtggaaaaaacctctgcattgatcctagcatatgcacttcgtattatccctctgaacattttcagaacaaattatattgttgactatagctttatttgaacagtgcaattttttcaagcttgcgcattgagtaaacgtgctccaattttcaagatcttctcagcctctctatactgtaccctgtttatcttctctcgtaaactgttgccagttgtatgtttgtcctcaatttcgtcacttatgaatggcatgcatgtccttgcaagtcactcttttactctaattttttgcccactatcttttagtcattagttttaagaatgactgtgctactaggccttttctaggttattacatgtttattctattctgttacgtagagaagaaaacatcatgaagttgaccaaaagaaattattttttagtctgtgaagaaaaaaaatatctagtaatcttaaaaaacatacctttacatttacctgccgtactgaagtcatatgttttagatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttacgtggttagtactggactctggtttacagattatctgagtgcactcacgtattaatgtacctaattatcatctattttacttctttggactatagtttgagatgagagagcccaagatgtgtcagattgtctgcaaagcaaccattagcgataaacaagcaaaggagctaaaggaaaagatagaggatgagtaccgggtgaacatgtatgcctgtatggattgtgtagtttgattgaaatttattttatatgatgggttctggagtaacatggttaaattaccttacaggattcttgacaacctcccgctagttgtgcctattgcaaggacagatagggatgatgttgtttttcagggtggatatcatgttggtgttaagggccaatatgctggagtaagtatctgtgctcagcttccttttttttgtttggaaggtgagtaatgatcttacaaaaatatattttgcagagcaaggatgagaagtactttattcataaccacctggcatttttagtgaagtatcacaaggatgaaaattcagatctctctagaattgttgggttcgaggtcaaaccatttaggttcgttcacttaaccttttcatgtttgtttcatacaacgtctttgacatattgggcaaattttttattagtccctcatgtgcatttactaaattccctgactcagtgttaaacaccaattcgaagagaaatggaatgatgcaaacactcgtttgagcacatgtgatccccatgccaacaaaatagtaataaactcagatactcctcaagaggttgaagctgggaaggatatcatattcacatatgatgttggctttgaggtgatattttcatgacatctcttcttttcttttgtactgtgactctgttccttcacagctgttcttcgagtgttatctttatttaaacaatctcttttggttttcttggctgggtcttgtaggaaagtgatatcaagtgggcttctcgctgggacacctatctgcttatgacagatgatcaaattcactggttctctattgtgaactctctcatgatcgtgcttttcttatctggaatggtggccatgatcatgctccgcactctatatagagatatctccaggtacaatcaacttgagactgaagaagaagcccaggaggaaactggttggaagcttgttcatggagatgtgttccgcccaccaactaactctgacttactctgtgtctatgttggcactggtgtccagttctttggtatgctgctggttaccatgatgtttgctgtcttgggtttcctttctccatcaaaccgtggaggattgatgactgcgatgctgctcatttgggtcttgatggggctgtttgctggatatgcttcttcccgactctataagatgtttaaaggatcagaatggaagagcatcaccttgaagactgctttcctgtttccgggaattgcttttggtattttcttcgtcttgaatgctcttatatggggggagaaatcatcaggtgctgtccctttctccacaatgtttgccttggtgcttctttggttcggtatctcggttccacttgtctttgttgggagctatcttggtttcaagaaacctgccattgaggctccagtgaagaccaacaaaatcccgagacaggtcccagagcaggcttggtacatgaaccctgccttcaccattcttattggcgggattcttccattcggagcagttttcattgagctatttttcatcctcacttcaatctggcttcaccagttctactacatcttcggcttccttttcctcgtgttcattatcctcatcatcacttgtgcggagattgcaatcgtgctgtgctacttccagctctgcagtgaggattacatgtggtggtggaggtcctatcttacttcaggatcatctgccatctatctcttcctgtatgctgggttctacttcttcaccaagctgcagattactaaactggtgtcaggcattctgttcttcggctacatgcttctggcctcattctctttcttcgtgctcactggcacaattggtttctgtgcctgcttgtggttcacgagattgatttactcatctgtgaagattgactaggcgcagagttgctatacatccggcttccaatagttctgtatgattattgtggagaattgtgagacgaggatcagaatccactttgtattttgccgattttcaagaaaatttatatcgtagttcttagtttataaaccactgatgttcattcactataaatgagatgatacatctttgatatgaggttatataaggctaattacgattgttaatttcatatggcagagcatatttctcaattcttatggaccactgtatacattcattttattatatacagttgccgaatactactgttttctgcataacgtgcttggtagtaattggtactatcaccagcagctgctttgctccggtttttctttgggtgagttgaaaagttgccatattgctgtgtgacgtacgtgtaatcagtcagtcagttattgcggtccaaccacgtatgtcgtgaccagagaaaaccagtgcagaaggcaccgaagcttagctgctcctccgccgccgtccgccggccaactcgtcgttgtcatatatgagtgaggcttagtgcttctccctcctcaacgtcgccgccggccgactcgccgtcgtaccgtgaggctttattggctccgatgaggcagcggttgatgctactgttcatccacgaattcggcatcggatataaaagggcatccaaaaccttaaaataatcaaattcaagctgttcccagaaaaatcaaaatctcaacacctgatatccaaaaacctcccatatgcctcaaatgttaccatagacgacacgagtttgatattgacggctagctactagataaacttgatagcagaagaaaacacaacatgccatgttgccatccatttgaaccaatcatatgatctctcttgttttctcaatcctcattttgatttattagttttacatagtagacaaataaagagtaaattgtcccggtatatctgtgatggtattttcaaactcgttgacggataaaactaatgatacggggcggggggggggggggagg

SEQ ID NO: 26212 - DNA, 15030 bp, Oryza sativa
tattttgattttccatgcatgcatcatcccgatcactactccaataatgtcaaaactgccaatgtattaatttcctccatatcttctatactctctacttctcatcagtactgccactactagaacaacgatttttgcatgtagccaaaacgaaacagcagttggacgtggtggtggtggtcatcattgcagggaggattgatgccgccattgccaccgagaagccgatccggaagccggctttccatggacgccgcttctaccaccacctccagtgccaacattgtcaccaagaccaccacgaggaagacgaccacaaacagcgcgaggagggtgcgcccttgccaccatgacgaggaggaggccaagacgaaccatcgccagatccgccgcctccgccgccctcattgctagatccaccaccctcgtcggagaaccgtgcgccacggccgggggagcaccaccgctgctcccttccccgccaacactaccgagccccgccgttgctgccgttcgggtgaggaaagaggagcttgagagaggaaaagggagggagttagggacttagaaaaaactggtgtttcagtttccttttgcgtctatttaaatgccacaaccaaatttcaccatatggcttaagaggcccgcctgcaaaaataagggtattattgcaggcggcccttttaagccatctgcttgcaaaaatgggaataggatattcccaggcggtcggccattggactcctctccacacaacaactacacagccaggcaatcatagtcgaaaataagatcttcctgtgaaaatatatgtgttcattgtagaaaatcgtttttctagtagtatgccacccatcatcagccgcaaggagagagagatgaagcaatgagcaatggctgatcttcttgcaatgctagctatctactgtggctatgaacaagaaggcagacatatggaaacaaacctagctataaaaaaaacagggagaaaaagatgcctactaaatttgggcataaattaaataaaaaaatcatttacactctttgaatggaaaatatgaataggatcacatttttcccaatacttttgtagaggaagctagcaggtcctagtccttgaacactaaaatacattatgtaatgacaaatttaattagtttatcataaataaaagaaaatgttattagggatggaactctgctaattaagggttgttcgagttcaggctgctccttaagatcatctcggtgcggttttatggattggcgaagcatggtaaaagaagattcaaaaagcttacttttctacattttttttgaaaaaaaatacctttgttttgttttgttgtttcttagttaagatatttgaaaactaacgatttttgtaagttttgtctatgtatagtatatctatttatggtagaaggtctgggttctctatctattatattgagacagagagagggagagaacaaacaagtgcagtgctttccttccctcttttcttcattggcccggttcttagcataaaaccggctattgtttggtgaagacaagcgctcacgagccggcctccttggtcctccccatccttggttgtattgcattggaggcatatgattgaacattggcggtgttgccccccatggcatgtagtaaggaaaaggataacccggcgacggcattggataaggcccccatgacatgtcttgaggacgatgatatgttggtgattccgaccgtcttggtgaatgaccaaatcactccctaggaggtgatcttggtcttttccctttattgccagctttctcaccaccttgcttctcatacttgtccaaaagcatatcgaaggtcaccttagtcttcttaggagctttagaactcgaagcttcattcctattctccttccacacgccaacctccggattctttggcaccatcatctttggcctagtctccccaatgaccactcatttccccttagtagatgtaacgcaccgattttctttcgggattaaaaatcaattaataatgcattttctagaaattaaataaaagttaaagcaatttaatcaagtgaaatagtgagggaattaaaaattttctttaaaaaatcattagctgagaatattttgtaatattctttgtgccctagtataccctccggatttttccatgaattttcagagctcaagaagtaattataataatacaaagttcaattaacaattaaataaaaaagaaaaacaaatttaattccctcttcttccttttgggctgacccggcccaatccctcctttcccctcctcggcccgcttgcccctctccccttccccttcttccccctctcgggccgtcggcccagctcgctccccttcgcaagtccgtttgtcctccctctcccgttttcccctccctctctatctccgacaggtgggacccgaggccccacctgacatccccttcctccggctccaaccgcccccatggccgcccgagccaccccatgacgccgccatttccgccctcctcctccaccccgcgcgcgagcccgccggccgtgggaccccgtggccccacgtccttctcatccccacctctcccctccaaaaccgccgcccacaccccacgatgccgcccacgccaccggcggttgccgccctgtctccgcctctccttggctcggtccgacctcccctcccctataaaaacactccccagcctcccctctctcgtttcccccaactcccgagcttccccgtgccctaaatcgcgctcgggaaaaccgcgaagtccgagctccgccgctcgtcgccgtgctccggccgccccatgtggccgctcctggccacctcacgccgcgcctccgcctccaccgcgttcgccgcaccgcgtggaacccccggccgccactcctttttcccccttccaccccgaaacaccgttcccaccgtgcacccaaagccgccacctctttcaccgcctccagccgctcgccaccaccgccctagtcgtcgccgcgctgcgccactgccaccgacggcttcgccgcgaggtgctgcacaccggcctcagcttcgtttccccaaatcaccaccgcacccgcccctccaccgtcgacccgagccaccgccaccattggccgactccagccgtgttgtccctctgctccggtcgtcgccgacccacgccgtcgcctccctcggctccgcaaggacgaggagaacctcggccacctcttcccatcgctgaaaactcacaggacgtccgctatcccgtgcgttggtgagcccttcctcccttcttttcctctccggccggccatgtcgtcgccccgtcctccctaacacctcccctcccatcctatggtgcagctgccgctcgtccgcctcttcccgagctccgctcgtcgccggagcatcgtcgtctccctctaccccgagctccaccgtcgctacctcccgttgccatcccgccgccggccgcctccttccgccgtgtggcgctcggtgagaactcccccacccttcttcctcctttccccttcgctggccgcctcccgtgctgtgcaccgctgctccttgcgtcgccggccgtcgccgccggttgccgcgccgtcgctcagccgagccggccctttgccacgctcgtgcgccagccgcgccacccgaccgtccgatcggtctcggtcgatatgggccgtcgggtgtgtgcccgcgtggacctggtaggccgtgccgctgacgtgtggggcccgcccctttgtggacgcggtccacgcctcaccccttgctgcgtcagcagagtccatttcctttgagaaaataattaataattgcgcaataaatcaataaattctagaaattcatttaaatggctcaaaacttctaaaatccatatctaattcattcgaactccaaattgggccattcaacttgtaaaattcatctaaaattgagatctacatgtttgtttgctttctatgtactatttacttggtttttattagggtttttcctcaatttccgtgctagcgtgtataatccgtcgtttcgaaaatccgcggtcgcgaggaaaagagttcagaagataaaagtgaagaagcaaggcaagtcacacattccccttgagcattttgatcctactttacaaatgttttcccgtttgcaaataaatatgcatgttttgctaattaaatgggatcatggtttacctatctgcttgcgtgtgccatgtttacttcatatctgtcctttgtcaaccttgggtgataaatcgactagcttgtgttacttatgttgacctagctagaatcatttatgcttagccatgcttaattactactagctcagttgatgagataattgcagtattagaactttttagtatcatggcgagctgcgtgctcgagacatcagaccatgttccattggtcgtaattatccaactaaaatgcgactgaatggtgggtcgtgggtgcatggttttgctagtcgcacccatggcaattaaggaccggttcgcgggatgcactggaagacttacagcgcttgccacaattgggaatgggtaactgcctgacttaaagtatagcttttctctagctgacgcatccaggcaagggtgggcgtgatggagcgggatgggccctgcgacggcctttgtcgcttccggattcacctaggcacgagaggggactgcccgctgcctgctgggggcgggggtgaaacctgaggtgtggtgtgtttggtcagagggggttatatgaagggtcttgtcacaatcactcgacatggtgacgtgtccggccgggcacggtgacatgccggtggattgtgtcttgtgggtacagttgtgcacttctggccaaagtaaaactattcgaatagctgttgacgaaaaaatcgaacacaccggcctgggagatctgcttagctccagtgcaggtccaaatatgatgagatgcgtgcgtgccagtcagtttgatcctgccactgacaagatatgcaaatagtagatcaaaacagccgatcggctgacaagccgatggagtagttccagccgatagccgataatagccgatgccgataccagccgatagcgatagggtttaagcaatcggctatatgtccaatgtagataatgatatagaggcaatcggctgatgataatataatataacaataatatagtccagtagaaaccaatcggctagcaacgatatgatagaataagcactgatccgaaggttaaagcgtatatcggctggaggtccgatgccataaaatccacatattagattaaacagtgaaacctttgttgcaatcggctaaatccaacttatatatatatatgtaatccttatgagctgatgcaacatccagataacttatcggctagcaccccgataaaacattagtatgaacctatcggcttcacaagacttatattatcaacaacaatctagtaggtcgaacctaaccgatgcagcatgagatgagattgtatatgataatctaatactcgatgagccgatagatctgtctaatgtgaaggatataacaaatctatttataacagcattgcgattatagagatatatcggccaagatagaagatcagacctaaccgagacagttccaactaaaccgatgcatctctaaacacaatgcaactagagatagaattgagatatcaggtaggcaaatatgtcaaccaaaccagagcgatccaagagatcgaagcgatgcagccttgaacaacaccaacgtagccgacagattcatcagggcccgacggaacataggacttaccccttcgccggagatcgaaagccgatgcagccccgcgtcaggtgcccaaatcccgccggaagataagtaaaaacctcgataaagagggtggcgatgcgccgagagtattgttgatcgatagattgataaattacatagaccccgggtgtacatatttatacccatagggagatactagtccttgtcggacaagaaagaaactaaaaaggaaaagattaaagtccctatcggacactaaacaaactttcttaaagataaaaggaaactaacaaactatgcctaattaatagataaactgtcatgtcgcatccttcttgatctcagactcttctagataagcttcctttgattgatccgactccaccaagaacatgatatcgtggcgacttgactcccatcggctgattctagaactttgaagccgataagtggagattcaatgttaccttaattaaccaattgttttactgttttgcgcaataaatgttttacaaccgcctttatgcaaatagccacaaaccgtccttgtatccccttgcacgtctgcattattggtgtggcttgctgagtacggtggttgtactcagccttgctattgtttccccttttcagaagtgtagtgcttctaagatgaagacggagttagaggaccaaggctcagaccccagttgagttttgcctgtagagtgaagctgaagccccgttaggatcgcctttttccgctgctactgctttcgtttcggtgtgaggactaagttcctcttctataattattttacgctttatttacatttagagctgtatattacttgtcgttttgtgtaccctggctggtcctgtacagggatttaatacacaaaatagtttggaaatttgggctaaatttttgggcgtgacagtagattcggcttgctccggccgaatcaacaccttcttatcattgaaattaattgtatttaccggaaaaggatcatgatcaagcttcatcttggaaccatgggtaaacttcaatcgtccttcatctatggccgattgaacctgtcgtcgaaacacattgcaatcattagtagaatgagaataagaatcatgccatttacaataagctcgacgcttcaactcttcttgagatgatatgatatggcctttaggtaatctaatttttttttcttgcaaaagataataaaaaatcttatcacatttggccacatcaaaactatacttaacctcactttgccgatctttacgaggagtcggcattaaattagaacaaacaaaagccttatttttgttagtccatgaccactcaacaacatgcatatcatgatcaccctcaccatcactatcactagcctcggggtaatcaatcaaattaacattaggcttcttctcatatggtctaacaaatttcttactatccttaacccggctttcctgagccagaaccatttgcataagttgactaacatcaagaaattgttggccatctaatctttctttaataggagcaattaaaccattaaaagcaagatcagccaaatccctatcagttatattcaagctataacatcggtttctaacatccctgaacctcttaacataatctatgacagattcattatacttttatttaaccgatgttaaatcagataacctaagctcagtttcaccagtatagaaataatcatggaatctttgttctaattgagcccaagtatgaatagaattggccggtaaagaagtaaaccatgtaaaagcaataccggacaaagataaagaaaacaagcgcaatttaaaagtatcggaactactagcctctccacattgcgctaagaattatcctacatgttcccatatggtcctactatcctcaccactaaatttggtaaattcgggaaccctataactacgaggatatggtacatcgtcatagtaatcaggatacggcttttggtaaaccttagcacgattcctagcttcaatcccgaatttatccctaatgattccactaatcaattcctctatattatcaggcctatgttggtttggtggtgggtttggtggcctaataggttgaggttgtggcgcaatataattatattggccatgcctagtatcggtgggatatcccctactaggatcattataagcattgggaacatgtgggggaacttgggaacaagcaacaacagtagatacagggggatcaaatgttctaagatggtacaaatacgcgttatttgtaataggatctaccccctgtataggaataattgcgtcggtctgcctggtccaagacccggtctgaccggcgtccagaggtgcggtcagaccggtctgaggtccggtctgaccgccggggtaatacccagtctgaccggccatctggccggtctgactggcggcaaagtcgcggtctgaccggccatctggcccggtcagaccggctgtatgcgccgactacccctcgccggtttgttgcgtcttcgccccatcagttttactacttatttgatctataggggcttggctagcactggtagaggctttatctttgaacataaaatcggccatgagagagccgaatgtagtcctcatgaattcttcacaacgagtttcaatagatgcatctaatttattatttaaagtaaccatagatgaatctattgaatgtgcaatttgttgttggatagattgtgataactcttcagcacttaccatgtcaaaagtaggtttaggcaatgatcccggcttgaaaaccacaccttgacgggtcctagcgcacgccttcgtcaatagatcttgagtatacgccttaagatgttcattcaaagctttgcgtgctccctcgtcaagctcctccaatgcgactggtatcacattgcccggttccacctctgccttggttgatggaagctttgtcatgacgacgtcgaagttgagatgcctttgagcagatttcccaagcggaatcaccaaaaatcgtgttggcaactttttgtgacaagttgacaagcacaatcgtagcacctaaacgccttgcagtgatcctagagtcgccaaccacctcaatctagcaaaagctaaaccaagatgggttttgataactaaaccggctagcggagccgattctagataactacccgtctcgtgggcaaaacggaaggttttcaggacaaacctacaaagaggtgtcacactctcgcagcggcggcggacgatttacggcgcaaatcgacaaagatggacaaactaagagaaaactaaaagcaatatggaaaacgattcgattgattgattgtagattgaattttacaatgaaccggccttacccccttatataagggttggtcttgctctctacaggccctcctccacatccaacttgggatagaatccaaaagaaacccgaaacatgccttcccgagcaaggaaacccgagacccgatgaaaacagaaccggactcggactctgccggtcagaccggccacacaccaccggtctgatcggccctcattcggcggtctgaccggccaacatacgacagtcagaccggcccaatcagaggaaaaccggcagacttccaaactttggtaattttccctattttatccctaggtgccaaatttgggtgtaaatacttcccacgggattaaacaaatacgatacccttggaatactctcgggtgaaatgctacaatggtatatccgtgcgcttgtggatgaactctgtaaccatatataccaggagtatttctgcaccattgctggaaattatatttctagtaatgtcgttaagaaataccaacaactatccgcaactcgtggaaaaggaaataaaagatgaaaagaattagtaatacgaataaattggacgcggttctcctacccccactgtaacgccccgattttcgttcgggattaaaaatcatttaataatccatttcctagaaattaaataaaagttaaatcaattcaatcaagtgaaattattgggagaattaaaattttcctttaaaaatcattggccgagaatattttgtaatattctttgtgccctaaatatcctccggatttttccgtgaattttcggagctcaagaaataatgttaacgatacaaagttcatttatcaattaaaataaaaagaagagcaagaaaatttccccctctttgattttgggccgtcccggcccaatccccctctccctctcgggctctctctctccctcggcccagctcgccgctcggccctctcctccccgaagtctactttgcctccccaaccagccaccctctcctctttggccgacagatgggacccatgggcccacttatcatccccaacttcaggccggcaactgtcgttgccgcaatggccgccgaaaaccgcccacgtcgccgccattcccagcctcctcgagccctttcttgcgtgggaccggaagcaacccctctcttccacctactcccccgtttttccccaaaaacaggcgccggtttggcccccacgatcctacgatgcctcgccacttcaccggtcgttgccgccccactcggccacggttccccctccacgagtgtatataaacaattcctggagcatcctctctcgttttcccatttcgcccgaacccgccacactccccctcgctctccccacgccgttccccatcgccgccgcccgccggcgctctccagccgcgcgcctcagtcgctgccgccgtctccgtgctgcgccgttgccaccgccggctttgccgccgcccgggaaagctcgtccactgctccatttcccctcttcacctccgaagcgccgcagccacgcgaaccacctttttccgccgccgctgccgactccagccgcgtcacgccgccgcttcggtcgacgccgacccgcgccattgcctccctcagctccgcaaggacgaggaggacctcggccgccgcccctcttcgccagaaatccgccgtagctcctccttcctcagtcgccggtgagcgcctcctcatattgtcgtggtcggccatcgttaccggtcaccacgcaccagtcctcccctctctaacccctcctttatgttcctcagatcgaggccgagcccgtccgccccttcccgagcgacgcccgtcgccggagctccgtcgcatcgtcttcctgaggagccccaccgccgccggtccttgcgtcggctgccccttcgccgtcgtgcccctcgttgagcactcccttccctctcccttttcctccccttcgtcggccacctccaaggcgtcctcgcgatgcgctgccgccgccggtggccgtccgaccgggtcactgccgccgccctcagcgcccgcgccgttgccggtggtgccgggcagctggttgccgcctcccccttgccgcaccgcgccgccgctctctcgcgtgcgccgccatcgcccgcgtgagtcgttgccggccgtcgccgcaagtggccgcgccgccgcgagccgtcgctcggccgggccggcctgagccgtgcccgtgccctgccgcgccaccccgtggtcgcccgatcagctcgggctgatctgggccgtcggttcccgtggaccggcggtggaacatcccatggtcctggtccacggtggaccgattcccttgacacgctgacgtgtggggcccgcttgtcggcgccggcctctttgatgacgtcagcgcttaagccttttcctttgtaaaaataattaataattgcgcaataaatcattgataattatagaaaatcatttaatggctcaacaacttctaaaattcatatctaattcattcgaactccgaattgagccgttcaacttgcaaaattcatctaaaattaagctctacatgtttgtttactttttatgtactgtttgcttggtttttattagagttttttctcgttttgtgtgccagcgtgtagaatccgtcgtttcggaagattgcgatcgcaaggggaacgagttcagaagatcaaagtgaagaagcaaagcaagtcacatattccccttgagcatgttgatcccaatttataaatgttttaccgtttgcaaataaatatgcatgttttgctaattacatgggatccgggtgttacctatctactcgcttgtgccatgtttacttgatatctgtcatttgtcaaccatgagtaataaatctcctagcttgtgttacttatgtgaccgagctagaactatatgcttagccatgcttaattaccactagctcagttgatgggataattacagtattagacctttttagtatcagaatgagctgcatgctcgagacatctggccaagcttcatggtcatatttatccaactaaaaaagcgactgaatggtgggctgtgggtgtatggttttgctagtcgcacccatggcgattaaggaccggttcgcgggatgccctggaagaacttatcatacttaccacaagccagcgtgggcaacggctgggcttgtagtgtagctttcctctagctaacgcatccaggtaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagtgggggttatgcgaagggtcctgtcacggcctctttctggtatgtcatggtggcatgtcggcacacggaaacgtgtcgtgggactgtgtcttgtgggtacagttgtacacctctggccagagtaaaactattcgaatagccgtgcccgcggttatgggcggtcgaccaaattcaccgtcattagtcccaccttaataaatcgactcaatgcactgtagttcaggtgggttggttgggcctgttcaacgtggtgtagcgttgataagtggagatttaatgttactttaattacttaattgtttacggttttgctcaataaaatgttttacaactacctttatgcaaatagcctcaagccgtccttgtatccccttgcacgtctgcatcattggtgtggcttgctgagtacagtggttgtactcagccttgctatttccccccctttttcagaagtgtagtgcttctgaactaaagacgaagttagaaaaccaaggctcaaaccccatttcttttccgctgctgctgctttcttttcggtgtgaggactaagtgcctcttctgtaagtatttacgctttatttatgtttggaactgtatattacttgtcgttttgtgtaccctggctggtcctggacagggatttaatacacaaaatagtctggaaatttggggctaaatttctgggcgtgacacccaccacttccaatttcacttgctaattaagataaatataaccgtacaaattttaagtatctacggctaattattctttcaatggtaaacgatgtatttgtcgataacgagacacccatagtgacttcgctaataccaaaatataccgatctagttttttagatgtgcttatagggataagcaagagtggatccaatgtgggtgttgggtcactcgagcccctgtaccacactgaatcaccattgatagaagaagagatggaaggagaagaagagggatatgaggaatagtggggtttgggtgtgggggccgaaggaggaagaaggagatgagtctcacctatatatggctgagttctttacctcacttttccaacttatttctcttgtttttcgcgcgcacgcttttcaaactattaaacagtgtattttttgtaaaaattttccatacgaaaattgctttttaaaatcatattaatccttttttgaaaaaaataactaatagttaattaatcatgcgctaatgccatgtcgttttgcgtgccgcacccctcctcccgaacacagctaatctagttctagatccctatttgaagatagggtgcatgtatgtctgcgtttgaacaacttttctaaaaattttaaaaaaacttggaaaacgaaaaaaaggcctgaaaatggtataggagccatgtttagttaaaaacaaaaattttcacactgtcacatcgaatgtttggacatatgaataaagtattaaatgtagaaaaaaaactaattacacagtttgcgtgtaaattgcgagacgaatcttttaagcctaattgctccacgatttgataatgtggtgctacattaaacatttgctaatgatggattaattaggcttaataaattcgtctcgcagtttacaagcgaaatctataatttgttttgttattagtctacgtttaatacttcaaatgtgtgtccttatatccgaggggcgggcccacctcaattcaagggtattcaaatgaatacccaagatttttagcacaataagaaatacatatgtgagatatatatttcgtatgtatatagagaaataaagaaaatatacgttattgatcgaaagaagtccaacaagaaagcctaacatgctggatccctcaaaatcgaacccaattatgcatggttgtcataatttgtgcattaaccatgttgtaatggcatgacgccaatcgatatatacttggttggtagattgtactgtatatgttttctcacaaagtatatcataataaattaagaaaattgctaaaagccttgtcgcaagttctaattcaataagcagtactaaaatactatactattgatcattcatacctaatattgagctcgtgttgtaaaaattatttttttatcccctttacatttctaataactaatctcaaaatcctgggccgcccttagacgtgacaaccacacacacacacaaattttcgcccaacaaacaaggcccccaacttgccccccaacacgaccggtgagcgtgagtagcagtagcagctcgaaaaaaggacacgagggagggagagggagtttgccagatccggatcccgcaccagatgcgcccgccggcgatgctccgatggcccgccgccgcggcggcgctcgcgctcgtcttcctcctcctaatcgccgccgcgccccccgccgcggccttctacctccccggcgtcgcgcccaacgactttcataaggtccgttcctcctccccctccttcttctggtatggcttccgctcctgcgcttgtggatttcggcgatcccctggtgcagattcggatccttgagtccttgtgctttagccttttcggggttgtccgtacgggccaaat

SEQ ID NO: 26213 - DNA, 2498 bp, Oryza sativa
cactggcacaattggtttctgtgcctgcttgtggttcacgagattgatttactcatctgtgaagattgactaggcgcagagttgctatacatccggcttccaaaagttctgtatgattattgtggagaattgtgagacgaggatcagaatccactctgtattttaccgattttcgagaaaatttatatcgtagttcttagcttataaaccacttgtgttcattcactataaatgagatgatacatctttgatatgaagttatataaggctagttacgattgttagtttcgtatggcagagcatattattctcaattcttatggatctctgtataaattcattttattatatacgggaccgaatactactgttttctgatcattttttacccttccaagatagtatcaccagcagctgctttgctccggtttttctttgggtgagttgaaaagttgccatattgctgtgtgacgtacgtgtaatcagtcagtcagttattgcggtccacccaggggtcaacggtcaaccacgtatgtcgtggccagagaaaaccaatgcagaaggccgtctcctccgtcgccgtcgctgtcgccgccgtccgccggccaactcgtcgttgtcatctcccagcacttccggtatcatatatgagtgaggcttagtgcttctccctcctcaacgtcaccgccggccgactcgccgtcgtacgtgaggctttatggtgcgtggtggcggcggtggccgcgctgctcgccgcgccaccggtcgcagctgtgttcatccacgaattctacaaggtactgaatctgatacgctctacatggtatctgtctcctttggaattgatctgctgaacattaattggtctaatcttctgaattgtttgctttgtttcttgtgttcattttcacagggagatgaggttttggtgaagatgaacgagctgatgtccatcgagactcagatcacctactcgtactactcacttcccttctgtagacctgacaatctaactgaaagtgctccgactctttggcaacttctccatggtgatcgccaacagaggtccccttaccaggttagtcacacactgccacctgccagggttttatcttgggttctatcattttttttttgtctgtgaagatcttggattatcatttttggactgcgaattgatgatccaactttgcgttttcactgtagtttgaaatgagagtgcccaagaagtgccaaattgtctgcagagtgcttgttggagaaaaagaagcgaaggagctgacggagaagatggaagatgagtaccgtgtgaacatgtaaggattgtagaggttagatttacattttctaaaaacaccgcaaagtttgtgagagatttaatgaagttgaattacagggctcttgacaacctcccattaagtattccaatcagaaggatagataaagatgattttttctatcagcatgggtaccatattggtgtaattggccaattctttggagtgggttcatcttctcaaaactctttttttagatgaaagatcattatattgatcttctcaaactctttatttcgctaaaatctttagttaaaaagaccctcatgcataagcatttttccgcaggaggagcataagaggtacttcatccacaatcacttatcatttttggtgaggtacaagagggatatcgacacaagtgcttctacaatagtggcgtttgaggtcaaaccattcaggttttgccaactttgcttcccacattttattcagcatgaatgagtaccatctttaccgttcttctggttaatttccttttgtcccagtgttaagcaccaatatgaagcgcaatggaacggtgcaaactctcgtctgagcacatgtgatgctaatgccaacaggttcatcttatcctctgattctccaccggagattgaagtcggtgaagaaatcatattcacctatgatgttaactttgaggtggctttcatccttcccttttatcatcctttcacctgtaaattgtatcttctccctaaaacagacattaatcagatattaaacctttctctaatgatttatcacatgcttgtgctactgctgttacaggaaagtgatatcaagtgggcttctcgctgggatgcctacctgtcaatgacagatgatcaggctcgctggttttccattgttaactctcctgttaccctgattggtctttctgttgcaatggccatgactatgcttcgaagtctgcatagagatatctttagatacagccaacttgaaacccagaatgaggctcaagtggaaaccgggtggaagcttgttcatggagatgtgttccggcctccatccaaccctgtcttgctctgtgcctatgcagggagtggtgttcaactctttggtactcatcaccgtagccttcgctgcgctgggcttcttttctccatcaaattctgcaggcctgagaaatgttgtgttgctcacctgggtcctgat

SEQ ID NO: 26214 - DNA, 814 bp, Oryza sativa
aagatgagaattcatcagccacagttcctccaaccacaatgtgtgccttggtcctcctctggtccggtatcacgccgcctctcgtgtttcttggaggatatcttgggtacaagagacctgccattgagcctccggtggagatcaacaaaactccacgaaagattcccaagcaagcatggtacatcagccctgtgttctccatcctcattggtagtatctttccatttacaattgttttcattgagctcttctttggcctcatcttcatctggtatcaccaattctaccgtggatttgggttcctcctcatcacgcttgttctactcctcgtcgcctgcgctgaaatctccgttgcgttttgctactatcaactgcgaagcggcaactacaagtggtggtggagatcattccttacaccaggatgttctgcagtctatctcttcttatatgcgacattcttcttcttcgcgaagctgagcattgttaagccagtgtcagtcatgttctactttggatacatgcttgtcgtctcatatgccttcttcctgcttacaggcacaattggtttcttctcttgtttcttcttcacgaggtttatttactcacagagggcatttggatgaacttgagattagaattttggaattggaattagaattctgctgtgattgtaactccagtttgttacagtcacctctgtgtcctggaacaggagagcttgtcaatggcaattccattccagttattccaagtcccagggataattttttttccaagctaaacatgagaatgatagtatagcatgtgtgctact

SEQ ID NO: 26215 - DNA, 8218 bp, Oryza sativa
agtcaatattgtacctcttgtcaaagcaaattacaatgccaaaatcatctctcatccccaaggcattccagaagaaaacctggtgatttcgaatgaggagcagttgcaggcattagagtgctgcatcggagatcttgaggctggagcaggacttctgttcaggagattgatccagaccagggttactctcctcaacattcttagctcatagatactcctcaagatctgacactcttaagaccctgcgattggcatccgtcttttaaaggatttgctgatccttcccatttgtatatgttataggcttactgtacagcaaagaaaatacatgaaaagagacaaagttttgatccaattcttgtcgtgcacttgatcctcgcgtgttgcagagttacatgatgggttatgcaattcaatgtcaatataattgccatggcatatgacttatgaaatatatgggcaagttagcgatattactttcatttcttttatttcttacaggcaaattgatatatgatgcgccatagggctatgaaaaatggccatgtgggtcatgccagtctgatgccgtttgttgcctcactagcaagcaactgatccatgtaaagtggatcttgctgctgcaggtaaaacaggccagctccaatacacaaggttaagcgtgtaagcggcatggattgtacacaatagaacacttgttgaaattaacaaaagcattaaaaaatagataacacacttggcaataataatactctggtaacactttattaaaataatcccttgataacatgcaataatgccaaaatccaccggtagactgaacaaacctgctggcttttgctgccaatagttgggacatgacaatgtgatagctgacttggaagatagacgcagtgcattaaaatattgagcatacaagactatatgctgcagccagatctcaaaccatgatagatagcatcgggaggtgaactggcaggattctgtttgtctaccatccaattgatgctgtgtgttgcacatctctgtataaataggcctcagcacaaagctagaaacatcaaaccaaaacttccctctctttctcatctctcagactcaatagggagacagagttctagcgacagaaatggctttccgccagagatcaattagtttgccttctaggcctcactctaaggttgaagaggagctgtgcatcctagatgcatgcatctcttcaccctccacgacccttgatacaatgtgtgagggtttgaggaggcttgccaacatctatagctctattgaggagatcatgtgccttcctagcaaccaagctttctcctcccaacgaagaaaattgttggatggagaaatggaatgctcccttgagctattggatctatgcaacgtgatgcatgaggacttcacagagttgaaggccatcattcaagatatgcaagtggccctgagaaaaggagatgatgcagctgttcaatccaagacccaatcatactaccgcttgttgaagaaggcaaagaaacatttcaagactgcaaagaaggttacttatgaaaaggaggattgcaggatggccaggctattgagggaggctagagatatatcaacctctatgctggagtccacactgcatctcctgtcaaagcaaatcgaaatgcccaaacaatcacttgtttccaaggcattcaacaagaagaaagtagttatttgcgaggaggagcaattgcaggtgttagagtgcagcatcagagatcttgagagcggagcaggacatctgttcaggaaattggtccagagcagagtttctctcctcaacattcttagctcatagatactccagaatcttcactcgacacccagcgattggcatccgccttttaaaggatctgctgatctttcacattgtatatatataagtagaaatgtacagaaaactccatacataatagtgaacaaaagttttggccaaactcagtgtcatgaaaatccttgcatgcttctgatttcaacctctatgcgattatccatgtcagtactgttgcccttgtgcagttgtgctttgctccgaacatagtctgcaaaagaaaagacagcatgtgatctgtgaaatacgtgcggaattatttgatgacgccaacaaaaaaaaaatgttcgatgaatgcagaatcacaaggaattatccattggccctgaacattcgcttgtctactcaggtctcaacaggatggccgcgaaggattcggctgggaacgcaaggcattgcgaagataccgcagataccgtgtgctattgagttagggttagtgggatacctccgccagaactgatggagacctccgcgatcttgtcgggggctgccttccagggcgggggtagcggcgggaagggtggtcgcggcctcaccggcagccggcggcgagcggcgcatctcctcgctcctcttcttcttctccggtggggggtggtggcgagtggtgagacgaagacacgtggattggggaacgagtggggtactgagtggattcatgggcttcctgtgggccggatggtctcgctatccttcagtttggcccatgaaactacattgccaacaacaattctttttctgtaaaaatttgaacaactctgcatagttagaaaactatttatatcttgtagtatactcttatatagggtctgtttagattggtgtcgaaataaactttaccaaaattttagcaaattgtcaacattgccaaagttttggtagaattggcttattaatgttgccaaaattatatacacattgtcaatatttggtaacaaactaaacgtagctacataattgtcaattttaccaaataatgctatggttggaaatgtcatcaatctgaacatgcccatagatatggttgaaggggtggagtcatttgcagccccattgtttctcttattcatatgcttatccgaatcgcttatttttaaggaaaattgttatatacgtgtccttagcgatttaaaaacaaatgttgtgaaataaactacgatgaaaaaaacaaacaaatcaaattcaaaatttagttctaaaattcaaattttataatcataagtcaaacaatactccctccgtttcacaatgtaagttattctagcatttctcacattcatattgatgttaatgaatctagatagatatatgtctagattcattagtatcaatatgaatgtaggaaatgctagaatgacttacattgtgaaacggaggaagtaagacatttgaagtcggcgcggctataaatatagatttttctttctttttgcattgtaaagcgcttctttttttcatgttcagaattaagggtttacttaagtacatcattaatcaagtcttaaaagcaaatgcaggaaacaattaataattttgttcctatcatttgatttattattaaatatacttttatgtatacatatagttttacacatttcacaaaagtttttaaataagacgaacggtcaaacatgtttaaaaaagtcaacggtatcaaacatttaggggaaaaaacatttagggaaaaggagggagtagatcaaaatagcgtactaatgttcctgaacgaacgcgaggacaagcgagttggtttgcaacttcgcattatcgcatattagacgcccttgtggattatttgcggacgattaataaaaaaaaagttagcaaacatgacagcccgataagcttagttattgttcaacacacggatcatctcgagattgaggtgaaacaaaccagccatgcgcacgaaggcaattatggatggaatcatcgtgtagtaatacagaaagcgtaagccaaccaaatacactgcgatatctgcttccaacggacagatagatgggagcgtatcctatgcacacagaccctcgcatgtacacaccgtgtacagcaactaaaaattatcacaaaaaattaatacatgtactttcaatagtattacatctacgtgcaaagtcacatcttcaaattcattctacatagagaataacaaaaaagataaaattctgacaaaattgcaaccttaaaacaatcagattttttgtttttttgttacggctaaaatataatgaatttaacgttaagattttaaccctaggtgtaatacaattgaaagtatgtgtatgattttttctaaattttttattgacattttttagttggtgtgcacgtgtgtacacgtgagggcctgtgtgtataggatatgtttccaagatagatatgcacacgaggcaaagtcaaactctttgcacggttgcaacagcaaccacagctcatctcttctcactgcattgcattggcattgcttgctcatcacagatctcacacgatctggacctggcattaaactgaagtttcacgcgctcgtgcagatgagtgtttgtctccagtttcaggtgagacatgacagctagtcatctactagtattatctcacaagttcattcaatcagtagagatgctgcctcttgcatcgagcaaagcatataatgatagagattaaagaaacagaaacctgttgcttctgtagttctgttgcagcacaagtgatcgtcaattatcaatgagattctttctgtctgctggtccagcaatgagacctgcttctccttccttggttatatatacagagaagccatggtttggtgtcgacaacattgcgaagcagtcttgagttatctcctcttctcttccaattccagagagaaacaagtcatcagcttccatcccagccatggcattccacctcagatccgcgagtgcgccttccagccctcgctctgccaaaaccgacgtcgaagaacagctgcagagcctcgaggagatcgtctcctcaccctctgcaacaattgaaacaatgtgcaatggtttcaggagacttacagatgtgtacagctgcatggatgagatgatgtgcttgcccagcttcaggcttcagcagaggagagctgtggagcaagagctggagcggtctctcgccttgcttgacctctgcaacgccatgcaagagagcttctctgagctcaaggcgagcacccaggagatgcagttggccatcaagaggggtgatgatgcagcagttcagtccaaggttcaggcttacacccgcctgaccaagaaggcgcagaaacagttcaagaagatcaacaagaagtctgcttcagaagaccaggagggttgcagggtggtcaagctgctggctgatgccagagagatcgctctctcggtgcttgaatcaactttgcacctcctgtcaaagcagattgcgatgccaagtcaaagcaagtggtctcttgtctccaaggcattccagaagacaagggttacatgccaggaggagcaattacaggcgttggagttggacatcgttgatcttgagagcggagttgagactttgttcaggagattgatccagagcagagtttctcttttgaatgctcttagcttgtagatagatcatacaccaactctgatcccctgtgattggcgtccgccttttagaggatttgctgatcattgaaacaatttttggatgtatagtagtgtacataaatgagaggaaatgtacagaattcactcgaatgaaaaacaaaggatttttccttctgtcttatttcactgtcttacttcccttttcccctcaatcgacatggatggcaggtgaacaatcatctatcattttgaatacttcagctgaagcttgttcaagagggcacatagcaatttaatcagaattttcttcatctatcttggttgttataataaagaaattagtataattgcactgttcaaatattttattcgcaaagcttttaccgtgagatggacacgtcattgctattcacatgagatgtgcctcaagaacaggcgcaagaccctttttcaatggatattgccatgcatataattgatagcagcatgacagattgccagttagccggctgatatagttcttgataaattgttccgcaagaagatggtggatattgccatgcatataattgatagcagcatgacagattgccagttagccggctgatatagttcttgataaattgttccgcaagaagatggagtagcacagatggcaagttggaaacaacacaactcgattagcattctccattaaagaagtgctgcagcatgcatgtatgacaaggctctgcactatgactacgagttagctgccatgctgattcctgctggcaataacacactatgatatctgcgaccagcaacagatgacacatgatgtcaagtcaactcctcctttgcacggttgcaacagcaaaaacagctcatctcctctcactgcactgcattgctttactcaccaatctcacgatatggatctgatattaaactaaactgacacgctcgtgcagatgagtttgtctccagtttctggccagcgaggcatgatagccacctcaatgcaagctcaattagagaagagatgctttgtgcattgagcaaagcatacaaatattaaagaaacagaaacctgtcgtgcagatggtggcttctgttgcagcacaaggcttcgccaattattagagagattctttctgtctgctggtccagtaatgagactgctctccctccttcgttatatatagagaagccatggtttgctgttgacaacattgccaagcagtctgttctcttccatttctagagagaaacgagtcatcagcttccatcccaaccatggtattccacctcagatccgcgagcgtgccttccagcccttgctccaatgaaaccaacatcgaagaacagctggcgagcctcagggagatcatctgttcaccctctgcaaccatggaaacaatgtgcaatggtttcaggaggcttacagatgtgtacagctgcatggatgagatcatgtgcttgcccagcagccaagctagcctttgcaagcatcagcagaggagagaagtggagaaagagctggagcggtctctcaccttgcttgacctctgcaacgccatgcaagagagcttctctgagctcaaggcaaccacccaggagatgcagttggccatcaagagaggagaagatgcagcagttcagaccaatgttcagtcttacacccgcctgaccaagaaggcacataaacagtgcaagaagatcaacaagaagcctgctagttcagctgatcaggagagctgcagggtggtcaagctgatggctgatgccagagagatcactttctcagtgcttgaatcaactttgcatctcctgtcaaagcagattgcggtgccgagttccagcaagtggtctcttaaggcattccagaagacaagggttacatgccaggaggagcaattacaggtgttggagttggacatcgttgatcttcagagcggagttgagactttgttcaggagattgatccagagcagagtttctcttttgaatgctcttagcttgtgatagatcatacaccaactctaatcccctgtgattggcatccgccttttcgaggatttgctgatcattgaatcaattttgtcatgtgtacataaatgagaggaaatgtacagaaatttatgcgattgaaaaacaaaggatttattccttttgtttaatttcactgtcttccttttccccctcattccacatggatgtcaactgaacaatcacctgacattttgagttcttcagatgaaacttgttcacgaaaggaaatagtaacttaataagaattttcttcatcgatcttggctgttataatatagagatcagtagtaatgcagagttcaaatattagatttacaaagctttaccgtgagatgcccatgtaattactattcacatgtgacgtgcctcaagtacaggcacaagatccttctgcagtggatcttgccttgcatatagcaccatgacagattgccagctcgtacggttgttgataaattattctgcaatcagatgggcagcacagatggcaagttgcaataacactactcgattagcaatctccattggataaatgctggagcttgcacgtatgacaaaggctcaacgctagagtaagctgccatgctgattcctgctgccaataactggaacatgacattgtgattcagttaggcggcctaattgaccagaaatttggacagcacgtggaatcatcttgagattgcaacagatgctaaatgctgtgagcacagcaggcaag

SEQ ID NO: 26216 - DNA, 1946 bp, Oryza sativa
ttcatttggaatataaaatgtgcggtacactatttgaggctagaaagctttgctgcttatggctcctttgaggatttgaaattgatctgttgcaacacaaatctaggacattaacacacaaaatttatggtattaagtagcaagattgtatttatcactggatgtcatggcctcatttgtttcctcttcataggtaagccaggtaggccttctccaaaggtccaaggaaatttcatgtgcatctctttctttaattgttatgcaatttttattgtttgtcatagtacagattaaaaacaataattcatctttagtctatcccaagataatacaatacattctggttcactagtcatgctaaaacgcgtgattatagaaaagcagaagctgactgtgaattcatgaatttaggtctgatctacacaaactccaggtctttgatagttgaatagttgagatcctatatacatgacctgatagttcaatagttgggattctgtagacataacctaatagcatgcacttcttgcacataccacaacaacagatatacaagaaaatttgtattcactcatctgtgttttgaagcacagatctgcatcagaaaatatatccataggtttgtagatatccttcttgtcaaaagaatatgtcagtttgcttggactgtgccttgagatccttcaatttttttaaaatgttagtgaagtaatcttgcaaatacttctctaaggtgagaatatcctttgaatctaccccaagaagctggtatgtatcattcattggaactgagaaaattgtgtcactggagaggacctgaattataacaattaaatactagttattaattttcataagccttgacaattttataattactgaaaaatcaagtgcactatttagataagtctagagtgtaacctctgagaatgccagtctgtcagccacatcatttgtccactggaagaaccgtgtcaactgacgagtaaatctcaacactgcaacagggacagtagtaacgttggcatcttggccagccaaccgctcacacagtgtaatcacctgagtaaaaaaacaatacaatagttgagtaaatgatagtattccaactctcagaagccatcatttggtacattctgacattgaaaacgaaattaagagcaggaaatacaagattagtactcccatctcttgaagaattcatgacattttggacaacaatatagtctccacatgcaactttgacctttacatttatatgaatatgcttgtgaacataaattagtatattgcaattttttccattgaacacgcagaagagctctgtgctatttcattaagaataaataatatagtactacaaggggagggttaggggttaaaagcccttcctatccccaaaatataccacataaacacacacacacactggaaaactaaaacagatgcgccacagaaaattccagcaaaaattttcatgacaggctttcatggaagccaaatatgtacatatgacaagcctaataccatttgatatgttggtggacaaagataaggaagttcagctgcacattttgcaaaacgacatatatttctgacagagggagtatatttccagtcaagaataaacatgctgtgcaatttattcatggaaaccaaatatgtatttacatccttaaaaaaagaattgacgtcattagaacagtgtacagtatactacctcttgagttgtccaggcacgtggtccggcaaaagttaagagcttcttgctagccttctcattccgcatggcaataaacgtcagtcgagcaacgtcctacaatcacacgagggatgttgtatcaaaggaagggactttgaagagataatgttacaaataggtcacatattcatctttcaatggagaaggagaaagataaacctgggtatccatgtaagcaatccgg

SEQ ID NO: 26217 - DNA, 5108 bp, Oryza sativa
aacggatgatgagataatccaggccggcatcctgaataaacttctctgtacaatgcttgatttccatcaagggaacctccgggtgcttgtcacagttatgaatagagtagaacacatacttttgaattcccatggccttagcacattgtattagagcaacctttccttcccaatctacctaaatagaacaactattagcaaaacggaaaccaaattcactcaacgactctacagcatatatgtcacaggactcacagtataaggactacatcacaattacgtgatatattaaaagcaatgtgattagctttagtcacgactcaacaatagtgcaaatacacttcagcaagaatcaacttcaggacaggaatacagaagtatcacattatgcttaaagaaatgctaacaacataccgtccgaatgggctcttcgggacgccctgtagcacaatcgatgacggtatgaataccaacaagcgtcgcgggaatggtctctggcttgctgagatcggcctaaatcagcaaacagaaatgggcatgaggcggataaacattgaacagtgaggttgatatagcagcaaggaaaacagtggaaacctacattgaccacagtggcgccccagtcgcggaggaaatcggccggcgccgggcggggcctgacgaggcagcgcacgtcgtagccctcgtccagcgcccgcctgaccacctgccgtcccagcgtcccggtggcgccgaccaccaggatgctggtcggcctgacgggcgtgccctgcgcaatgctggtcgggaccgccgtctgcgcgttgcaggtcaccaccagcctgcagcctggagaaccccccaaacttcgtttacctcacacgatcatccgcaactgcaggcgaggggaaggcggaaacgggataggtattgtacctttgggcggtgcgcggaggagggggtggtggtggtggcgcggccgcgcggtagcggaccgggagagggcggcgcggcgggcgggggaggcgagctgcgagggcagcgcggcgaggctggtcgacgacgccatttgcgcgcgcgagagagagagcgtggagaagtggcggcgtgggtcgtcggggttgggtttttggttggggggagaggcgggcgaggagtggcggagaggggatgcggagtagccgatggccgtcgcgccacgtctaccgccatcccgtcatccgttctgtccacgtcaccctcctgtttcctctgtctctcttttttttttcttcaccgcagacgtggactctgtgcaggaatgctaattggggcgcacgcgccggcccacacggcccaatagacggcaagacacggttattttttttttccgaatttttccatatatgtgtaaactttcaacccagatttgaatacttttaactctaacttgaaaactttcaacttcaacttgaaatctttcaacttcgacttgaaaactttcaactcatatttgaaaactttcaactcagatttaaaaaattttaacttgagattcaaaaacttttaactcagattcgaaaactttcaactcgagatttaaaaactttcaattacagatttgaaaatttttaagttaagatttgaaaaaatatgaaaactttcgactcagatttaaaaactttcaactcaaaattcgaaaacttttgactccgattcgaaaactttcaactcaaatttgaaaacttacaactcagattcaaaaactttcaactcgagatttgaatactttcaaatcaaatttaaaaattttcaagttaagatttaaaaactttcaactcaaaacattttataaaaaaataagtgtgctaaagattaaaaaaagtaataagaaagaaaacgaaaaaaaccgaaaacaatcgcaaaagaaaaagaaaaaacaaatcgcgaaaaaaaagggctgatgggccttaggccgggagcagctggtgcgcgcgccaactagcaacccccgactctgggctggtttggtttgtggcctaaattaggcttaccaatttttggcaatttcaatagtgtttagtgtctatttggtttgaagccaaattttggcatgcctaagaaaataggccatttcaatagtgaacttaggctattttggcttcaatccaaacacaactttgccttaccaaaattagtcatgccaaaacttgccaaattttggtactaataaaatttggtaaggcctatttagaccacaaaccaaaccaaccctctgcttccttttttttaaccgtttttatacggaatacgtggacaaacagtttacagttagacggagtcattagagcacccgcgatggtaaagtaaagtgttctctataaaacatgtacatctcagcaatatactagattaatagtaaaccacctcaatagtatgtctacatgggtatctatagctctctcatgcattgcctcgtttttctctatagactatctctatgttagtagatagcttcgctctctctctcttcatttaatatcttccaagtagaaaaatatgctgacatggatctcttgtagagagcttatagataatcattgcgggtgccttagtatccaagtaatatacaggtggctatattacatttgcgatgacaaaattaatgagttagagaagaaatgggtgaagggagagtgagtaggtcacttaaataatcatcggtttctacagcactcaaagacacttaaaggctagataaaacgcatcaggtcagcttttattgacccatgtgatgtagagatactgagatagtggtgacatcattgcacaaacaacaatattgcctcctttgggacaacaaacatgagagtgtatgcatcacgccaagagttacccaatgttgtacattgtttgttctgtttttcatggttgtcatcaacaatgttctcatttgtagcgggtccatgtcagtaaccgtgcataggcgcgcgcgcttgaattggcaatagaatagtcgctcgcttctctctctctagtccttctcttcttacataagcaggctattatcttgcttactctaaagtgacggtgcttgatatagagtagtggtggtactctgtttttagactttgcaataatactctctgtcaataatgatcagcggcggagctagggcccggcgaccctgggcacttgcccgggcttcggcgccgcaagcatcatttgattagtgctaatttatggtgcttagccacggcatgaagcagtataagcacactatttggttgggacacttaataacgtgtataagtattagagaacatacttagccacagcatacaataactagcatgctgcatgcagtagtataagtacgttttaataatctgttagacataatcatctagggtataacctgaagcaccagaattatttactagctagattgttgtacccattacttgagtgtaagctattagacatctgcaacctgaaagcaaagtaaattttctagcaccattataatttttctcttttcgggataataaattactaagtcccatagcctgcaaaaacacaaccatgttttcctctaaattagaatagataaaaaagttgttgtatggtacacaatctatgaagttatgtgtgatttgttatatatccgttggcgtaacaggctcacacaaatttctagatccgcattggcactgataatgattctggacgtcgtccactcgttctaaccttgagaaagcccggactcctctcacctgctgctttcttctcataaagaacaagtgctgaaattttgagaaggaaatgtgtgacacctcgaaaatcgaaataattgatggaaaaaagttttgaaaagctagagctagcaagctgttggccgatatatctttgatggtcgatggctgttgggtttgtgggcttgtgctaggcgtcccagctactcaggctgtaaggggtttccggcctatgtgcggcccatattgcatgggccgcaagtccggaacggactgtaacttccttgcgggcccacactaggcgatcgtagatgggccgggccgtattggggagccgaatcctatttgaacggcctacctacctttcccaacgctcacgtctaaccaaatcttttccgcttcgcatacgtagaaaacgtaaaccattgaccatatcggacacggtctcaagaagttcgtttccatgtgtacgaaacgtattctttttctcgataagaagtgtagaaggcgccaggtcgccgtagtctcgctcgtctccgtgcattccgcgatctccgtgcccgtcgaccaccgtggtgctcgccggcgacggacggagcgagaatgcagggcggatctagcggcatcgtctacggcggcctcaagtaccaggcaagccttctcgaaccttctagaacagtctcccgtaggggggcgcccctcacccttgcaccccactcttgcaggcgcggtgcatcgccgacgtgcgcgcggccgccgggtcgaccaccttcctcgccggaaccctcagtctcaaggaggagaacgaggtgcgtctcctggaggagggggggagggctctccgccccaactcgtcttcttccatcgactctggctctgccctgtgtgttgcagcaattcgagcaattgtagaagagaacgttgtgattggatctctaactcgttgttgctgccaagtaggtgcacctgatccggttttcaccggcggagagcgagctggtgtgcgacgggctgttctaccatccaaacgagatctgggaccttaagtcttgccccttcgatcatagggtcttctccacagtctacacgtctggtaaagaaagaattcccctctttgttactctctttctgccggtgcattgggcatttcatctagttgtaaatttctaaaaatttctttatgttatgatatggatggaaggcgagggctatggtgcatctgtttggaagatcccggagctgcacgggcagtcgaattcgccgccacttgagcagcttttcacgcttgatgagcacacgggcaaaataagatggtgcgcgctcttgtttctgttgatgttctgtgctcgcttgttctggtgccgtttagtcttattgctgtagagtattttgccg

SEQ ID NO: 26218 - DNA, 10648 bp, Oryza sativa
aattttaatatttttatttaccaataccatttgtgatctaaagttttagataagttatgacctttcttcacagtcttataacaatgtataagctcctttaatacattgttatttctggtggataccatgctcagactgtatctgtaagctggcttatctttgcagtgttctctggtggccactagggaagcacgacaagttaattagtattgatgacagaaatattttcctctggaatatagatgcatcaaataagtcagccaaggtgtgcccagcatccttctgttttaccaatagtacatcgacataattacgtgatattacattgtttctaagcattatcttcgcacttcagtgtcaactttatggaaacttacagttctgtatctctgttagcagaagttctgaacttaatcttgtcctaacttgaattcctaagttacaggtgatgcaaaaggggtctgctgacatgcttcccaatttacgtggtggatcttgggatccacacgatcacaattcaattgctgcaattactgattcctcacttcactgctgggatctccgttctatgaagttaataccttcacaatcttgacatattagatttgttgatctagtgtctgtggtttagatgctgaaatgttccacttatatctttatctgtgaacttgttcttttcaggaaatcaaatgcaattgagcatgcgcattttcgggatgtggattataaccccaagaaacagcacttaattgtgagtggtgatacttgccgtacttcatttcaagtgtttcagatcaagccatagttcgtttgcttaagtcatggttatgaattagtactgaagagaaaaacactgttgtattacttccgttttctttgttacctgtcaacttcgtttcgtctttgttttgattaaggatcctgcagagattatttttcttacattagtaggtactgtgtggtatcagctgtgccgctacttgctagccgttacttcttttattgttcaatgaaactaaacactcggatttgattgtgttatctagctgaatcattgaaccctatttcagaggttgttgaatcagacaattgtgcaattaacggttatagtgataggtactgtttatttttattcagtttaatttatttatggttccaataaaagatcctttatgcattgtagacaacagcagaagatgaatttggtatccgtttgtgggatctcagaatgcttaagtatcctctgaagaatctccctgggcattcgcattggtatatttctatatcctgttttactcagattagaatcctttcgattcaatgtttagttagtcgacccttgtgaattttgcaggacatgggctgttcggcacaatcctgagcatgaccagttgattctggtctctccctctctctctatttcttcaagtggtttgcatattgtgatgtactgttttattgtgtactgactacattgtaactcctgtagagtgctggaacagattcaactgtcaatttgtggtttgctaaagttggcactgatgactcaggacctgaaaggtttctattccttgtgtattttcttgtttggttactttgtttgttataatcttgatgcccacattcttgcttatcagtcctcctggttcacccacaagagaagaagaaccattactaaattcatacactgattatgaagatagcatatacggtaccctcaggaattcctacctgtgtttataattctacgttataattttgacaaggaatcacacagcgtattaaaaaattgtaggtattgcatggagctcccatgatccgtcattatttgcttctttatcttatgacggaagggtaagtacctgcagcatttgtatgcttatttgaaatatttgtcttgtgattttttaaagccagtttatctgatatctgaatcttgactctaatgatctgtgataatttcctctaatggtcaggttgttttagaatcagtcaagccctacttgcagagaaaatgaagctgcatgttctctccgttgtaagggcacataactccacttctttgctcggtatgttgttgatgcgattaccaatagtaccttctcttgttctaacagaccttcccttttctgctcaagcagacttgtttgttgtgcatattattggtgttgtagattttctccttgccatcctatatactgtactctggtacatggagttgatgcgatggcctgattcgacagcttgtgaccccagaacaatagcaagccaataatgtttcagtaaccatcttggcagaaatccagtgtctcatatgatctgccactcttgtgattcaggccagctgtaattgcaaaattcagcctggtacaattgccaaatactgctcctcgagtgattcttgaatgtcatatatctgagaaaggttggtgtcaattgttgcgttatgtggtgaagtacaaccgatctgaattttgtagaactgttgagattgacaagatctgagcttctgtttttcattcgatttttcactgtatgagtggttcccttactttagcaaagattaatatttcgtctgtatgttacaaaatcattcagggaatgagcaaattaacttcaaattgttttgggcatgagccacctacgaacttgtcatgcgttcaggacggcaggctcacatgctttcagcatttctttttcgcgaagattttgtcgacagtttctttttaaatcatatgtgttcgctgataccccctccgtttcaaaatatttgactccgttgatttttttagcacatgtttgaccgttcgtcttattaaaaaaatttgtgaaatatgtaaaactatatgtatatatgaaagtatatttaacaataaatcaaatgatatgaaaataataaataattacttaatttttttaataagacgaatggtcaaacacgtactaaaaaatcattttgaaacgaagggataaatttgtcttagaaaatgatcaaccttttttaatgaaaaaaaacaaatcaacattttgcttgttttttttagtctggtcccatctgtcgccaaaatcctgaacggattgggatatcgggacaggaaatgataatgtcaccggagaatgtcaccgaatccctgggtgtcacgggagaatgtcaccaaatcccaatccaacccgaacacacgccgacattcacgtttccttcatgtgtctcaatgatggtagagaaattcgtgcttcaattactccattaaagggcaagttttaaccggaggattacagaaaaatttcgaccaatttgtactagctaatgtgaatacatctcctttacaaatgtacacaaaagtctcaattcctacagaaatcgacaataaatacctgtatccttttttagatgaaatatcttgtattcaaattgcatcgtttaatcgttacagttatatgtgctatgaaaaaaggaaaagaatttgaaaattagtacaaaatttgcaatacggaaatccagtttaatttaatactgcactgccgtacactggaacagtatcaccttctcgaaagttcaaacccactcatcgaaattccacaagtctcccatgtcgccgccgtctcggcgaccaccccaccaccaccgccgccgctgccgtcgcggcactacctccctagcctagcctgagatctccgggctccggaggatggcccagcctctacggcgcggcggcggaggccacaacaagtgcccgcgcccggccctgctgccggcggcggcgctcctgctcttcctcctcgccgccgtcgcgctgctctacgtctccccgccgccgctcatcgatcacccggccctcgcttcctctcgccgccgctcccctcatgcccccctggtggtgttgcactagtaccccttcctacctgctccccacgcttatcccgatctaatttgtcttgctctgtgcattccgagtgcagctgaacagctccggcggcggaagcacggtggtgtccgagcacagcgagatttcgcgcgttccgataagcgtaagcttctttggttagattaagcgaactaattcctcgattaattgtcagaggttgcgtggttgtgctgttcagaaattagtagatacagtgcacttattccagttctagtgcctaactaattgtttctgggaaatggttgttttaattggtagataatgattcaggttccattccctgtgccatttttgaagcaaattagatgatggcaagctattaaattgagctcttttctattatatttacggagttagattaggatgttctagagtattttctaacttgttatcatgggtttatttatttcctttgaaacacaacttgttctcatgggttttctagatgtgatcctctgagatttgagttaaactgattttatttaatgcgctcaagagtcaagacactccctattttgaaatatagacccatgaaatatgtactcattttgctccatttttgtctaaagtagcatgaaaacttcattgcaatttctcatactgcagaaagaggcagatggcctttggggttctaagtttgcgagcagattctatgggtgcagcaactcaagcagcaggttccttggtgcgcattatttttccactgacggttaaaatttgctcgaactgagtagtgttttagatttgtagtgtgcatgtttctgaggcattctacatataggaggttttagtggcagtggtactattctttgttgtatggattacctgaaatagtcaatgttttaaattgtgcaggttcaagtgttatcacgcaaccagaccgttatttgatgatcgttacaagtggaggcctcaatcaacagagaacaggggtaatatatgtgccacactgttccgtatcaaatactgtgatgcgtgtggatggataggaaaaagaataaaagaaatcagtttgcaaatgtacatgaagaatcaacttgtacacatagattttatgtgatccattatgacaccatgttccatgtaactccgtggtagttatgtgtattctgttgttccatatgcataactatgaccatcttctgcttttcagataattgatgctgttgttgctgcacgtatcttaaatgccacacttgttgttcccaaattggatcaaacatctttctggaaagatgcaaggttaatttgagtattgagcgcttcctaccctaatattctaaggctgcccatgtttctatgaacacttacatttgtatgtgtactgtttctctgcagcaatttctctgaaatttttgacgtcgactggttcatctcgaatctatcaaaggatgtaaagattgtgaaagagcttccagagataggaggcaaactgcggactcctcatagaatgcgtgtgccccgaaaatgtactcagagatgttatgtgaaccgtgtgttgcctgcacttcttaagaaacatgtaagtcattgctagcagcatataatcccaagatacttttaaattatgtgctaattcaccgtcttgatgatatgaatttttgagatcaggaatagaaatttcatattcttggtaggtcaattgactgtactttcgttccactgactgaccattgaccaccttgtgtgacttcaaataaatttacttcttctgttcagagacactcataataccaataccaggataccttatatcattactttcacgtagtgcaggttgttcggctgacgaaatttgattatagactagcaaacaggttggacacagatctgcagaagctgagatgcagagtaaactatcatgggttgagatttactggcctaatagaagaaatgggtgaaaaattaatacaaagaatgagagagagaagcaaacattttattgctcttcatttaaggtacacgcatctcaagttctggtgcttgagctctcatattttggttttcctttaatacaaaactagagagtcttatattcttagtgctgtatttgtgaagaacatagtttctttttctcaggggattacttgaaacccattttaggtcataaggggggcaattttcatctctagcttggattagcaaatgttgggctccttagcatgtttcttttatcatgaataccccagttgagcatagcctggatttgagagggaggatgcacaaaataggatgcatgcacaaaatagtgaagggtgatatctaaaagttgtcaaccaatactgtccaaagtagcctttgtgcgggcacatactcatactagtagaacatatatatggagttccgaatggcatgtcaaaagagggtcctcctgtgctccatctatgtattgagaagattggtctcagatcttatcgataatatcagtcaatcacttgttggtcatgctagtaaagagagaaggccatcatatagcatgctcttgtcaggagaagttcagtttagtggattggctgtgacctttgcttcagaatagaccaccatcttggtctgaagttgtactggtttctgattttcttgtatgagtaatataagtatgttgtctatttagtttgtagtggtttccttttttttccttttccctaaacagtctttctcttgggttgccagatttgaacctgatatgcttgcattttcggggtgctattatggtggtggagaaaaagaaagaaaagagcttggtgcaatacggaagagatggaaaaccttgcatgtacgtatggcatatcattatagtgtattagtacgtacttaaaatggcatatatccttgaccgaactacctactgcaacctcttctttgtttaggctatcaaccctgagaaaggaagaaggcaaggtagatgcccattgactcctgaagaggtggggctgatgttgagggcactgggctacagaaatgatgttcacatttatgttgcatctggagagatatatggcggggcaaggacattagcacccctcaaagcgttcttcccaaatctccacacgaaagaaacaatatcaagcaaagaggagctggctccattctctaaatactcatctcgcatggctgcacttgattttattgtatgtgatggaagtgatgcttttgtgactaacaacaatggtaacatggctaaaattttggctgggcgaaggtatacttctcttctgctactggaagctccctgctgtcatcatgtacttcgttattagttctgaccatctatactgcttttgataggagatattttgggcataagagaacgatccggccaaatgctaaaaggctctattccttaatttcgaacagaagaaacatgtcatgggattcattctcctcaagagtgcgcatggttcagaaaggatttatgggagagcccaaggaactcaggccaggaaggggagaatttcatgagaacccttctacctgtatatgtgaaaaaaccgttagcaaaacagtagccaaatctaactcccaatctgagcaagtcttaagtaatgatactgagagaggaatagccattcaaactgagcaagtctcgagtaatgatactgagatgggaatagccactagtgagcccacagttcctgatcatactgatgaagaggcaggtgaatccgaggcagatgaagatgctcctggagagaaagaggagataattgatcctgaagcggatgatgatgtgcagttcagactagaggatccagagttagaagggattctttcagattagttgagttgtcgatgcttcaccaaccaatttttttggtgagcaattgaggaattttgcccctctaacgcctaaactgtacataacttggtttgctctgtcaatgtacatctctaggctagttcatagtgacatttttctgtagttcactcactcacagtgtcacgccggcggttgatctcttagaagctttgagtttgtagtacttgtggtttgcattgatatagcctgtagcatatgctcttgtacctgttattcaactcctttttgtggtgtctaaaatggatgttctattttgacctgtttgcagcaaatgcaactgagcagctttgtttgaaaccagtgaggtcttcttttaactgtatcaaatttatctgtgttgatttcaacctttcatgctatcaactgaattacaatgatacccgcctacctggatcaagtaaaggagtaaagctttgcaaaaagttaccagtttgcaaggaacataactcctgtccgacactaattctcaacattataccactaagtgctgtatttgtgacaaatttgtgctcttgaacattccctggaaaaaaaaccgatctggtggtgggtcctcattcatgaaaaagaagaatgacaacaccttccaatctaactgaatggaacttgcatattactcttgctattgatgaatttgcaggcgttcttcgggatatcgtatggttttgttgttactgaactaacttttctggagtctgtaacctccatggacgtaaataaccggccaaacaaacagaggttagttcaacagttctcttccctctccctgttttaactcattttcttactgccctgtttgatttctgcattgcagatactgtgcttctcacttgtgatcttttcccctaggtgattcttgctcacttttgctcttgcctattgctgcatcaagccctccacgagcatctcatctttctactttcaaggatcagttttttttttacctcccctctgcaattctctgaatctgacgacggagaacgcaattttcttgcaagcagcacatggcaggatagggaacccaaaacttttcatagctggagtacagttcttgattcactatgcaactatccctttctaggaattaggcaattaagtccccgtgaatatctcactagccttgatgcttggtacagtagagagtacagtaggaatcctagctgaagagatgtatcagctgagctcccatcacatgatcactgtgctgaactacctcccctgttccccatacaatctctgatgctttggatttcgctgctcgtgccggtgttcttccgttccaaggacaagaggccaaacgctttcccccaatgcctgccaatatctctatgcttgctccaatgaaagtcttctcttcctgtcgttttctcttttctgaacttgtgttttctcttcctctctgcctcacgggactactagatggtgacacttgggatgctgtggctatcggcatgttccacgtgtcaatgccacagagttcggacatacaccaactagttcatcatctagtagactagtactagtgtcagattctaatgttggcgtactaatctgtgttaaaactcaccttttctcattgatttgaatttttcataagtataggaatacataggacacgattttatgcttttgttttgagctgaaagcctctaaataataagccctttgcatcaaacacccctttttatttgaaggtttgcagcgaacagcttccactgaagaagttgccagatggtggcaaggcacatacttcactcaaaagctccaacaagctgttagttaattaggtcaaatcagttgctgaccccactaaatataagcaaagaaatcaattcttgaagcagtagttatctttgacaccttccttttgctgcaggtctcacctctcaacaagtcaagcctctgaagcttttgatcccttcacctcgcactcgcagcagcagcaggctgtactgaccaaccaccaagaagtatcggcgccattgctgtcctcctccttggcttgaactcaactcaactccagtgcaggcacatgcttgctttccaaaccaagggataaccactcatctaatcaagccaactccacaagcagctggccatccactgattgatcaatccatccatccatcagcttgctcatggggaaacttaggtactactgctgcttctgcattcttctttcttctgttgctactgctgcatctgcactgcatggccatgtccactccacacacttggccggcattgccagtcattgctatactatatatgctgctggtttcctggtttggtggtctcatgctcatgcatgcacacgtccatctgtgttgaattctgaagctgcaagaacctattgccgtgctgcatgggccatccaccggcgacctcaccggccggcgccaccgccggcgtcagcgttaaggtcagcgaccgatatgtaagtgtgctgctgctggtcagctctgcctgcgcatgttcgatcgattcattgttgacatgattgattgaatgattgattggttggcccgcgttgcaccattgcatgcgcatgcaggttgagattaaaaatggcatatttgagcttacgctgtccaaccccgacgggatcgtgaccggcgtccggtataatggtgtggacaacttgatggagattcttaacaaagaagacaacagagggtgcctactgacaattttgcttacgctttttatcctctctttgatatgtttaattagcaagtacaatagtttggtactacttggatcttgccacatcctacaagtgtacatttgttaattgttattcagctactttgccaatttaaaactaaagaaaaaaccttttagtcctcattcaagtacaggctggaactgaggttatggtcaatgtactcatatggtgttgcat

SEQ ID NO: 26219 - DNA, 5727 bp, Oryza sativa
aaaggcaaagctgttcccttgaacattgataagaggtgatccaatagcacaggcataacaatggaattgttctcagcaattcatttggaaaaaaggcaatcatgtttaacagagcaagtaatttttgaaatattttgacagcgcaagtatgtttgtacaggttcattgtactccggggctgctcaggattctatacctatggaatctatgagcatcaggaagggtggcctggttttagcctgggagagaccagggtggccttcaagcttcggaaagacaagttgttctagttcctgaatttaagttttcttttttttttttgcagtttgctgaattatgctacatcttacactgaatgtctgaatccattactttggtgcaaattcaggtttcattacatggcattagctgacgacaggcagagaataatgccgatgcctgaagaccgagtgccgccccggggacagcaattagcataccctgaagctgtccttcttgtggacccaataaatcctgacctaagaggagaggtaagttgacaaatataggattttttttatctatgataaacgtattatatcatgaagaatctaaacactgttactggtaaattgtcaaggttgatgataaataccaatactcctgtgaagaccagtataacaatgtccatggatggatatcattcgatcctccaattggcttctggcagatcactccgagtgacgagttccgaacaggaggtcccgtcaagcagaacttgacctctcatgttgggccaactatgctggctgtaagttcagacattgtattatattgaaataaaaagttcagattattaagttcagacattcttctgaaaccctttttttaaaatatgtttttcagatgtttcttagcggtcattatgctggggatgaccttacacccaagttcttgactggtgaatactggaaaaaggtccatgggcctgtcttcatgtaccttaactccagttgggatggaagtgacccaactctactctgggaggatgcaaaagttcaggtgaaaaattggatgcatatttcgtctctaatttgatatctttcttttattcacaaaagttcaggtgataacattcaggttgattcttattgacagtacaagtgttatgaacacggcacaagtaacttgtaatttaactctctctttctccttttgaaatcagatgatgattgagaaagagagctggccgtactgttttgcactgtcagatgattttcagaagactgagcaaagaggttgtatctctggtagattactcgtccgagacaggtagtaattaatgacatctttttccagttttatacaacagtagtaactaaaagaagtttgattcagtccagatgtaatttagttcgcgatacatctattactaatgaattcatcatgtgttatttaggtatttagatgatgcagatctttatgctacatcagcttatgtaggcttagctctaccaggagatgttggatcctggcaaagagagtgcaaggtgatgcatgctatatacacacttattcttttagaacaagcttgaatacatgttagactatgaagtatattatcaatcacatattccaacaccgtgacccggcaaaaaaaaatatatattccaacactgtagggataccaattctggtgtagggcagaagatgatggaagcttttgcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacggtcccacgatgtgggagatcggaatacctgatcgatccgcctctgaattctttgttccagaccctaatcccaactatgtgaataggttgtatatcaaccatcctgacaggtgatgcagactggctaccaacagacttctcaaacatgtagtaaccaagtgatcatcatttcttatcatatagtgttcttatcgttcgttacagatttaggcagtatggactttgggaaagatatgcagagctgtatccagacggtgatctggtatacacaattggccagagcgactataccaccgattggttctttgctcaagtaaacaggtgatgttttcatctcatttgaatacaactgattgcgcagagttacatgatctgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaacacaaaaatacttagattggccaatgtccattcctatttcattatttgttatcatcattcaagaagttgatcctaaatacacaaaatgcttgtattttcaggttcgtttcaacgatcaggacagaactgctcctcacttcacaactgggttgattgggaaagacaacacgattgcgaggcacgggatccatgggctgtactggctgttcaacatcgatgtgagtggagcttggcttgttcaagggatgaacaccatctacctgaagcagcccaggaaccagagtccatttcagggactgatgtatgactacctgagaatggaaggtccttctggcagctaaggccagtctttagctagtttaaccagcctcacctgtatggctagtatagctgtactatgcctaggtatgcagtacgattatgacccagatattcccatccactaatattctatttagtgtgctttaaagtttaatcttattttaccaaaaaaaatcctgggttttgtctaaccccggatttagcttatctgatttaggttagctggtaaagatgtaagctgccgaaatttcgcagagcatcagaattcagaaaacgattagatatactctaaatcggtgatatgtattggaaaaagaaataacatttccctgctgttttaactctagtgtaacaatttgaaataatctaaattggtgccatgctcttgtttctcagaattaaggtttgcagcaaacagctttcactggagaagttgccagatggtggcaagacacattcttcactcaaaagtcaaaagctccaacaagctgttagttaattaggtcaaatcggttgccaaccccactaactattagcaaagaaatcaattcttgaagcagtagctatctttggcaccttccttttgctgcaggtctcccctctcaacaagtcaagcccctgaagcttttgatcccttcacctcgtactcgcagcagcagcaggctgtactgactactgaccaaccaccagtttcggcgccattgctgtcctcctccttggcttgaactcaactcatcgatcaactccagtgcaggcacatgccaattgctttccaaaccaagggataaccagtcatctaagcaaagctgatgatggattgatcaatcagtggattgccagctgcttgcggagttggaggatgtggtggtgcttgattagggcatggaaaaccaagggataaccactcatctaatcaaagctgatggatggattgatcaatcagtgcattgtcagctgcttgtggagttttggaggatgtggtggtgcttgattagggggagtggattttgatctctcgagagggatgtcccctcgttgtttgtatgtcactcaaatggttatgaaaaagctctaaaaaaattgagaagatgtattaacatgtgatattactccatgaacatgctagttcaaattcaacttctacatctcgcaacgaaaaacaaatttgactgtgaatatacgttaactagctgtagtttaattatttttttttgttgcgagatgtagaagttgaatttgaacttgcatgtttgtggagtgatatatcacatgttgcattttttttaattttttttcataactatttgaatgatatgcaaacaacgaggggatatccccttgaatgatcaaaatagtttccccaggattagggcatggaaaaccaagggataaccactcatctaagcaaagctgatggatggattgatcaatcagtggattgccacttgccagctgcttgtggagttggaggatgtggtacggtggtcactcctacggaacacatttttgcatactggcaaaactgattttcgcatgcggttgctctagccgcatgtgtgaaaaggtttgcgaaaatcggtatttttgcatgtggccagcgcaatctcatgcgaaaatacgattttcgcacgggcacttaagccgaccacatgcaaaaaaaaataatcgccccgccgccgcctgagatcgtcgcagccgccgccaccgctcctgtcgtcgccgtcgccgtcaccagccgccggtagaaccgtcccgcccggatccgccgcctgagaccgccgccgccaccaccgccatcatctgtgccggatcctccggtcgagaccgccgtcgcgatctccgccacgctccagatccgccgcccaccgtcgtcatcgccgtcacatccaccgcccccaccgcacgaggtaggatcctgtagctggatctgccttcgtcgtccggatctgccgctcgccgtcattgtcgttgagggtgccgtcggatccgccacccgccatcgttgtcgtcatcggcactgttggatccgccccccacctccctccgtcgtcgccggtgccagatccatgtggggagggcctgctcccggtcgccgccgtcgttgccggtgctagatccacgcgagcccgctcctcctccggccatcaagcccgccgccgccacccaccccactccacaccgctctcggagtctcggttgctcttgccgtcgaggtgacaaggagagagagagagaggattgagaggagaggaggagaagataagtatcgacgtttgaggtctcgactacggtatttgcatggtgtggagatcgtcggtgtaccagggtatatgcgagactgaagtgaaagaaatggagacaaggatttttatacaggtaataaccctactcctattgaccaaagccggtgttgctctttattcatctggatcacacaagtacaatatttgggataacctatctagctgtcatcgacttggcggcatagataaccaacatgtagtcgacgacaagatagtcttcctcctcgagtacgaactcatcgagatcagagatggcgctagatcccttttgtcggcctccgcaggcaccatattgggtctgtctaggcttatctctgatgtcgatgtctgccggcgtgttggtttgtgtgtcgatctatcgtgtcctctctcccctagtgtcagggttatggataccacatacataatagtagtcgactaaatctcggcaggacccaccacataccatgtcttatacgggaacaatcttcggatataggaggagttctacataaggaaggatgaatagagttctacatgaaaatgacaaggaatactcggattgtatccatattggtttccctagttctacttggacaaggggacacctatgggtataaatacaaggccccctaggaggaaaggggacacg

SEQ ID NO: 26220 - DNA, 5023 bp, Oryza sativa
aaagattaattagccgtaaatacaagaattcgtatcaaatctagaactcgaacctatgtgaattagttctatcataagcaatgtaaccagttaagctacattcacttcgcagtcccataatactccacggaaggtttctaactatatattggaggtgctcatagaattgggagtattctcattctctgaattgaatctaattctcctttgtcggcacttgccacagttaagaattatactgctactgttgattttataatatatacagagtatatcttggaaaagagttggagaaaaggtacttagttactacttcccaagaaaaaaaactatttagctgctgatcgaccgattagcttatttttcttctctaggcagaattgttaatttagtgtgtattttgtttgtgcatgaatgatgttaacataaattatgcaattgcagtttgcagagctgcatgcatgctccgcgacaaggctctaatttaaaattttcaaataaaattccatggaaacaatttcagtgacaacacaaggagaattggtgtcgtaattaattaacaaatgaaattaagatgaaaagcatctagctagccatgcatccttatcacttgcagatgcagatgatggccaccctttctgtaaagagaaagagaaataaagagaaagagaaaaattagagaaagtgaagaagaaaaccggaaggtagaaaggtgaacaccggggcatctattgatctatatcttcgtcatagctagcttggttttgtttagctgactcttaccaaacaacttgcttgcaaaagttaaaacaagctttaaatccaaacaaagcaatgtcccccaaatgcactgttcgtagttcaccactcatcattcactcagccagacagcttaaggatcggaaatggtcaaaattaacttggtcagaaagcaagcaaagtagatcggccatcatcatcagatagtccaatatcgcaatagaccatatccatttatcgatcctttttgaaaataaatttgcagtttatcatatacatagataagttaagagtttgccacctatcaaatactccatttcagcaatatatgtgtcatgttggacttcacgtactccatgttctttttttaatttatttcttgacggatgaataaaagaatgcgtacgcttgctggacggtgtgatttttaaaagaccctctaccgtatatacgaatttcttggaataattaaatgtgcttttcaacttcataatatagttagtccattcatttgtatacttaaatagttaggagtatcataaatcattcaaccattcaatcattcagtataaaaggaagggcagctagttttgtttataacactacattcgcgtaatccacacatctcttaataatatagtacttggatgttgccataacatatactcatacaaacgtgataaagtaaccgcacatattaacgatttaatattggcgccaaaaccacctgataaatactcttgtggtgtttagtattaaattacattgcctattccactttaaaacttaattaattatcgagaattatgaaaccggatggtgtaagtagaagtagattcttttagagctcattcaattcaagaaactcgtaagatgtcttccgagagagggaggaaaagagactaggagagtacgaaatatgctcgtcttgttatacaagatggattttaagataacaaattaaaatccagcctttatatgtaaaggagtgtaggcagccccacgagagacagatggaggatgcagaggatatattgtagctaagccagctcgtggatggggtttactaccatcaccccacgggttaacggtaaccgcaagatatatcgtggtttaaaaaactaaaaaggttacagcatatgataaccatgataacaacatgataaccgtgtggttttgtaaaccctgctcgtagagaatgagaggtgaagacgacgacacatgcaaaagtactccttccgtctcataacataagtgattttggagggatgtaacagattctaggattatgtatctacatagtccaagcctgtccagatgcataatcataagatgtgtcacatcccttaaaaaatcacttatactatagaacggagggagtatatacttgctctgtctcattaaaaaaatacggtacaaatgtaaccagtaataacttacatctggaggggacgtacggagggatctggcacgtgtgtgctgatggagacgacccaggagctgagagctgctgactggccgcatgggatccaactcatcatcactggctggatcttgaccggtcaacaggaagggcccaccacaccaggagtagtagtagagtggtgccacctgatgccgacgagatcccatcgcacattgcgatgcgatgcgatgcagacactgccactcatcactgcacactcatgactttgatctgcaaaattaaagcatgtttcctctcgggagtagtgtagtgtattactccctccatcctataatatagcaatctaggatgaatcttattccatcccagaactacggtggtgtttggatccagagacttaactttagtctctatacttagacactaatttagagtattaaatatagactacttacaaaactaaaaagctaatttgcgagacaaattttttaagcataattaatctataattagagaatatttatggtagcatcacataggctaatcatggattaattagtctcaatagattcatctcgtgaattagtctagggttatagaataagttttatcaatagtctatatttaatatttataattaatgtttaaacatctgatatgacagggatttaaaagttttagtaacatctatctctacgttgccctctcctctcatcgcaacaacaaatcagcagcagcatggccatgccactatgccagacgaccgagcactagatagatactcctacatcggccagagcgcgagagcgacgtgacctgccactactccatgtctctctctagtactaccagtgtagtagtagtacatgcctgcggctagcccaatcttgagctgcaaattttgatcatctcaaactactccctcaataagttcatttttgactcctctcacttatttcaaaatattttttaaaaataataattatatagtagtttatgaaaataggggcgctataccagttgcaggttttaccacgaaccatattggttttccaacaggcctattgctaacagttctattgccaaatatatatatcattaacagcgctctatttaattttcttctcatcttacctctaatatatcaaccggccacccctatttaattttcttctcatcttacctctaataattctctcgtccccaacggacgcggcttccatccatgctccgttgcatcggacggcttcggttatttagcggtgggttcgtctctgtttttatttatttttacctgcaaaatcagcggcggtatttttcgaaagaaaaaaaaaacttcaacagaaaagaagacatatagcagacgataaatcataaaactgctacttagatcggttgcatccttcttctaccaaagatatccaaagtaacctcatatttgaggggaaaccatctagagcatcctctatctgatagttttattataatcacttgaataactgcattcatattgagcatgctgcagaaaatatcctaacctcatgtactgtgataaaatatttaattagttgcttagtgctaattacagtgtcacgaaagcccaaattagcaatcgcttgatcctaacatgtgcttgatcgttagcattgacgatttgaaaaatcgcgttgccgaagagaatcaaagatcttgccaccgttgatcgttgttctagccgattcattttttccttttctccgattatttccatgggagaggaacttggagaaagaaaatgaataggcttgggagaaagaagatgtaggcccatcaccaaaaaatcagagccgtccgataaattgggagtacggatgggagcactgtggaggagcaggcaagccgcgtccgtccccaactatcccttattcaataagatgtcatgcatcaatcctagcactacaacaaaagattcacagttaaaacactcatagatcatcttttcccatggttgacatatcacaccatagctgtgtttagttcgtgtgccaattttttttaagtatatggacacacatttgaagtattaaacgtagactaataacaaaacaaattacaaattccgcatataaacttcgagacgaatttattaagcctaattattaatccggcattagcaaatatttactgtagcaccacgttgttaaatcatggcgtaattaggctcaaaagattcgtctcatgatttacataaaaattgtgcaattgttttttttaaccatatttaatgctccatgtatatgcttaaatatttgatgtgacgaaaatattgaaagtttgaataaaatattttgaatctaaacatggcccatatataaatgagtacttgtagtcctatatggtccgtgaatccgtacgtgatggataatatcgagaccggccgctcttgttgggtcgtcaacgtgtacaggacctgctgcttttgcacggctacacgatcgatcaattcattcgttaccagtcctgcagtgcggacgactgcggagtacgtagtacaattaatatacagtaccaaggtctggtttagttctaaactttttatttaaacttttaattttttcatcacatcaaaacttttctacacatataaactttcaatttttctgtcatatcgttccaattttaaccaaactttcaattttagcgttattcaccccaaagcatcaggcagtccatgcatgagatcataaggagcattactcctcgagatccatctccgtgtggctaatcgcccaaaaagctgaaacgaaccttgcccttactctgtatcagcagcaggctcgaaaacctcgaagaagaagt

SEQ ID NO: 26221 - DNA, 5550 bp, Oryza sativa
  unsure (1)..(5550): unsure at all n locations
gtaatgagcgtaggcgtagccgtgaagcccaatcttcacattctcgagaaaaaaaaaaggtccaatctttgaattttttttttgtctgacacggatgaatacctgacaaatcgccggcctccgtcagcccgtcacagataatgtctggttctgtactgtactaggtaagagatcatcttcacccagcttggtctgcatgcactgaatctgtaaattagtatcgcttaatttggtcgaagtactactactgatgatcgatatgatggtgattagactaataataaagcgtagaacatctcaatccgtcgacaagtctagcttatatacggagtatatcctttaattcagttgtgactcctgtatggctgtatctactgcatatgcatgctcgctagccagtggcaactcgatccaactcgctatcagaaaatgatggctttcgcgtcaaaaaaaaaagagaaaatgatggcttgatgaccatatataataacaaactaattactagttgatccatctcgatcgctatcgatcgaccgtgccatgaccgcaatacagtattagttctagctagctagctgctcctaaatagtcatgagattaatccgctgatagattattttagcttatcgaatctatgagctaaagaaggccgaaccgagattgatatgaatagcttaataatctatcagcatatatttctgtggactttgggcttgaaagactgccttttgcaagggatgggccgtgatggattttatgggttttaagtttgtgtaaactttagctcattaatttatgggccgcctcctgtgacaagataacaggattaagctaataactgggcctttggaccgtggctatataggggccggcctcatggagatggcccacactgctgcagtagcccttgagcttaaattagtctattggcccattggcccagcccaaatgaccctttcatgctcttcttcatggatgaaagtccttagctaaatgaacccaaaggagcttaactattatcttgagcggtgaagcttcatggatcatggatgagttcgaagggtttgtgggtgtctcctaagacatgtctatttttctaaatcatacttttgtaaaaaaaaatagttataattgcatgagtttttttttaacacatacacgcatatgacacttatatatacaccctcacactcacctttgcaaacacacgcgactccaatgaatatctctgacatatcttgttattgatatagtaatttgcgcttaaagaataattagttacgaacacctaatcaaatttccacaaggaagctaatgataggtacgctcatttttgctgcgtgaagttatactattttttatgatcgatccacctaattaatattattagtttttgcatatcatacctttaaatctttacatatattgatgactcgaaatctaaagatttgttgtactattactcgaaatataaagatttggagaataatggaaggatcactcctgctcttgattgtactttccgtgggtgtacaccggtacaccgtacacgtacgtacacgctagctagtctgatgtgtccttttgcgtgtttttgtttctggatgtttttcaacatcatcatgcgaccgaaatgataaggagtgagagtgcgtttagtttccagaaagtttttctcaaaaacattacatcgaatctttaaacacatgtataaagcattaaatatagataaaaacaaaaactatttgtacagttaggggggaaattgcgagacgaatcttttgagcctaattagtctatgattagccataagtgctacagtaatctacatgtgctaatgacggattaattaggctcaaaaaattcgtctcgcggcttccatatgagttatgaaattagttttttcattcgtgtctgaaaatccctccagacatccggtcaaacatccgatgtgacacctaaaaattttcatttcgcgaattaactgggccttactaatttgcattgattgaccgatccaccgatgagaacggtcaggggtgccaaaacatccggaaggaacgaaaagatcgagacaaccaggcaatgacacgtagcgaacactagtagcagcacccattcgatgtgtctagttacttgaaaaaaaagttaaaagtttgaataaagttaggagtttgaagaaaaggttcaaaagtttatatatgtaggatagtttttgatgtgatataatgtgatgaaaagttaggaatagaggtaaactaaacagttcatattctgtacagtttgggtacgtcagtaccttgcgattgtcgcacggatccggggctatcgctacgctcgtgcgtcgcgcacgtcgcgcacgccgcgcacgtgctcggctgctcacgtctacacggagtcgaatctcatccttttacagacacacttatcgcgcctccccactcacgcaccacaactctttcttgagaacagaatattcgcaaaagaaatatcacaattaanngtaaaaggaagccaagatatttatgcttagcgcccatccggcccatactatagtatacactcatcactaacaaagttaagtaggtgctacactgctactaccactaattaagaacacaaattagaacgcgtaatcagcaacacctttcttgacctgcactgcactgaactgaaggaaagctagctaatggcaccacacactagtatttttacaagaaaggcactgtacagttatacagtatttgccacactacccaactccacaccaacaaagcaatatgcagacagacacgtgcaggtggggccgccacccagagacgcctgttccacgtgacaaacttcccaaactacccctgatctgatcgctaattcgctatggtacctcatggcaccccgcgtaattaacccgcaaaaccgagcctcttcgtatacaacctcgaaggcagggcagcggcaggggcagcacatgtcccacgccgcaagggatccctacagggccccaccctccaccaccgcactcaactcaactcgtgtcctttttcacgacgcgcaccgaaacgacactcactggagggtggggaccgccaccaccacgtgtcgccgaccgcctgccacgtgggcagggcgtctcccccgctacgcgcacccaggcgaaacgcacacgccgtttcgcccgccacaccgtcgcgtcggggtcggtaataactaacccgagacagggagagagacgagaccgaccgacgccgcgggcttagtccagtggaaggtgttcgtccactcgcgctcgcactcccgccgttacgcgcgcgcgcgccgccgccgccccgacctcgccgcgcgcgccgacgaacctagatgcggtgatgggaagaaggggcgcgggcgcgggcgctgcggtggtggtggtcgcggccttcgtggcggcggccgtggcgtcgggggacacgctcgccgatctcggcggcgccgccaaggggatcgacagcgtgccaggtgcgtgggcttgagctgttttgcggcgagtggtcctgcgattcgtctctcgttctattctatctctccgttgcgacttgcgatcgatcggtggagtggagtggagtgagcggagggggatcggatgagtagcttaattaggtcgagttcatccgtttcaatccattttgttactgattggagctgtgttttttgggtggatttcaccctgctgttcaggaccactgcgccggtgctacgtttgtcctgtctagtatcagtatgtgcgcttttttgttcagatattactaatttttttcgtcgccgtctgcgaaaccatcagcgtcttagggtgatctcatctcattcgatttctatatcggatatgctctattttgttcggagaatcaagcccaaataaatccggcttttgttttgctcaatttctgcataaaagagcggctattgttccggaggattcggcggtgattgctcgttcgttcgggccatattgcttcccctttactgcgtttgccgggtagatctccttccgtctgttagttgattttttaaaccccgtagttcagggatgctaattttggtgattcgcttccactagtaaaaattctctcatctcgtttggaacaagtcaaacactgggtaccagtatttaattatcatgtcggtgctctaatctgcgacggctacaattcggtctttacttacacgtgaagtcacaaggttcacacgaagcatttcttcctagggagtggtagaactttcatctttctgtgtaaaagcggcactttcgttcactggttcatgcgcaaacagaatctagattttcgtaatttatgcttataaatgtgaagctcgatgctttacttatcgtacaagattacaaccaagtggcaattttcatttgcttcttgccttgtacaagcaagcagaactttgatggtagttatggttaaatattatcagctagtagtattctggactggtactaaacggttgtttttcttccttttttgtgtgaactgctactacagaagtgaataacttgggaccatgggcgaaggggcttctgaaagggatgccggactcggcggcagggccagcagagggccccatcgcaaagtatccgctggttctggcagaggagaggacgcggcggccggatgttcttgaccaccttaggatgtatggaggagggtggaacatcactaacaagcactattgggcggtatgtgttgctatcaagaattcaagacactaaaagttttatactcttgaagctctagtttattagagatgtcatgatatgcaagtagacgatactagtatttatgttggttgttggaatatgatagtatagatcagtacaggctatatatgaactacaaattcagtctggacaatttatttctacttgtccaaatacagtagccagttacaggacaacttatagaccattcatggataaacttacttgattcttttttgtttggttttaaggtatttgtgaaatccccccaaaaaaaatctatgtaaaaacattgagaaatttgcggtagtatgatatgacagtgttgtctcactttctttgaactgtgtaaatactgtttacaaggtaatctaaggagaacaggaaaacactgactctacagtcgaaaaatgtatggcatagtttgaagttaaactggcctatgcctttaattatgattgaactgttatactcttcgttctgcttaatgcccatgttctgcctacatcttagctgaatcaagtttgtttcagtctgtttcattcacaggaattgctgggtttgttcttgctgctgggtggtttatttcgtttggaattgctgtagctgcaagctgcttttggaaatcaagaatagacaaagaaaatgattttcatgcagatatactgcgccttgtgttgcttgtggtcttcatatttactttaacgtaatgtgctaactctctaataatcattttttccttttctttttgagttcatctgattgggatatcgctggtttaaatagagttttctactccatgccactat

SEQ ID NO: 26222 - DNA, 10516 bp, Oryza sativa
catttatgctagcacattattagtaatgctatgccttcaactgaaaatttgaattcctgttttactacaggtcagttgctttgatttgcatagctgcgttgatgcctgttcttgcattcttgggatatggtaagaatttcattctgttagtcaaactgatgccctttttgttggttttgttatctcagatgtgttaacactcactacttgaacaacctattcctcacatttgcagttttggagctgtatggacaaagaagtacagtttatgtgtaagctttgtggccatgtacaaagtactgtgtattagagtgggcatgttagtgcagtaattttttaccacttactttttgaattttacagatttgttaccttatgctggacagtagtggcaactctcttcattcttctagggattttcctgatattgaacaggtattattaggttacgaatagccttctttccatgcgaaataattctaggaggtcttacaattctaattttctccttggtatggaaccatgaatcaaacagaacttcttttaccgtgaatcaggaggtaagcccacagtttcattaattaaaagtataagagctacaaacatatttagtagaaacatttttgtagaactcaacgatgatgaatttgcttgtcggttgatatgtgctatgtgttcatttgaaaagaatgaatttgcttgccatttgatatgtcacccatgttcatatgctatgaaccagcattgatagtatccctcccaaaactaaatatgtttttatgaggttgcaattcactgtttagtattaacaacattataatctttctgcaacagtgctgcaaaggatacctgtgaagcaatggatgaatgggcacaacatcctcaagcagagacagctctcagcaacatccttccatgtgtagatgaaagcacaaccaatcaaaccttgtaccagagtaaacatgttgtggtaattcttgtaggcatagttaatagggctatatctgctctttcaaatcgaaggccacatcataaacatcctgggcagttcatgccttacctgtgttctccctatgatgcgaacctgactgatcggcagtgcaagtctagggaggtcaccttcgataatgcaaccacagtaagttttggcattgttctgttactaatttcacaatttgttggcttcaattgaagtttttctctgatgcatgactcttgctgatctggtttattttaggattactagatggggtcatttgtgaagctttgcttgataacaaaatgatttcttcttttcaggcatggctgaactatacatgcacagttcctgactcagatttgtgctctggccccagaaccataactccagagatatacagtcagcttgttttagctgccaatgtaagctatgctctgtaccattatgcccctctcatgctcaatctccaggactgcaagttcgtccgcaacacattcagctccatcgcttcgcagtactgccctcctatatggcgcgacctcagcttggtctcagcaggcctggctctcattgcctctggcttaacacttggcctcctcttgatgctttttgcggaccgcccccaaagggaggaggtgtccgagctgccatcagggtcaaggatcaccccagtagactgctctccatgacgagctcagtctctatggtcattcagactagtatagcaattgcctgtaatagttaggaaaagaagaaggtgaagcactggggcaaagccccattttgcagtggagatgatctaggtggatgagtgcttccttccgtggtatacatggtatgtttcagggaatagttgtaaaggctaatgcctaatggcaaacaaaatttgggcaaaaccccactatgatatgaagagcaatgttctgtatcccctatgattgttcagctggacatgtttctttcttatgtacatgtcttgttctgtgtgtttccatattctgttggtgggggggacattccttgtacactagatcagcctgatgtctatgctggaggttggaacagattttgcaaccatgtcaattgatgcagttgagcaagcgggaggttttcagaaaaaaaaatgcacaattttcagctctggtcgtaagggttgtacttgcacagcagtaaacttacagcaattctaatgtcctttttttaaaaaataataataataatggttacatcttcggcctctgttagcaggcgcacaaccaaattcggatgtccttttgtcgtaatattactagtatttgcttcattgcttgtgaagaactgaagagaagagaggagtgggtcaacttttccttttcctaatttgattttggttttgggttccaatcttcttggccgttcaatgtcaaaagtaatttggtaaaatttcagttgggaacatcactttagcttgacatacaatcattctatttgtgactatctaggtcctgccctttctctaggatacagacagcaaatccatggaaaggttctccggaaaagcatattcagaaaagatcagacaaaaaggaaaactctccaattcacttcagctccaagctagaacacctttactaccatttttcaccttacctctcctctagttgtgaaaagtatttacatgatctgaattctgacgagcaccatgtctgggttttcacacccgtgtgttgcaagatttcaagttgcagaagttgttggaattctgcatcattgtattagtaaaaaagcttcagcgctgcataattaggattctagttgtagttgtgttggcaggtaaccactttggcttgacgaacgcacttgggtgatgtttgctcacttgctgggaaaccatgatggctctgtttattctgttctgacctgacaagctaccgtgtacagtacacagggctgtgttaccatttttgagcgattttgatcagttaaaattgattaaacttagtttgtatgtaatgatgtgcagtttgtatgtaattagattatcatttttctgattccacagctaatccattagacgatcgatctgcagcagtgtaactaacaacaataaaatagtaaacaagcttgttctgccttttgtgcaacaatgttaacaaacatactcttccgatccgttcagtgttttgtgctggagtggagcttcagtatgaattacgagtccaagatgacccttgtaaaaccagacaaaactcgatggctcgtttgccaacccagctgctgcaaaagtgatactggacgttgacctgcagtgataaaaacgaaattaaaaagaacgtcatatgttgagatatactgctccctccatcccaaaatatttgacgtcgttgactttttaaaaaatgtttgaccgttcgtcttattcaaaaaatttaagtaattattaatttttttcctattatttgatttattgttaaatatacttttacgtctacaaatggttttacatatttcacaaaagtttttgaataagacgagcggtcaaatatgtttaaaaaaatcaacggcgttaaacatttagggaagaggggagtagtataatgcaggttttgattggcttcgatcactgctgactgctgagatgttcggtttcagtacacaatgaagagggcatagcacagatcatgtgtattctgcagtgttttctgattcttcctgattactgatttttcatgcaagagaagaacaatcgatgcaatcccaggctagctgctgctgcttgaacgttttggcttatgatctgtatcttcaatgcagtcagtcttatgttgtccagctacgatgatttatttggccactccattacagggtaaaatatatgctgctaatcagggactgacaatagcaaaggatttcagaatcgtaactggaacaaaagaaaaaaaaaaggagtataaccctgcagctgtagtattctgaagcccgaagatttggacggtgaaaagagtaattcttcttacagttgtgtcggacactggtgcaagttctaatcctaaagatatataccagtttttgaatcctccgctaattaatctccttgtacaattctcatctgaactctgaaatgatatcagtgttggaatcaaggccaaacaacctcttgtaaaaacaagcagaaattcatgatgagacacatctgagttcttcgacgctacagtatcttgtcagagggcgcgggggttgagagattttgacaacttgaccctttgcaaaaactatttttacaaatgaaccgccgccaaaacttatttcaaaactaacccttttgttcagcgctaaatcgtgtggcgctgaatttagacacctcggcgccaaatagcatggcgctgaatgtatgttggcatgctgacttagcctcccatccacggtggtacggcattcagcgccagttgacatggcgctgaggtgttgttaatgaccaaaatttgtaagatataaaccaggttcagtgctggaatcgaagcggattcggcgaggagttagattcgaagaacagagtatgcatcggctggagtctgcatcggctaagatggatcggacagaggacagccgattttcttaaagacggttgtgagactacttctagaatcgatcgacgtgcttaacaaggattgccacgatagagataagctctcaaataagcaattgtatctattaattatgatattttatgtaatttccttagacatatgtttgggcaaaagtctgtcgtaaagattttgtgtatcttagagtttgttagatagaagactcgtgtccggtaaggacatattatgtatctcgggtataaatattacccgaacctttgtaatcagacaacatcggttcaataacactttcggcgcatcgccacccttttttactttcgttctatttcgacgagttcttactttcgggttgagctgcatcaattcgatcttcaactagaggtaaatttgtcatggcggtctgcattctcgggattagtgcttccatctttatgacactctaatcttgttcgtgtaattcgtcgagttatcgtatatactttatagtctctgttagttacactatataacttgcgatcggttggtttttactgttagaaagtacctgatagagttagatctcgttgttaatttagattatatcgtatatctaccatcttttagagatttttattatcttgtttagattttaccgttatctctatgcttaatgctgcatcggttgggttcgatctattaagttctatctataattgtaatatctagcctgttccatgatcatcaatagagatagtgtcggagtttaagccgatcttaactgatttagctattttatctcatatgtttggttgttatgctaaatctgccctttatattaagatcttatcgcattagagtatattaggcttctcgtttaatatattttgcttgttttaatatcttggtataaagttgtatcggagtattaaccgatacatgctggatttatctgatcggctatgctataaacgtttatataattattactttagtatatattttgacttaagtgatttatactgtctcggcatgacgaccgatctatcccaatcacttagtttaaatatgtatcgaagtaaagattatatgttgttaatatttacagccgatcaagtagatttagttctattttattcagtcattatcgccgatcgattataatatgacatcggcaattagccgatcggctatcgtttatagatttaactgcggttttcttgtctttctttcttattgattgtaggatcaaatcaactagcacactctcgaacctaaaagtaagattttggacttaaaagcaagattttgaacctgcacaggagttaagaagatcttctaggccattgtgtgtttttcgcatcaacgggtgtctaatttcaacgccacatgatttggaggatcatttttgaaataagtttttgcggtagttcatttgtaaaattatttttttcaaagggtcaaattgtcaaaaattgtgcccggttcggacttcggagaataatgccccgtaccctgctgagttgacaggaaccgttggatcaagaacgtgcggtcaagatgggtcggaggcggaggccacgcgggggttcggagagttattctccgacccctgttgggctcacggaaaccgttggatcaagatcgtgaggccaaataatcaagcgggcagagtccagcaagcacaatatatctagaaataaagtccatagctttacttaaatcaggattagattatcgttttctgattccacaggcaattcattagccgatcgatctggcatctggcaggcgaacagtggagttccagtatgaatttgcgagtcctcgttgacccttgtaaaatcagaaaaaacttgatgctagtttgccaaaccaactgctgcaaatgatactggacgttgacctgcagtaaaaactaaattaaagagaacagtatcgattgttcagatactacataatgcagggtttgacctgcagccatcctggggcctctagacctcttcctttggagacattcatgggggctgattggattgaatccgtgatgagattcagatcatgtggcagacacgagtgtgtgacatctgctgtgcgttctcatctctgattaattgctgtttctccattcaacagaagaacagtcgatgcaatcccaagctagctgcttcatgaatgatctatccagcgtaagtaacgtagccatcatgtatatgcatgtgaatatatgtaggatgtaatgtattttggcgttcgcttccatataccgtatgtctcccattaccaggatagtagacatactgtggatacaggatgcctgcctcctgcagtataatgtttttatccccagtgtatggctgtatgcacatatgacgtctgacgcttgcctgaattcttcactgcagtcttacgttggtatctgtatgttgttcatcttacgatgatttggccactccattttcagggtatcaatgttgctaatcagggcctgacagtcgcaaagtaattaagagtcgtaccatgtagtactctgaagcctgaagatttgaatagtcaagcgaatacttattacaggtttgtctgaaagaatggggcgctactggtagttctaatccttttctgctgtgcacatcgcccaaaaatctgctgattcgaaagagacgctgatgctatttatacgatgaggctgcatcgtaatgataagcctgcaggcttaaaagggagcacctaatcgatcttcaagcttccatcaaagcaagctgcctaaccatactttactgcatatagtattcatcgtgtcagtgtgtgtagctcaacagtaatacaaccatacgcatgcaaagtgtagtcctcaaagaagaaaaaaaaaaaggctgcggttcaaagctagtaatgcttcagtctgaactgcatgcacacgatggccactgagttagactgttagtttgttatgtgttttggcatgtgtgatatctctctcccgttatctctaccgattatgtttttataagtcggttgaatagataagggaaggatgtctatacatgtactttgcattactgagatcaatctattgcattgagtctatctcgctctcatagacaagtacatacaacatgtcatgttttatggaaacaaaattcaaagcaaaaggacaaaaaaaaaatggcaaagtttaacccataacttcatctacgagactctgcgacgtatttttggttttcattttgtaggatatcaaaggtttggcatgtcagggttaacttcagacaaaatttagttaggctacctagctactgtgtggtcctctccttgtatcaaaagatacttctctatctgtcttacataagatctcatcacaaatttatttattgtgccaaagtgaggactaaacaaaaacaggtgcaacaaattcacactaccatttaaaacttcacacatgctttaataccctttgtttataagaagttaggagaacatcttttattctgacaaaattcagaacttgggggaaaagatgcaaaggtcattactattggtgttcaacaggtgtgtttgttgtgactaagagaattaggcaaatataggtcaacaaagacagatgatgcacacctaatcaactgggtttcatttgcatgattcctgacggaagcacttcagatgtgagacagatcgcttggtttatggggttcaccaacccaactctaaccaaagtaccaaacaaataagtagtgtaaactatactagtttagaaatgggcctctttttgggtcatctccattgaccaaagttgagaaaaatgaatatggtttggcacatttcagacaaaattctgagagagttggtgatggacttgacaagtctgatactacttttttcttagctttcacaaggacatagttattaatttggtccaatagccagtgctcaaatactagagctctacaagagcacaagatgtcaagatgtagtagcttcatataattacattcagcagcagaagacaacatcatctcaccccaagaagaacaagaggaaaagacagtagaagataggcattgccaaaacaatcattcaagatggggaagacctgaaattgaattgtcaattcaaacacctgctggactggtcatcaaattatctttccctcgtttgcttgttgtcaagttgctgtacagtgattctctcaagtagagaaaaggcatgtagatcatctctgtggcagaaaaaggtcgaaatgcaaaagggatttaggtcaaatctttattttgcaaatggtgacataagctgtggctttgaagtgaagtgaaccactgcacactgcctagttggaccagccccaactgtagctaaagacaatttctaaggatatttgttttgttttgaacaaagtattattattgttttatcaagtaaacgtgcattattcaaagagatatagtagtaacgaattattaatctgtagatttttggaacttaactataactccaaaatcttgtatgatattattatatatgtcctatgttctataaagaaacaatttttaaagatgatataatctttagagtctgtttgacatgactccatctccaactccaccttttcttggaattggaccaaacagtttcaactccacctaaaatggaagtaaagctaggtggagcgttctcacaaaatgaactgagaagtagagctgggtttagactgttgcacgattctactctgtacataactcctacaattaaatttaggaggtgaaactctacaaaacggacccttagaattagttttcattttttcttggaataaagagggtattgtataaactctgcctcacagacttgaatttcctatagcaatcgattatttcttctcactaattaggattttaaaaaaaaatcattgcttagtacaacatccagtatcttttttttaaaaaaataagaaaataataagtgcaagagagaatttcgcgcctacttcttcctagtcctaaggaagaggagctaatatacagcacagtggccatcagaggggtagccacgtaattttgacaggctgctcttgcagttagtggtgggccacccacctcacaaggaatccgtattcctctcgagctttgcgttcttgcaagcaggtactccgtatacacagaatctttcatcaggctaatcatcatagcgattaccaagcttggtttacatctcagtaatgtgtggtgtctccaattttttgtttctatcttttggacaggaagatttcagcatgtcgttggagtcgttgtacaggctgaatatctttactgatgagaaacttctgatcagcttgtgccagtaagaagtgtatgcatgtgtagataaatagagattgacttttatcagtttaagataagataacatctgttctagaagaagactactagtagaacatattacaggggcagacggtggcattattgtatcattattgccaagacatgtagtactaatgacttttactagtacaacaggtatgccatgttgcaaggcagcattctgaatacctgaagtaaggctttgtcattagtagtaatagagattatcttttctctactcaattcctagctcaaagcagttaatagtaatagttagtaaacagtaactccactgatttctgagcaccatgtactagaaaagaaaaggagagcctttactacaaagctccagaaaatggagagagcctttgggaaagtgagaaggaatcagggagaggaggctattccaaagaaagaaagaaacatgcaaaagagcagtatcagtgaagttgttgtttggtgatacttattcccctctctctttctttgcctctcttctaatttaaatttgagggaagaaggaggaggagttgaaggtgaggtgagctagagtgttcttccttggcttggcctccattgttacatccccctccactccatctcttgcttcccttaacccctcc

SEQ ID NO: 26223 - DNA, 14279 bp, Oryza sativa
ttgctattaagccgccagaccattggaaacagcaacttcgccttccttctgtgtttcctgcatctcttatctctcttggtgagttcttggttttggctgttgaattgttctcttgtttttctttttaatcttcttggtggtgttttcatggcgtttctttgattcagcactactttcttggtactgtaaaatgctagtagcaaccaccctcttgttctagctctcatcgattagtaaacttgtttcccttccattcgatgaaagccattttcatccaatccatcatgttatgctcagaaaccagaatgtgtaggttttgcctgttcttggtgcaattgctgctcgggccaactttgtccatcggctagcagataattccagttactaagtaactccccatctcttgcggttattatcatcacggagcaatcggttcctgtcagttcttaccaaaatccaaaagtcagcggttgcatttcatccccctcctgcaacacacatacctgacgaactcctccttggattcttggtgttctcctcggccattacactgttttttttttctcttaggagcatagattgtagcaagaattgtttcaggctgcgcagattgcgatgactgaaccatggagtgcgttgtttgcaggattaatgggcgaccatctggcattgcttgtggatcggctgctgacggagtcgacgctggacgcggcaatcaggaagcaggtggccgatctgcaggcggagacggtggcgatcgactactgctgcgacggcgacggcgatggcggctcggcgaggaagatggtggagtgcaggatttgccaagaggaggattgggataccagcatggaggcaccctgtgcttgctgtggcagcctcaaggttatggcttttccttggctttgtgaattgtttattctgtaattctgatttgttaccgttatgaaaaatatatccttttttcagatggaaaatttggtcttttggtctccacttttagtgggagaagataaattagttaattggtgtccatggttttctttgtggtcactttagatttctagttctagaggagtagttcactagttattttagataatagtagttcactagttgacttaggatgaaaattgttgacatttatggttggggttagctgcagtaggttcacttggttgtgtactatcatacatgctaattaagtatgcgaaaaaggtcaatcctggatttaagaaaagttgttatgaaaaatcagctgcatttgcctcgatgtaacttggaagtcactgcctcgtattggccttcctatttgatagtgatgttgctgagaaacaaaacaaaataaggtgttggtgttctttcgaagtaagggaaatggaggaggctatctgtgaccttcaagcaatgagtggggcaactacccacattatctagcaaggtcaaatgtagttgaaagttcagtaaaacattctgaattcggtgctgtttgttgcttcttgttctagcaaatgatactgtaatataatgaatgtatttcagttggttatgcaggtgaatttttgcaagatattaaattcttagcttctcccttgcagtatgcgcaccggaaatgcattcagcgttggtgcaatgagaaaggcgacaccgtttgcgaaatatgtttgcaggtaaaatcatcttggttcaactatgcattctttgtagccttgtggaactgtttatagtacagacaaatgtgtttgatagcgatacgatttgaggacatataaaactgttcaagcatgcatgggctaatcctctgatgtgatatctctttctgcagcaattcaagcctggttatactgccccacagcaactgtttcactatggaagtataccgatgaacttcaggtactctcttggggatcctaagtgataattggttgctgtgcctgactagtcagcatctgtaaattcttacatttttcttctgtttctttccctgatccctctacagaggaaattgggagattgctaggcaagatctccatgattcccagataataacaatggtgccatcggagcgcgacttcatggatggttatgaggactacttacccattaggacgagaagcagcaccctgtgttgccgaacagtcgccataattgtgagattccttgcatctggatagataaatatcctttaatgacaattatctatcacccagttcaatcctggctaattcttgtgtttcctttctgatggaattctgtccctgtgattgaatagttcatgtcactcctggttcttcgccacactcttcctcttatgattggtggggatggggagtactcgttggccttattctcggtaagatcgatgtccaaattgagtttagatcatcactgcaaaaaagaattatcacacttatcttgaagatcaagctcctgactgagtgtctgtacttctgatgggggtaaaagcttcttgtcttgaggaccgccggaatcctatttccaatcttggtcatggtgagagcattggcaaccttccatcgtcgtcgtcgccagcaggtaattccatcactgcatgatctgccattgttggagcctcctcaggtgcagtgaaatgcagtcctaatcctgctcagttagcttgagcaggtctacacctgagcagagtcctccatcttaaccattcatagtatatgctacaatcttccttggctggatcataactctgggatctagatcacttaaccctgcaggaaagacgggaaatgtatatgacttcgtcagacagcgaagaggaggaggattattcagataccgatcctgcacagccaattcattctcagacacgcctggtaccaatctactgacacgatcaagaacgatgccaaaaaaattcaaaaaaagaagaaaaaaagaagaggaaggtgaccatatgtgacatagtaaatgaagatagtttgaagccactcgcttcaaggtgcccttgcaagaatgtagtggctctgtacatatgagaaaggaacagatcgctaactaacccaagatgctgtaacttgagcttctctagtactgcaagcaagttcagctacccactataagtattgaaaaggttgttattattcagattacttgcaaatggaaggaaatacacgtcgttttctggatccatccacttgcatttttcattttacaatcgcaatcattttcgtctataacagtagagccagaatggcaattaggcattccatggctatcatcaactcagatcgtcaacccatgtacgttattgcctgatcgattggtgaattgttgattcagctttcatagcacagagttctgcatatctgatgtaatagtgttgcttgtcacgctttcaaaagagtacatccatcaagaattcaagacataacaaagcaacgttacaactgaataacctatctggcaaagtagactatcacccgaagagaactagggtaaaggggatacacactgggatggcaaagttagggagaaaaagagagagcatacatatatgtttcagctatgcgagaaagcaacggtcgtgatgcaggaactatccacgatggggtacgtttggacatggtcgatgtacttgaacaccgcagtatcactggcctgcgcaccttcggagcccatagcactgagctttctctggttgaagctctctacctcctggaccaactcatccttggttctgctacatgatgtgatgacctaaacacatgtgaaagtagcatcagaggcttgacacattctttgtcctaagccatcttcacatacatggctttcaaatagttactgtaatggtgaaaccatgtagattacacaggattattaaaagttaaacagaacatcatatgtagatattaaattggtaatttccgtaggtagaatatgtaaagcaaatagtttcaccacagtaaactgttcgaattttgttgcaagtgagccaccatgcaacacaaagatatttgggttgaatgtggtggaagtactgaccagtatgccaccaggagaaaccagccctgcaaccgactgccaatacatcattctgaaatggagtaaattgaaaatagtttaacacatggaaaccaacaagcagtgtgatccatgccagtttaaacaacctaagcaattgagagtaccaagtcactcctaaatattatgcggtgtatcaaaatttatgataatttaccatgagggattaaagcatacatcaacagcttcgcacgcattacctctttacaggtccatcggggtgcaacccaatcgtgtccagagttccttcatccatcacaagttcaaatctcctctccaactttgactctaacacatcatcaacctgcaagagcaagattcatgtaagctgaatcagctctttcctcctctttccgctttaaagctctttgttcaagggagttgataattagctgtacaaccttgaaagatgttgttttggtatctaagatacaaccagaaggtcatggatgtgcacattatacgttaaagcaaaataagaacatgaaattgtgaagcatacagatacaggcatatgcaccaaatggtccagtgctcaactcaccaagaaattaatgtgctcaaacccatcacggatagcaagattacgagcaacctcaattgcaccttcactgtggtcgatcccagtcagatcagagaacctgtatatggacatatcagtactgtcaagaggcattaacaattcaacagagtgaaatacatagttgaatgtctcctaatttataaaaatactccaagtcaatagagatgtttctcccaatctacaaaacatatagctattcgagaaaaagaaaacatgagactgtgctagcatgatcctttgcttaacagcaaaccagatgcagcttccaagaataattatcaaagggcatctcccttcaatttacaaagatggccagattttaagcatgtgatagaaagaccattgggaaattgataggtctgcttaactaaatcaattatacttgccttatggtaccaaactttacaactccaaattcatactctaattatatagaaggaacacaaacacaagagagaaggagcacaaacgcaagagcaaaagaatagacaataagtctatttcagggctgtcagaaaacgttaagaaaggcatctcaacaccaatacattgaagttgacaacaataacagcattcacattaaagtaacctttggttggagaaatgcaaatggaagattgccatttcatcaacatacccttgctttgcaagctgttgcgagagtcgaccgctcccagttcctatgtcgagtacactgcagctacgcaaatccttgttggaacataagtttttcgtccagcttacgaggacatccatgttctccgtgccaaacctacatgcatacaagttagactttcatcataaccagcgatataatgattgaagcagaaaatgaagattttctgcctttttacccttaaaatggaacattgctgcaaaaaaaaaagtagtccatccatagtagctagtagatagggaaaagacaagtctaaaagttctgaatttaatttggccaatgggcagtgggaaccaggcaaccttagctagaagacaacactcgataggcattggctgttatcgaaactacatgttggtagatattactataatgctaacgtgttttgcattccctagtgaggcaataacttagttatgttccttgttattcccatcatgttgtgaacaaagctacaacaaaaattcgatgaggagatctacactctatccatatgtgcacagcaggtgaagagaagaatctgaccagtcatctgtgtggctccgttcttgaaaattagcaaggtattctgcataagaaccatcctgatgataattcggcaggcccagcaacggcggctccatatcggcggagtctggcacgtccttgtcaaagctgttcgacattcacaacgccgagtcaggtaagcataccaaaaatgatcatctcttgaggactaaaatgtaattaccgagagatcgttggactaaatcgcatgatacagcgcgacagaacgcccccctcttcttccccccaacacaaggaaatcagatcacgggcacaacaaagcaattaaaccgtagaaacggatcgctcttaacctgaaatctccggaggggttggcggcgaccgacgccgtcgtggcggcggcggggccggaggcggcggcggaggaggaggaggaggaggcgaggaggacctcggcggcgtcggcgtaccgctgctcgtcgtcgagggtgctcccgtagtcgctcttgatggaccacgagtccgccgccaccgaccggtcgtcgtcggaggccatctcccccgggggcccggggggtcctcctcccgcgcccccgccgccgccgccggtcaccatcctcgacgggaagatctccgggtcctcgggcggccaccgtatccccgccatgccgcgcgcgcccgacctcaaaccctagccctagccctagcccggccgctgcgtcgcgtcgcaatttgttcgcgtcgtcgcggaggacgacgaaaagtcgacgagtgaatgaatgatgcgaggggtgggggcttggaagaagggtcaatgacaggtggggccctggctcgattggcccacgtgtcggtgtgagagccgattgggatttgcagcggggaccgaggagaagcgtcgggtgggcgggaattggtcgctgatttgtgggaccaactaaggatggggaccatgtgacagtgggaccaggtaaggtataacggtgcaggccggatttcgcgggaagcgtcggctgttgatcggaaggaaggccgttggtcgttggggcttgggctgattttttattagtggaccgggccgagttttaaggttagatcgttcattaataagccgtgaaaaagataatataaacgaattaattaaaacataatttatgggttaaaattttatatttacgttccttttttagagggttatatttatgttctttagtgattttaaaagctaatgctaaaaataaactacgataaaaaatcacaccatcaaccctgaaattaagttttaaattttaaatttttgttgcgcctgataagccaaaagacaaactatgagagccttaagaatgagtaaaaatcatcatggatccgccggaaatttcaaagtcgtccgacgaaattgtccccgtttcaaatacggcagtttggaatttaccaaatcaaagcagaaactatctgaaaaatctacacccagaggcccttcctctgaattgactgaaaattctaatactaattaattagctctgatttttttctacatgatcacagagagctagtatacaatgcactggcatatctaatgatatctcattgtttgcttgaaagaaacatggtgtggtgcatgcaaataaaaggggcccttgaaacttgctccctccctttgttgttttccctgcaagttgctcctatgtacagctgatgcccggtcacacacagagattatctgtgagtatcctgcaggtgcagagtagcatacagctccaactccctcttcatatacagcatatcaccttgttctctacagcctgtgtgccggctgctcagctcaagttgttatagtatagtaccccactcatgacgcaatcaatcacatttaaggatcattctctttcttctttctttttgtgggggcgacatcttgcatatttctctaaaaaatgctgaaaaaaaagcagtgtcattggcgtatttatcaaaattgagaagtagattttggggaacacatacccagggcattttgctttctggtgacaaaatcccaaacaattataggccaaaaaaattgaactttacagaagaaaaaaaataaaaggaaaaaagaagaagaaaaagataagggaaaaaaatagctagagctagctaatgtacactcgagagccagctcaagctagctgcctaacactagcaaaagcaatccgcttacgtctccggcgatcaaccgccggtgcacggcacctcgtcgatggcctccagcctcggatgccacgaccggtgccgcctcacgccgccgccgccgccgctcggcttgactccggcggcggcggcggcggcggcgtccggcgcggcgtggagctgcaggctgagcaccggaaagaacctggcgccatcgtcgcttccgtcgtcgccttcgtgatccgtcggctcgctgatccggccaccgtggctcccatcgcggcggcgaccgccgccggtggcgatcctcttccacgacgaggaggccgcggtggcggcgtggaagctggagagcgcggccatctcctcgtcggtgagcacggagtagagcatgtccatgggcagcaggaagtaggcgcgccgcggctcgaggagctcgtccgccgccacgccgggcacccggcagccgacggcgaggcggccggagtcgcacacgaactgccccgggtagtccaccatcagttccgacgccctcaccggccgcgcgagccgcgtcaccgtgccatcgacgtggatgatcttgcacgccgtcgacgacgagccgcccgccaccggagccagcggtatgcacgacggcgtgatccccatgagaactagagagagaagagaatgagaatgagatggtgatgaagaagcaatggaggagatggtctatatgcaggaggcacaagttgcatattggttggtagtgcagggaagaagacaagcaaatgattagtgtgctgtgtaaggggttaggagcagcttgcttgattatctaatgctaatccgatttaattatctacgacttagctaggatcaaccgatcaaaaatggccatatgaccgcagtttggatgcttaaaacgtggcagcgagaggggccgtcaagacaggttggcatgcagcaggaacaagattagtggcatcaagctaataactagcggattgacgagagtcttttggtgagatgtcactgttcttaactagcatacggtcgagatgattatatatatatgctaattccatccaggtgttaacgctcgcttaagcaggatgttaataattatctagccttttggggaaaaagataaacttggttttgcaggctgctgcttaggatatggacacattctggcagtgcccgacaccaacgaccacttttgctaagctagcaagcattgagttggaagccacaaactgaactaaaaactattatgctttctttcattctttctttctttacagagtaagccagctgaattgatgggtcaattgagtgataaacataatagtatttgcagctgaagtgtcaatggcagagttctgaaggtatatgtctgcagattgcagcattagtgattagttgatgctctgcagtttaacagtccacaaagcgagggggttaatcctgatgcttcacattattcagtttgactctgaaattaatcaaggtttataaattttatcaacttcaaaagtattgggtgtttgagagctgacatgtttgtgttagcaaaaaagaaaataaagatgtaggagtattttataacttaaacacagtgcattttttactattattctgctgctctaggcaagcaaaagattaaacaaacaaatagattatacagcattaagatgtgcgtgttgctaagagaatacgacgacggatccagcttgcattcaaccaacctaactaaaatctgaggatctggcatttggcccctccatatattcccaaatctctgcctcttgtgttcagtgcttgtgacggcaatcaaggagatggaatcctaagagaaatgttaatttatctgtttatttattcgctcttcagcaatgcaagagttcttttttgcttttgaagcaatgcaagaggtcagtatctcaaatctactcatcattctgaaaatcttgataggtgttaaaaaaaaacattttgactgacttaagtacactagtataaagtatgcaaaactggctcatgtgcattctaactcagccacatgacgaaacatgtcgaaaaatttaaattataaaaaatagttttgaattaatccagttatttttcatagttttctatttaacccgctaagagtagaaataagaaggtgctgcccaaaatcattttaggttttcgtttatttttgtatagcttattatcgtagcttaaccaattgagcactaaataaacacgatattatcatgttttttttctttttacaggagatgagcctaactttctttgagtgctcaggttcattttatagtctagcaaaatttcctctctttttttttggtcttttatttgttgttaggaaaaggcccatcaagatttcttgggcttgtagacgactagtactattgaaagtaggcccattaagtggccgaacttgtcgaactgggccaagcttgtcctcgtgtgcaggcgaaaaaaataaggaaacccgaaggactcctcccacgagatcggacggccagaagaggcccaaccccacaaaccgacggctagagatcactccacgtcgtcaggaataacccccggaagcgggccgcgtcgtatttcacttggaccctcgcaaccctaataaacccctcacccccgcgccgccgccgcctccactctcctacgcttccaccccccattcccatcccctccacccagatcgccgccgccgccttcgcctcggacggccgtacggcgccgtccaccgcgcacgtctccggcgatctacaggtatcgtcgccacctcctagcccccggtctctcatcatacggtggcttccccccgtggtggattcctcggtcggttccgatctgttcgggaggtgggggtggggggtcgttgttctgtaggttatggagcgttggtggtgttgttttttgtgggtggttcgaggtgaatcggtgggttgattcctgattttgctgtttgttttggctgtgatgaaggtgtagatcgcttccggagacatccaaccgcggccatggcgaccttcgcgaaacctgagaacgcgctcaagagagcggagggtgagtcccctttggatctgttatgtttatttaggggaccagttttcactgttttgtaagcatggaattcgaaaagagcggtgtttgattcctcccgtcatagacaaattaacagaccatggctggtcgttcaatcttacagaaatacttgttgattcgttcgtgctagttcttagatgtgttcaattatacatacttcggaaaacattttatttttactgatgatggccctctgctctacttcagagttgatacatgttgggcagaagcaggcagcgctacaggcgttacatgatctcatcacttcaaaaagatacaggtcatggcaaaagccactcgaaaggattatgatgaagtatgtggagctctgtgtagacctgaggaagggcaggtttgcgaaagatggccttattcagtacaggattgtctgccagcaagtgaatgtgtcatccttggaggaggtgataaaacacttcatgcagctttccaatgagaaagcagagcaagcaaggaaccaggcgcaagcactggaagatgccctggatgtagaagatctggaagcagacaagcggcctgaggatttgatgctcagctatgtcagcggggagaaagggaaggaccgatcagacagagagcatgtcacaccatggttcaagtttctctgggaaacatacagaacagttcttgagatattgagaaacaattcaaagcttgaagcattatatgctgtaagctattctatctgtgttccccttattcctgtatacatactcttcacacatgacatggcatttcatctggctgttccattttgtgtacacaatcaatgatcttaatcgtgattgcctcgatgctgcgcttctgcccgtctagtgtcttcaaaacaataatgtgaataaacacacctaattcaccgctctactgccataccaccaattggatttccttctagtgctattatagtactcttggtcatcattgttcaatcacattatcatatgctgtattattagagttcctactttaactgcttcatatttttcctatgtcatctaataaaatagttgtacactatgtcattatcacattattatggcttaatttggtaatggtgccagaagtttaacatgatgattcaattaccataattgcattctctctgcactatgtctgtttatatttatgcagatctctgtgtaattgccaatttggtttaggcagattttactcctgtttttttccagaaccttaaataaatttctgaattgtgaaattgatttcctgcacatagtcttctgtaccaagtacttttgcatttgccaatgcatctaaaccctttttaatctctcattttgcagatgactgctcacaaggcttttcaattttgtaagcagtataagagaacgactgaattccgtaggttgtgcgagataataagaaatcatcttgctaacttgaacaaataccgtgaccagcgagatcgtcctgatctgactgccccagaaagcttacagctatacctggacactagagttgaacaactaaaaattgctacagagctctctctctggcaggtccgttccttatattttttaaccttttttatgccaagtgaatcatctttgctgtatgatcgtaaagctttgcttcttgcaggaggcctttaggtctgtggaagacatccatggcttgatgagcatggtgaagaaaacaccaaaaccatctgtcctggttgtgtattatgccaagttgactgaaatattctggatatctgattgccacttgtatcatgcatatgcatggcttaagctattctacttgcagaaaagctacaataagaacttgtctcagaaggaccttcaattaatagcttcttctgttttgcttgctgcacttgccgtgtcaccatatgaccataaatatggcgcatctcatcttgagcttgaaaatgagaaagatcgtaatctgcggatagctaatctcgtcaacttctcccttgactccaagcgtgagaatagagaagtggttagccctccagatctttttcaaagcaaagaatattttgaataattttatttattatcttcctgacatatctcctgtcaccattgcagccatcaagagcatctcttttttctgagctggtatgtgctgaatcctgggtccttttatttatcaaactattctgttgagttttgcactctcgtcagttgtcgatgggatagctgacatggatagttcattcaattctttttgtcagtattatagggttggtagggttgtatccagtaatttgtactccatttatcatgcataattgaatttctcttcttgtgcttgcttgacttgatatttataaatttaggctgccaaaggtgtcattgcctgtgcttcacaagatgtcaaagatttatacaaccttttggaacacgattttcttcctctggatctcgtatccaaagcacagccactgctatctaagatttcaaagattggagggaagctttcatcagctcccttggttccagaagtttttctgtcacagtaccttcctgctttggagaagttaacaactttaagggtgttgcaacaggtatgttcaatggcacactgtacaggaagtataagttctcttttctcatgatcttttacgttattctttggttaacacgtggtttatgcacccttttgttctttttcaggcttcccagatatttcagtctgtgaaaattgatatgctctcaagaatgatcccattctttgacttttctgttgttgagaagatctctgttgatgccgtgaaacacaattttgttgctatgaaagtcaaccatttatcaggagctgtccattttgggaaaatggtatgtggtttagttcctcaagtctgttggccactttagccttctcagtgttcttattggtggaatttacttttttattgttttatttccctgtaagcatcagtatagaagttggttgttctgttcattgtggtatgcatatttatcctcgccaaattatttcctctaaagttgaaatattcatagagaccatagtttgaactgatggccaagatacaattggtacatgacaaccactattttcattcactttcgacagcctttgtagtgtagaacaaaaatgtgttgactcaattgtatatgctgtcttaccactaagacttagggcatggttctttgtgcctctgttaca

SEQ ID NO: 26224 - DNA, 732 bp, Oryza sativa
gggtctatggaactggcatttagccctaggtatatttgccaaatcgagtgtattgtatgttatttgtaataaaaaagaaagtctgaagaaaattcttgcttgatttattttgcttcagattttaaactaggtgtcactgtcgtagacatttttggtaatctggtaattgtacatagctgtaactcgcattctcattctcaacattatatttaactatgttatattattttttattttttagattttcaagtgactatgtagtgcctgatgttggtatcttttggttttaatacgttctagtttgtttgcttttaatgccaaatatcagacagtactggttcttgtgctgtcaatttcgggacttcagttttattaattattaacctgtgacatcaattttattctgactggtttctgtttgtaggacattgaatctgattgtctcagtaatcacctaagtgttttggctgattctctaaataaagcaaggagccttatccatccacctgtgaagaagccatccaagcttggtgaaaacttaacgagtcttgctgcagtagtggagaatgagcacaagcgtcttcttgcgaggaaatcaattattgaaaaacgcaaagaagatcttgagcgccaaatattggaaaaggtgtctatttggtactgttcaaagtggccaactctgtgaatttctgcttatgtcatattctctcttttccagaaaaagggggatcc

SEQ ID NO: 26225 - DNA, 4081 bp, Oryza sativa
  unsure (1)..(4081): unsure at all n locations
actagtggatcccccttctagtggagtagtagagggtgtgctaatatgctgttttttatgttttgtggctaaccattatagactacaagaacgcagaacgcagatgatatttgaatctttatattctgtagtgtcctactcttgtttcatattaagaattgattgtcttctccgaagtcggaactataaagttgtactatcccaagccaattacagcttaatatttgtttctccacacaggccctttatactttgaatgttttcattgcaggaagttactaaggaggctgtgatggaattggctatgaatgagcagtttaaggagcgccaagagatggagaaaaaactacagaagactggtaagcaaatggattacttggagagggcaaaaaggcaggaagaggcacctctaattgagcaagcttttcaaaaacgccttgaagtagagaaaatccttcatgagcaagagcagctggtttgtttctcacaattccttgattgtcacattacaatagcatatgattacttaagctcacaaaaatcactattaatctcttcttgtagagagagattgagctcagcaagcaacaccatgcaggtgacctgcaggagaagaacagactttctcgaatgttggagcataaggtaagcaaatacatatctgtattcagaccagatattcttgcactatttcatcttctttttagttaattgaaggaccaaatgtcccactgtaattaatcctgtgtttttccgaaaccatgttttgcaattccaagcataacagttgaaatacttagtatattatctgtgcaaaggtctgattagatacagattaatttaacatataatatgtgctatacttgctgagaatctaatattggcatgtcttctttggctatgtgtgtgttcacatgatttgagcactagacatttgaatacaccaggcgatttgttcctgtcagggaatagacagctgtcttctctccttcgcacatattttaaattgccctttttgcttgcagaacattttccaggaaagaattgtccaacgtcgtgaagctgagtttagtcgtcttaagaaagagagggatgaaaggactagtcaattgatatcatcaaggaagcgtgaaagggatacagtgcggaagttaatgtactatcttaacttagaagagcagcgcctccaaaggctccgtgaggaagaggaagctagaaaacgtgaaggcaagaattcatgactttgtgctttgaaatacttgttcttatcttaccttattagattagattaatttacactgccatatatcgtccagctaattttggaatttcttgagaattagtgaacattgcttgttgaattactgtgactttactgcagtatggacctgtgttacttagggcctgtcactttgatgccaaaaaaaaccttaccaaattttggcatagccaaaatttcggcaacttgccaaaattttagcaggatttcttatatagttaccaaaatttggcaacaaactaaatgtagccacttttcttgcaactttaacaaaatttggtaagattgaaaatggcatcaaagtgaacaagcccttagacaatggatagctttaaaacttaaaatgttatttggcatcaaagtgtgatttgcttgtgcataattatcttgcggatctttttttttttgcctgatgcaatgaaatcaaattctagcttatacatattgttgataatgatttcaccttctctgcagaggaagagaggagaaagagggaagagactgagaggaaggctaagctggatgcaattgcagccaagcagctgcagagagagagggaactagaagagaagaaggaaaaacagagaatggaagctctcatgggaagaggagctggagctgctgagcctgcacgcactcctgatgctgctccggttgcacagccagctcagccggtagctgcaccggctgctgctgctgccgctgctgcaccagctgctggtaagtatgtcccgaagtttaaacgaggtggtgatggtggcagtagtgctggcggccagagacctgctgtggcacctgagcaagaccgttggggttcacgggatgatcgcccacgtcctgatatgcgtccgctccgccaagaggcaccccctgctcgcgatgctgctcccccagcccgccaagatggtcctccaggcacatggcgaccttcaagatactcaagttcatcatcttcctcaacctggagcagcaggcgcaactgaagccgtctgctttcagatgtggactgctagggtgagattttttgctgtccagggccattgctgagataagcctgtgaaacatggttgaatgtttgactgtttgcgcatcaaatgctcgtaaaattttggagttaggacctgcttcagggcaatagcacctttcctaagttatgtcaaatgttatttcgttgttgcagttactccattgcacactggattgctactcgttaagtttgtccaaactttggcgctgttagtaatactggaatattgcccttgtctttgtgtctttgttcgtttggtcgttgctacaagtacatcgcatttcttttgattatcatcaaactaatatgacttgttgatcttgattaacaccaaactcggatgaagctttgacgaagagttggcggaaacatgaatcatggtggtgtaccccaagcaggaacgcactgctagcagttggtagtttgatgcactgggatttcggagctcgatttgcaccggaaatacaaccttacctatccgcggtctcctacgttgctcaagtaaagcattaacgttctccaatgttgctcaagtaaaacattaaccttgcatagaagtatgagactgccaatctgtttgaccttgcatagaagtatggatggcaatgaactgaactgtacaacatgaaatgccatccctctacatcatgccaaaattcgatgagtgttgtcatttttggcatcccattggctttgcccagtaaatccatctggtaatcagaaactcggaatggagttgggaggcaggatgcgttcgcttgtctccttttatcgcacgttctcgatccaacggttcctgtgaataccaacattctaccaccccagtttcaaattttttttttcgaaagaaaacgaaaagtgaaaaaaaaaagaaaggcgtcggcaacttgagttgggcaaagagcaaggttccacacgctgtcactgccgtgtgggccatccccccccccacgccacgcgctctgctctttctttatctagtcggtaggctcggtccactccgcctctctctctctctctcttcctcctccgcgcgccgccttacccctctcctccttcctcgacgcggcggctgctccagatcttctcttcccctcgcggcggcgtctcccgtccaatccagtgagttctcctctcccccccccccctcctctgcaccgcttgctgcatccatccacttctctcctccccaactttttttttgaattttttttcttactagatagattcgtggtgagggcttagatcgcgtggtgcggattgctcaggctccggatctgtacgtatagacgcgcgagccgcgggagattctgagtgggtggctaggtttttgtgctgtgcgtctagggtttgggcgcggttcgtccttgttctagggttccctcgcaattcagatctgactcgtcgctggaatcttcgtggggcttcggtttttcaaattccgtcgcctcaccgttgccgcgaacacccccccgctagggatgggaattgggcccagactacctgtgggctatggctatgccccgatatgcttttttgtgcatatatattcccatcgagatcagggggcgactcgagaagttgcttgctgaaagctacgtcatatccgctacgaattcacacattttctcttgttgtttcaggtgaactatcggctcagtaaaaggggaaaaaggagggatcttttctggacatttgnnnnnnnnnnnnnnnnnnnnnnnnnnnnnnnnnnnnnnnnnnnnnnnnnnnnnnnnnnnnnnnnnnnnnnnnnnnnn

SEQ ID NO: 26226 - DNA, 2766 bp, Oryza sativa
  unsure (1)..(2766): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtaatatgttaatttactttaacacttgattaattcctatttaatatattcagtctatattgatatcttagtataaagtagtatcggagtagtagccgatacgcgttaaatctacaacatcggctatgctatgaacatatataatctttatattaaagtacttttagacataagtgatttatactgtctcggcaagctggtccgatctatccgaatcacttggtttaaacatatttcgatttatagattatatactgttaatatctacagtcgatcgactagatttaactttctttttgctttatatatcattgccgatctaattcacgttacatcggctagcttacaaacgatacgtcatcggcatgtggccgatcgactatcgtttatggatttaactatgtttctttgtttgtttcttgttggttgcaggatcaaaccaactggcatgcccttaaacccaagagcaaggtcctgcactagagttaagcagatctctcaggccagcgtgtgtttttcacatcaacaaaccgtcattgccaattagagatagagctcaattaagacaaatgtatctattaattaagttagttatgtcggtttgtgttagttttggcaagagagcgccgttatggtcttgtttgtatcttatctttagaaatgtttgagtcatgtccataatagactaagtttgtactcgggtgttgacgagaaatccgtgctcggtcgagccggaactgtgttggcgtgaactaagtcgacgaacacaatggcctaggagatctgcttagctccagtgcaggtccaaaggttgacgagatgcggacgtgccagtcagtttgatcttgcaaccgacaagatatacaaatagcagatcaatgagccaatcggctgataagccgatagagcgataccaactgatgtcgataaggttttgagcaatcagccatatgtttgatgtagaatctgatacttaatgtaaataaaggcaatcggctgatgataattgttaataatggaatttggcatcagattcgagtaagaaggaatagatcgaagcggatttggtgttggatttagttgaactcagaatcggactgtgtatcggctggagaccgtatcggtaggaaacaagggctgaagattgatcaagctgaggggactgatggccgatacagctgatatggcatagcttgggctcggtatgggtctagattggactaaagatgaagctcaataaaggcaattgtatctaatataacttcggcgcgccgaagctcaataaaggcaattgtattaaagcaaatccaatacaactttggcgcatcgccacccttttcttttacttgttttcggcgagttatctccacagaggtaacccgtctcgatggctcgtgctatcggggctattatgtcgttttagatgtattagttcttgtattatgaccatcgctgagtctgtccaggcaagccagcggctctgtgtgtgtgtgtgtgtgtctcggtttccgtcttctgcctccataacaagaacgtcttctcgccaagttacgtggtgaaggcagccgcggtgtcggcacgcccggggcccgggctgccttcgatcccagtaggaatcgctcctccttctccctgaaggaagagcatggaagtttactagggaagtaacacggagatatctgtccggttgtaccttcctctgtaaggtacactagaaatatcctaactaccgctttaaaggatgtcaggggtgtgaccttaagtcctgacgggaggtgtgaagtctaagggccagttgtaaggcaatgcaccccctctcatcatgaaaccaagcttatagaagatttctcccgctgacaacggagagacttcgacaagacttgggtggcaaatcgttagggtcgatggcacccccgacacgtgtcacacatgcccacggacgccttccctcggcctagccggtagggaagagccgtgtcccgccgaaggtagcctaggccctactaggcccacctcgcaccacgtggtgtgcgagctggtggaagcccaactacctctgacaggactttggagctcggggctgtgtgaactgcaagacttgaagggtttcttgaggatcacagccaaaaagtcagacggcagagataagacaattgacgtgaaggtttcaagggtagttaggtaatattgtgagccccaccttacactataagggggggactagcaactatttaaggggtcggtctttttggaaggccggggacattgccatacattgcttctaattcttcccttaggctagccaattcaccttatactccgtcggccggccttccctacggtcgtcggcctagggtagttagtgaaagtgtagcgcccgttccgtcgtggcgcctagcgggaaaattatctctcaaaaaccctaattgcgaaattttgttcctttgattgttgtctagtgtccgtgccatctcaagatctcaatccccgatctatcgtcgagttcaaattccgaatccagatcttccgaatcaattcctccgcaaagtctaccttgcccccccggcccatctctccccccccggcccatttccctctctctctctctctccctccccgg

SEQ ID NO: 26227 - DNA, 5349 bp, Oryza sativa
ctcgcgctcttgaccgcgcaagtcggttccccaaaccgacattgccgcctccttaaacccccggcctccccttctccttccctccccattttcgcctcctccactgccgtctctattttcgccgtctccaatcgtcgccgcgcgtgtcggaggagccggcacgagcgaggacgccgaagaggactccggccgcgcctcttcttcctcttccccggcccgaggccggagagatcactcccgcgccgtcggcctctcgtcacagcgcctctccttcccgcggtgatgtttcgcttcgttctccctcctcgctccgtctcccccccttagacttcggatttagctcgagtagacctcccgtagttggccggcgccgccccgaccgatgccgttgctcgccatgtgctcgtcgccgtcgccgcccgagctccgaagtagccgcacgtcgccagcccagctcggcatagctccgtccaatccaaccctagcatcgagttcccgtggccttgtagatgctctcaccgccggaaatcgacctctcgtggcctcgtcgccgtttccctcttctcccgccgccggttgcggccgccgcaatccgccgccgccaagcaacctccggcgaatccgagccgttggctcgtctcctctcgtcccgtactactgcccggcgtgctcgccttcgccggtatcgccgtggcccgctctaccgctcgccgccgtcgcccgccgttcatttgcggccggtcgtcgtctacctcctgccagcccacgtggccgccacgtaggcgccacgtcggcgccagctcggctgagctcgggacgggccgaccccggccgatccctccccgtgcgcgcatcccaccgcaagccgtgaggctgcgcgtgggcccgccgcacccgagtcctccgtaaaccgcgcgtgcaccgctttccccctttcgcccgcgcgcgtgcgccgcgtgctccctccgcacggtgggccgagccgctgacaagcgggtcccacccggggccgcgcgaggtgagcccggtccaccggctctctctctcctctcccgcgcgcgcgcgtaaatgggccgctttgggccgtccggcccgtttagctcggccggaccgagccgaatacctttgggccgcgccctagccgcccgaggaaagtctagattccctcccttcatcatttccttttcctttttccaaaaaggatttaattaaatcctttttcctttagaccaaaaatccaataatcttagaaattcaatatctttccaaccaaaactccgtttgactccgttcaacttccaaaatttcccaaatctcgagatctatctaatggcatgcttaggggtcattaatagggctttattctcgccgtttgttgagttgtcccgtttcgcgtgtagtttcggagcccgaagacccgcagtgcgaggatttcgaggatcaagctccagatctcgagcaaggcaagccacctttgaacaacttgagcctatatttgaaatttaattatgttgcttgcaaaatattatgcattgataggatcacacttaatcttttgccccatctgcaaggcagattggtggacctacctaattgattgcatttgatcctccctctgttaattgttataccatgtcccttgtaaccacccagttgtaccgcgatattcgtgcactctgtacgagtatcgacggtagccttcaaacttaaaatctgagtacaacttgggtaaaactggagctttacaaaagacttggaaaacccgacgcctgggtcggtgcttgcgaactaaatgaatttccaaaactgcggaccgggaaacgtatcgggtgtacggtttcccgctcttgcacgtaaggaccgatcccttggaatttcatcccaacataagaccagtacgaccacatgggtggaatgggacacccctggctgagtaactagcttatcaggggagccttgatgccgagagacatgtggattcgccggggtggtgtcggggaggacccctgggtttcctagcacagtatggtctgggacctaacctgttgttggtctgggacccctctcgtcggcatatggcaaacctgcatcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaatcgggttcgatgtttgaaaagaatccgcagctgacgggatcagctaggcccgggtggccgtttaaaaagttgttggcccgggtggccgtttgaaaagttgttggcccgggtggccgtttgaaaggtgttggcccgggtggccgtttaaaaggcctttggccgggtgccaatcttgttcaaatctaaagactgatacattgcacatactccgaccggacgagacacactgcctcatccgtgtcgtttgagaagcactcacttagttgcttttagaaaagagttcaaataaaatcaattgcaaaaacaacagccattccttgaagcctgcattaaacacttattttcccctggcttgctgagtactcccgtactcacccttgctctatataaatatcccccccagttgctgaagaagatgaagcagatcctgctgatgaggagttcttccaggagcaagccggctacgatgagttttagggtttcggcctagttcccaagtcgcgcctgtgatgattggtccaagtcctggcttccgtttcgcttttgtaatgcagttgtgagctcgggttctgtccgcagcccaacatgactgtactcctactctatattaaagagacctctgttgctatgatattctgtctccctgtgataccagcactgtttcctgggactggtatcgattaacaggttaatttggagcgtcacgggctagttccggccggaactggttcggggcgtgacagaaagccaaaacacaggagtaggttattatacctccgggtggcctgaacctatataaatctcctcgcctcccgccacggggctagctcgagccctgcgcacactcgcgcccttgtcctctgccacccctcgcgacacactccatgccgccttggcacgaccaccgtccgggcgccgacaaaccccttggccgaatctccattctcacgggaaggggtctccactccccactgaccatggaatcgcccccacgacacatacttagtgctgcatcagtacattagatctgctaagtcgtgcatagaatcatgagctctagcctgtttttgactgataataggggtagtatcggtatttcagccgatcctatctaatatgcatgtttctttatctgtttcatgtatattcaccatctatatagacagatcacctaatagcatcatatcaagtctaggtcaaattggctgtgctatcaatattgactactgaactttacttaatatattgctatagattgatatgcttatatagatttgtactggagtattagctagtacgttatccttattgctctaaatattgttataccggaaatattgttatattggctattttctcaatattgtcttaaaatcttttattaacctttatggacagtattacagccgatagggcatatttagggttttatattctttgatttatcaagactatagccggttcggtcttaccccattagctgggaccatcaacaatacgctatcagcctatcggcctattggctatcggttgactaatcctatcttttgtttccttgctggttgcagggtcaaaccagctggcacgcccttagcacttcgaggcaagccctgtacctgcactgcagttaagcagatctcccaggccgtcgtattcggtcttatcccatcggctgggaccatcaatgatgcgctatcggcctatcagccgattggctatcggctaactaatcctgtcttttgtttctttactggttgcgggatcaaaccagctggcacccccttagcactttgaggcaagccttggaccagtactggagttaagcagatctcccaggccaccgtgctttcacagtaacaataatataatgaaacaataatataattcaatagaaactaatcatccaataatgatatgatagatccgaaggttaaagcatacatcggctggagatttgatgtcataaaatctacaatattagataaatagtgaaacctttattgtcatcggctaaattcaacatatatgctatccttgtatgccgatacaacatttagatacctcatcggctgaaaccctgatgaaacccttattggcaactaagaagtaggctagagattgtggttctaatcaagacttagtaggttgaatgtactaatccagcactaagtatgaaaagaaacacaatatctagacaatcaagcctttgactgattttcagggtggtgtgtcgtggggacgatcccacggacagcggggagtggagacccctccctgtgagaatggagatttggccaggggttagtcggcgcctggacggatgccgtgtcgaggcggcgtggagggtgtcgcaaggcatggtggaggacgagggcgtgagtgcgcggggcccgagctggccacgcagtgggaggcgaggaggtttatacatgttcaggccacccggaggtgtaataccctactcctgtgttttggctttcactaactcccctaggctgacaaccggagggaaggccggccggcggagtacaagatggatccgctagcctaagaaaggagctacaagctatgtgtgccaatatgggaagctatctccaaagcggcctctctaaatagttgctagtcccctccttttatagtgtaaggaggagctcacaatattacctaactacccttgataccgtcacgtcgatttcttgtctctgccatctgactttcggctggccgtaagacatcacacctcccgtcgggacttaaggtcacacccctgacattctttaaggcgatagttaggatatttctaccgtaccttacgagaaaggtacaaccggacagatatctccgtgttacttccctagtaagcttccatgctcttccttcggggcaagaggagcgattcatactaggggcgaagccggcgtgggtcccggacatgccgagaccacggctgccttcatcacataacttgtcgagaagacgtccttgttggtgctcccgagatgcgcccgggcccgagttagttcgggactctaggtc

SEQ ID NO: 26228 - DNA, 11664 bp, Oryza sativa
ggcgggggggggcaaggcagcccccgagcaaccttgaggcggtcccgggctcccagaccggggcctgcaaccacgacctccgattagttccctcttcggaagtgctttggtgcttggttaattgttttgacgggccccattcccatttcgtcgactctctcatatccctccagctcgctccccttcccttccttccttcccctcctagatccggtggaggggaggggcagcggccaaaggagaggtgcggcggaggcgcggccaaaggagaggtgcggctcccctccctctcctctccctcggctctactctcctccgccgccggtcacgacgacgacgactaccgcaagacgacgacgacgccgccgccggccggtctcggggaggagaggctgctatgatgaggaggtggggcggaggggaggtgcggctcccctccctctcctctccctctgtcgctggtcgcgacgacgaggaggtgaggcagcggcgcgcgcggaggggaggtgcggctcccctccctctcctctccctctgctctactctccctctgccgccggccgcgacgacgacaccgccgccacttgggtcccaccaccgactgtgacgatgacgtcgtcgcctggatccacctgacgcgcttctgtcgctgttttactgtcgctgttagatcccctacctgacatggttctgtcgctgttttagaccggcagatatttgaatcgttgtgcactctgcttggtgcgaagagtaatcacagtagacacgtaatatttggatcgttgtgaaccgtgcttggtgcgaagagcaatcacagctgacacggagtttatactggttcggaacctcgtagtcgagtttacgtacgtccaggtgctgcttcttgtattatttcggcgagtagagattacaatgcagctaatccctatcaattcgatgggtacaatataggtctacctagctatttaagtcactacgccagaaccctacatctgtgacggcacaccaatgacgggcctaaggattggtcacagatgaccgtcatctttgacgggtcgttaggtttgccgtcatcggtgaggcatccggccgtggcccgtcacatgtatcaccttacatgtgatgggccagaattttaagccgtcgcaggtgaggtagtgacggggttgctctccagcccattactagtttgacctcacctgtgaggggtgttaaatttgcaacccgtcaaagatttgatatctcatctcaaacgagttaaaaaaattatagccgtcagagatggcttacaaaaaaaatgccccaccccacccctgcgaccctactcctccccttggattccccttccctcctcatcttcccttctcatcttctttctctcctttactcactccctcccactcatcttccttctctccctcctcactctctccctcatagatcgggccgtggccccccctcgagagctggtcgctgacgcctcctcgcctcccgaccgtcggccgccgccgccgccgcctccccacctcccgaccgccggccactggatctggcctacaaggcgcggatccggccaccgcggcctctcccccgtccgtcggccgcttcctcctccgccactacaccgctaaccgcggatccggccaccgcgacctccttcccgatcgccggccgtttcctcctccgccactgcaccgccagccaccggatccggcctcgacaagtttgggggcgcggatccggccaccgcggcctctcgcccgaccgtcggccgcttcctcctcctccaccgcactgtcaaccgccggatccagcctcgacaagtttgggggccatggatccggccatcgcggcctctcccccgaccgtcggccgcttcctcctccgccaccgcaccgtcggatccgtccacgcctccctactgaccgccggccgcctcctccgccaccgcaccgccgccagatggagttatcctttctattttgtgcctagatgaatatgattgtgatgatttttgtgattttgttttgtgcccaaatgattgtgaatgtgaagtgattttgttctttggccagatgaatgtgattgcgagaatttttgtgattcagttttgtatcgaaatgactgtgaatgtgattatttctgtgaattgtgatgcctaatggtctcgcatgcaccaatctgtggcggcgaccatcctctgctgcgacctcatttttgtccgacgatcttgttccggggtcaccatcagccagcctagggctggccatctcactttaatttgcgcgcgcgcgcgcagcagtagcagcttaggcgcaagcgatcaccaagttaaacccctgaacttgtttgtcagatcagatgtgttcgtccaacataatttctacttaatttcaagatgatgctttcagaaaagtaaaccatggcataaaactcttgaccacataaaacactacagcgacatcgactcttctactagctatattcaaagatagatagatggactgcaacagacagttctactacagcgactagatcacacccaagtgttagtagcataatttggcttttggttaggtcattttagacaggccaaattatatagaatagttggtgtaattgttttagtggtttgcttaagaattggttagcttgactagggcaggaatttgtgatgcaccgggaggtgtacgagttgctggggagctgcagaaactagagaagaaggttgggacttgggaggctgcaattctcagattttgtcagttcaagcagcttagcatgcagcgatggagcttttgccgattcaatggatgtgaggcttcactggttgattttatgtggctggggttggatgcatggctatgtttgatgatatgcctgttgaagtctagccacacaggatcacattgttgccagagcaaggggagacaaattctgaaagttgggctggagcagcgttgcaggatggaggcgactttcggctgaggcttgtatacgtctacatggaagctgtcgttaaaaaaggacggttttcattacatagaattaatcacggatttacctagagttttctatatatgcagtacagcgtattcctttactatatactatggattttgcacttggtagggctcgaaaacaattatcatcatatattattttcttctaccgttttcatcgtacttttgctcttgtttctttggccaaatcctggttatctagggtgcggttgatctttactggtttgcgctgaaaatcagtcgggttcttccacgaaagtgaagatctttgctactttgcttgaaaactagtcgttcgtcgtcacgaaagcacgacggttatcattgttgttgcgtgaatcaattttacgtgtcaacaccaagtaccaacagataaagataagatagatcttcgctcatatctgatcaagctgctcctcctcctgcctatgcagataggctccgctcggcccaccacgccgtttacgcgacgagggcgctcttcgcaacggggaaccgctcggcccgccgtccccgccgtccccgccccgcccgccgtccccgccccgttggccaggtccaccttgacctccgtcgccgccgcggcctccgttgcctcctaggccgccgtcgccgccgcgaccgccgcggcctccaatgccgagaaagccgccggtgccgccagtgccgccgtcgccgccgtgagggccgaacgcggatccgccgcggccgccggggccgccgccctggcccggttggccgggctcgcccggctgtcctcccgtcccaccgtgtcctcccctgccgccgccctggcccggctcgcccggttggccgagctcgcccggctggcctcccctcccgccgcgtcctcccctcccgccgccctggcccggctctcccggttggccgagctcacccggctggcctcccctcccgccgcgtcctcccctgccaccgcgtcctcccctggttggcattggtggtggatggatctaggcgccgccgcagagaggaagagaaggggcaaaaacctaaagcctccaccaggaccgatgaatatatatatatatatatatatatattagcagaaaacgcgaattgggcctcagcccattaaccctccctgttgcctctcagagcaaggaaaaagtctacttagactcccttaattgttcaccgaatctaaatcgtaacccttgacgggaaaaccagataggacgactccccgaattattgaaactacccaatttgactcctccagcggttttggaggacggttttgcagacgtgacgctgacgtggcggtgctaacccggttttcattccacataacgcttatgtggcattagaattaaaaaaaattatgtggacccatctgtcattcacacacaaaatatattgtgggacccaccgacatgtggggcccacatgtcatcctttctccttcacttcttccccctccctccctccctctcccttctctctcttttctctctcccttttctcttcccccttcggaagcatcggtggcggcggcagccgggggctggagtggcgacggcggcgtgcgggcgagggctggttcgaggatgtcggcttgccggcgccgggcttttgctggggttcgaggctgttgtacaagccggagttgccgctgccgccactgaggtccgtcatctcctccaagtccggtgaggtccggtcgggcggaagtgcgggcgggagataggggtgaagaacctgtgggacatcctggagtcgtgcaagaagaagctcccgctccaccacctccagtgagtccccgatccgccattaatcccggcagggctagagggtagaggtttgctaagagcaagtacaatagcaggctgtaagcgagctacaaacatattttaaggagataaataaggagagagaagagcagcgggctacagatttatagccagctgtagcacggactccaagacgcagtgtgtgtatgacaggtgggaccatgtattaatagtgtagtatgtaactattgtatgaatgaacggttagattggctataaataaattggagctagtagttagttattctattaaacttgctctaagggcatccacagcgtcgttcgactcatgcctgccacgggagacgaacgaatcaaagattcgatagttgtagtggtaaagtcgatcggtgggacccacataaataaatatctattcaatcactaccgttcatcctcccttgcgtgagcttctaatgatatctacatggtccattcctctctcgtgggcaacaaatagttttttaaacggtagagttcgactctaaagtagatgtcgatttaatctccggcacgtaacaatcgatggccgtccgttcctgatccaacgatctcacgatggtagatgagcagccacgatgggacacgtggacggttagatcgtccctagcgtgtgatcgaacggatgatagcggcaggaaccgagacacaattaataggaattgtggggtttttttttttccaaaagaaccgatgatgtggcgcgctaaatcttcagcattcccacagtgtttaagtaaagtaatatttgaaacggtagagctagaaatgaaaatgacatcgataataatggaaaatcagaaacggaactattcaagggaaacacatcaaaagaagtaattctactgttttcaacaaattacctataccggatggttcggtcgatgcaacttcagaaaggcgagtcagtccgtaagtaatttctatgcatttgatccaattatcagactcacgtacgtttgaatttgataaacggttataaacagctgcaatgcatatgaacatactcctgctgtcccaaaaaatcaaatctatgattgacatccagattcgttgtattatgatatgtcacatccagtactagattgttttttaagtgacggagaaagtatatgttttgattgatatatggctacatgtctctagttatacggttatacacgagttgtacaattgggttgtacgtgtagcagtactcatttccgagattgttttcatccatgtactccacattactgttgttaaaaccctagggaatagttcttatcataacctactatcattagtactaaactaaaatttggcattattgctagtttgctactgctaatggccaagtgtcaggttgatccggactcaggaggtcttcttgtcaatgcaaatgccaagaatgatctccttgtgctccccgtgcagcatcttgggtggcacggccaagaacgtcgcctcctccacggcgacgccgccgggcgccacgccgctgctcgccacctccatgtccaccatgaccatgtccgccttgccgctcgccgcgcccgccaccgccgccgccgccgccgccggcgcgttcgcccacatcttgcacctgtaccgcgccgccgtctccgcgctcgccgcgacgcgcaccaacgtcaccgcgctggccgcgccgaccgcggccatggcgaggaggaacacgcgcttgtcctcctccccgacgagcaggcgccgccgccgctcagacgccggcacgcggagacacagggccttgccgtactcgaccttgtccacgtggcaggaatgcgccgcggcgaggtgttccaggagagccggcgaagccgcagccgggctccgggcatgagcacggcgcgtgcgggcacgcgcgctggtggtcgtcgacggcgtagtaggtgacgtagctccggcagccgtgcgcctggtaggggcactggatcttggtcgacgagacgaaggcctccatggcgcgagagcgggcgtagacgacgccgacgccgacgccttcgcacgagtggcaccggccgccggcgaccttgccgcggcagttgctgcaagccatgtgcccagcatcgcactgcataaatcgatggacaaagaaagaaacgattcatatgaatgcaaccatgaaacaagaaatggatgaagcatcagacattgcagcaacaagcaaggaacctggaagattggaggcttcaaggggagaaagcagatggggcagtgaagcatggccatgtcgatcctcacggcgatggcctccggctccggtgccacaaccatcgcgcctgcttcttgtttccccggccggccggtcaccgccgccgcggcgatcatcgttctccatcgagaaggcttccgttttctttgcaatgctgaagattgatttctctatcttttttttgatgtttgtcaaactctcagagcaatggcatggctggtcccttgtcaatctgccaaaccacgcagtgttgtgttgccgtgtactagtagggtgaagaacaagtagaaagagctctaccctctcagtaccaaaaaaactcaattgtgtgtcagattcaaatctagaattgagttttctttttggacggagggagtatgaaaaaaaaagaaagaactgttagatggatctccctccccttgagcccaacggctcaagggggccttgacccgcgccctgatcgggggcgcccagcccaatggctggtgggcccccgtcacactgtgccatataaagaggggtggaagacgggacggcataacgacacaaggaacgaggttcgtcgccgccgccgccactccaccccataaaccctaaccgatcgagggggcgcagccagtgacgggacgggaccggccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaaccctaacaatggtatcaaagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgtattatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctctgttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctaggatttagaagaaattcctaaatgagccaaaacagtaggctgtaaatgggtctacaaaaccaaatatgactctagagggaatatagaaaagtttaaagtgcgactcgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaa

SEQ ID NO: 26229 - DNA, 1432 bp, Oryza sativa
tcatgaaaggaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcccagtgcactggaaattggtaaagaaagtcttgcgtgtttgcaaggaacaaaaggcctcatgatgtcttacagaaaagcagaatcgctccagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgt

SEQ ID NO: 26230 - DNA, 30100 bp, Oryza sativa
  unsure (1)..(30100): unsure at all n locations
gccgccactccaccccataaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatctacccaaggacaagtccctgctaatcaaaatcaaacgtagcagcatctcacaaagtccatctatcccattgaatgcgcacatatgcttgtgtgaagagaggagtattttttgtgattggagttttttttttttggcattattcaagcatgtctgattttcagtaaacaaaacaatcagccacatctgtttgaataatctgcttgaggtgaattcaaaacctccaattacctcatgtaatatgggtacatgatattatgcttccattagcccccacaaaaaatgaaaatcgtcgcactccttccgttcaaaaaaaaaaaaacaagaagacccaaccttacactaggttggaacatgttagagtttgtatatgtgtacaaagtcggttataatttaggacttggagttgtactaggtatagaactagagtaagagtcggactctatcctagtctctctcataaatagtggggcgtgactgttgtgaccgcataacgacttagcatagcgagaggaagcggttgccgacggcgtccgaccgtgagtcgttgtaactctgatacgctgtaatatgctggatcggggagtagcgcccgtaatcagtgctccgaagatgtaggcctcggctaaactctgttatcaaatatcgtgcctcggtatcgtcttcatgtttggatgttctatggcgttttttcgcgtttagctacctatgtcgatttcggaggtggttttataacatgacacatcctagtacaacgaatctagatatactctacgtctagattcgttgttatattaggttgcgttccatctagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaataccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatggtgacattgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccggcgtcggcgacctggtggcggcgcccaacatggcgcggcggtgccccagcgccgatgaagacgacgatgcggtcaggcctagttggcttctttattcggaatgggctgctccttaatgcctaatgggctcctcctcctgctagccaagcccagccgacttccttcttcggaattttgctcctcctgctagccaggcccagccgacttccttcttcggaattttgtcggaaatttgacggaaattaccgataaaaaacggttaccgacaaaacggtcggaaaaaaccccatatcatttccgctaccatttccgaaagagattaccgtttccatttccgataccgacaattaccgataccgattgaaacggtcggtgcaaaccggaaacggtagccggaattctcggaaatttccgtaccgttttcacccctagttccatcctagtaaaggttgggtttttcttgggacggaggccggcagtgtttggttttggtttggggtaaagatagtttgcttcaattaggatctttttggcatctacttctatccattgaagattaaaaacgaggttgaaggaaagtacaagttcgaatttttaactcgagttttccttacgaaaattataatttagaacatcagagttcaaacttccaaatagcaaagcttatggctggttagaacttgaaactagcacctaaacttgaacggcatcagagcactaatcacgaatttaggacattactagtagaccatcatgtttcatgtcgatcgatcaggacatgtcaatgtcaatgtcaatgctgatgctgagcctgatgagcatctccttggacgttccggcgtcgagcaggtggaggaagcacggcggcaccgtcaggaacctggcctcctcgtcgacggcgacctcgccaccgggcgcggcggcgctgctcgccaccgccgagtccatgtggacgaagtccgcggcgccgccgcccggggcgtgcgcccagagcttgcagcggtagcgcggccccgccgcggcgttcgccctgacgcacgccaccgagacggccctcgccacgccgagcgcgcccacggacaggacgaacacgcgctcgtcgtcccccccggcggcccccgcgacgaccaggtggcgccgctccgactccggcacgtggatggtgaggacctcgccgtaggggaccttgctgacgggccacgagtggtcggcgacgaggtgggcgaggagcatcggcggcgagccgaggaagtcgcagcgcggctccgagcaggagcagggcgcgtgcgggcacgcgcgctggtgggcggcgacgtcgtggtaggcgacatagctccggcagccgaacaggtcgttggggcacaggatcttggcggcgcggaggaacgtgtccagcccggggcatcgcgcgtagacgccgccgccgccgccgccgccgcacgtgtggcacttcttgcccgggacgtcgccatggcagctgctgcacgccaagtgccccgccgcgcactgcacgccaagaaatcgtcactagccgagcacctcacgaatcgacagcaagaagaagaataggtgatgaattggacgaacagctggtacctggtaggtcgggggcttgagggggaggaggcagagggggcagtggagcacggccaagtcgatccgcacgctgatctccacaccctcgaagccgtcgcccaccgccgcggcgatcatcccgccggcttggacttcttcttcttcttctccggctccggcggctgcagcagctccctcgccgcgcgccgcttccaccgccatttctcgcttgacttggccgttgggcgacaccacccacgccgccgccttcttggcgccgctctgctcgccgtgctgcatcgtcgtctacggcgatcggctcttgtgtgcgtccttgttgactgaaaactgcaacagcatgaacaaacaatcggtggttggttgcagtttgcagcaatagacgaccagagagagaataaaccaaaaggcatgaaccgggaaggggggggggggtcattcaacaagctcctacattatgaactttgaaaaggcatgaactttgttgctggtgcattgttgagtagcagtagagtgggaggtgaggtagtaaaactgtatttgtccatcctattttaatgtaaccatgagtttttacgtttaattttaatcgtccatcttatttaaaaaattttaaaattagtatttttattgttatgagatgataaaatataaataatattttactcgtgatttatatttttaatttttttaaataagacggacgattaaaattggacatgttaaataatggttgtatttaaaatggggatagagggagtacaaaattgttgtaataattatagagtggaaagttactctctttcttcagtatttcaaacgttctgggttcacgccacgtcaacagggcagcactgcatttactttagagtagtactgtagcagtatacctctgaattccagtaaaaaaataaaccgaaccatttgtaacaaaagagaaaaaaagatctttcacaagaagagatatgtgtaggagtaggttggcactgtattaaagcagaattgttacatccaaacatgaaaagaggtggcggttgcaataatgcatagtagtggcatgtgtatgtttcagtgaggtaaaatgttcagagtaacaagtactccctccattccaaaataagtgcggctatatttttccgcggtcaactttaaccgttcgtcttatttaaacaaaatttaaaaacataagtcacgagtaaagtattattcatatttcatcatctcgtaacaacaaaaatctaagtattaaaaatttttaaataagacggacgatcaagttagacatagaaacttatggctgtactattttgggacggaggtagtacagtagtaatactgcaacaaaattttactgcacaccagcgttggctattgaagcctgtacacgatatttctactaggatgcaacttgaagcctgtagtacgtacatttctgccacgcttgaagcctctatacgactatacgcctcttttgcagatatcgacttgaaagttgaagcaagctttggactggtagtccccccttcccaaaataagtttatctgattttaaaataaataaacctttttataaaaaacatatttagatattagaaaactatccaaatttctagcactagccaacctaatatcgaggatatgagacattatatatatatatccagattagtaggaggttggttattttttggcaaattttgccataggacatcgtgactttgcgattttaactgtaggacaccgcgcgaagtgatttttagggaacctctcaaaatgtagttatttgctggtggacaccgcacccattaaattaatgatttctgtgctgactagatgagatggctccacttttttatatgacttgactaaattgccccttattcctctttctcttcctatcttcttcctctctctccctcgatggcgcgcctcgcgatgaccgtgcggcgcgcgatgcagggacagagggcggtgggtgacacgatggcacactcgtctaggagtggcgaccagcgcgaaggtggagtagcggccggcacggcttgcggcgaccgtgcggcgcgttgtgggcggccggcgcgcgacgcgggggcgcactcgtgcaggagcggcggtcggtgcgatggcggagcaacgaccggcgtggctacgcggcgtagggtggcgggcgatgcgagctgccggcgacgtggcacagtgcattgggtgatacgagcagccggcgacgccgcacagggcattgggcgatactagcagccggcgacgccgcacagggtggcgagcgatgcaatggcgccctcgtgcaggagtgacgggccaccgcgaaggtggagtagcggacgacgcggctcgcggcaaccgtgcggcgtgatgcgggcggcgcgcgacacggtggtgcacttgtgcaggagcggcggccggcgcgatggcggagcaacggctggcgtggctgtgcggcactagctgcagcagaagacggccgctgccaccgtagacgactgcccccgccgccgcccccacgcccagctcttctctgctccgctccctgaccccacagcgccgcccgacgtgtggcgcttcctccctcgccggcatacggctccaatcagctggcctccctcgccgggttcctgcttgtgggttagcccagcacgagccatctccttcgcgtcgacatggaggacggagaagcactagcaatagcagtgtggaaggaggggatagagagaagagagaaggaaagacctgacatatggacccaaggacattttagaactttcacacaatttctctctccttttcacacaatttctctctcctattcaactggaaattattaatttaatgggtgcggtgtccaccagcaaataaccacattttgagagtgtattcccccaaaagtcacttcgcgcggtgttctacagctaaaaccgtaaagtcacgatgtcctgtggcaaaatttgcctttttttttaactagggagcataaacattggaccacctctcttcctcctctggtgcagcactgcgtgatgcaatagtcgaaatcatgcatgtgagcaatggcgtccaatttctgaaacggtagcatcatacatgaacagttcatcatcggttcacaaatctcaagttaaattactaacaacattagagtcaaaccgtacaaaattcctacacaagtcatgagttaaaccatactccattactcatatattggctagtgctagtcaatacacaaaagatcaagtactaataccagactgtcatcttaagcatatactctattggattcacataagcttcactgcaatctcctcagggacctggctcgtggagtggtgggcttggcaatggcgggagcagctcgatcgatgcggatgctgaggatcggcgtctcgccggacacctcgtgaagcagctccggcggcaccaccaagaacatcccctgctccgccgccgggaacccgccggagaggtcgctgctcctcaccttggacgtcatcatcaccatgttgtcgctgttggtcggcacctccacccacagcttgcacttgtactgcgccgccgccgcgtcgtcgccgttcgcccggacgcacgccacgcacaccgccgcgccgacgccgacgccgcacggggacggggacaccaccaggaacatggcgcggtcgtcctccccgacgaggacgtggcaccgccggggcagcggcacggcgagcctgcacggcttcgcgtagctgatctgcgtgacggaccaggggtggtcggtggcgaagtggccgaggagcgccgccggcgagccgcggaagccgcagccggggtccgggcaggagcagggcgcgcacgggcacgcgcgctggtgctcggcggccgcgccgtacacgacgtagctgtcgcagccgtacggcgcgtgggcgcacgccaccttggcggcgccgacgatggcgtccagctcggcgcagtgggcgtacgcggcggcgcggcggcagagctggccgtggttgccgcggcagccggagcacaccacgtgcgccgcctcgcactgcaaaaccacacaacaaaagaagatttgatccaaacacaaaaatccaagattacaacaaaagctatcaaacattcgacgacatgagaagaaaaacaaaaagaaacaaatgaaatcaagagaggaatcttgaaatgaagtgagagtgagagtgagaccttgaagacgggaggcttgagggggaggaggcaggcatggcagtggagcaagccgacggcgatcctgacgtcgatctgcgggtcgtccatggcggtggccaccaccagaggccccgtctttgcgctctcttcttcttggctcatctctccttcctccgcctcctcttcctcctgcttcacctcgacgttggccctcgccttcttgccgccggcgtggccgttctccgccgccgacgagctcctcttgttctgctcagccatttctgcagtctccggagatgatgtggtggtggtggtagtagtagaacaaaacgtagtaatcagttcattgcaagaagccaagaactagaaagcgagagagagacagagaatgtgttgttgagtcatgtggtgggactgggaagagatgagcatgagctcatgagccaaatgaagtgagacagtgtgcaacatcacaggatcagtcggttcccagaaacggatatggggattaactagcctctggacccaagatttgttgtttttacttgattgatgacacaagttgattcatcacgcattactgttgagttactacggactagttcagtaaggtagtgtttagttacaaattttttttcttcaaactttcaattttttcatcacatcaaaatttttctacacacataaactttcaacttttcagtcacatcattctaatttcaaccaaattttcaattttaatgtgaactaaacgtagcctaatacactgtttaaggaggcgacatataagtattagggtgtgtcacatttaaaaaaaaatatgagggagtatatcagtagccgttcatcattgccagtttgcaaccactttggccttcctttgccactatgcgtttgtttagggctgtatttagttactttcaaaggtagaagtttgggttgaaattggtacgatgtgactgaaaagttgtgtgtatgataggttgatgtgatggaaaaagttggaagtttagatctaaacacagcctaggagattagagatagaaagcacatcattttccacacgcacgctttccaaactactaaacggtgtgtcttttgtaaaaattttctatagaaaagttgctttaaaaatcatattagttcattttgaaatttaaaataattaatactcattagtcatgcaataataactcacctcgttttgcgtatcttcctaatcttctctatctcccctttctctacaaggtggtcagatcattggatcaagcaaccgtaaaggcgcaatgcaatttctcatgagaccttttacggtgtttgagagtacttaaatgtattgagaggtggaacaatataaaccattaattaaaagagagacaagtgtcacgccccgaactagccccgaacagaactagcccgtgacgctccaaattaacctgttaatcgataccagtcccaggaagacagaatatcacagcaacagaggtctctttattacagagtaggtgtacagtcatgttgggctgcggacagatcccgagctcacaactgcattacaaaagggaaagcggaagccaagacttggacccatcatcacaggcacgacttgggaactagaccgaaaccctaaaactcatcgtagccgacttgctcctagaaaaactcctcgtcagcgggatccacttcatcctcttcagcaactgggggggaattatttatatagagcaagggtgagtacaggagtactcagcaagccatgggaattaagtgtttaatgcaggcttcaaaggtaaggctgttgtttttgcaaatgactttatttaaactcctttttgaaacaactaagtgagtgattctcaaacgacacggatgaggcagtgcgtctcgtccggccggagtatgtgcgatgtatcagtctttgaattgattcaaggttggcacccggccacaactttcaaacggccacccgggcctagctgatcccatcagccgcagattttccaaacatcgatcccattccacaacagcaatttcacaaagcagtagtcaaacaaaactacgctaggaatcacctcacatccgcccatgaccgtgggcatggctgttcgaacagtttaataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaagggtcctccccgacaccaccccggcgaatccacttgtctctcggcatcaaggctcccctgattagctaattactcagccaggggtgccccattccacccatgtggtcgcactattgtatgctcggatgtaattccaaaggaaaacggtccttaagtgcaagagcgggaaaccgtactcccggtacatttcccgatccgcgattttggaaattcatttagttcgcaagcaccgacccaggtgtcgggttttccaagtcttttgtaaaacccaagttttacccatcgttagatattttaaatttgaggggaggtgttccgatgcgcgtgcccgagggcccgtgcatcgaagcacaacaggtgacaaagaaggtttaagtgttcaacaattcaaggagggtaattgcagcaattaggattgggggccggcaggctatctcgcaagccgcggccgaattacttgtgtaaatcctattcatgcaatatttgcggaaaagaaatacttagatttaaattatcggtgcaagatgatcaaaggtgacttgccttgctcgagatcttgagcttgatcctcgaaatcctcgcactgcgggtcttcgggctccgaaactacacgcaaaacgggacaactcaacaaacaacgaaaataaagctctattattgacctctaaacgtgccattaaatagatctcgagatttgaagaattttagaagttgaacagagtcaaaccgacatacgattaagaagatattgaatttctaagattattggatttttggtctaaaggaaaaaggatttaattaaacccttttgaaaaagagaaaagaaagagggaggggaaacagacttccctcgggcggctagggtgcgacccgagagaaaagggcggctcggctgagcttaatgggccggccggcccgagaaggcggcccaaggcacgcgcgggaggggaggagagggggagccagtgggccgggctcacctcgcgtggtcccgagcgggacccgcttgtcggtggcacggttcaccgtgcggagggagcacgcggcgcgcgctaggatttgggggagggacgcggtgcacgcgcgcggctcgcgggggtgcggttgcggcgggcccacgcgcagcctcatggctcatggtggaccgcgcgcgcgagcggggcagaggggagcggcggaccgaggtcggcttgacccggtcttagccgagctggcaccgacgtggcgcctacgtggctgccacacaggccggcgggaggttgaagacggcgccggccaaaacggacggcggacggcggctacgaacggcggggcgaaccacggcgataccggcggaagcgggcacaccgggtggttgcacgagacgaggggagacgatccaacggctcggattcgccggagggagctcgacggcggcggattgcggcggcggcaaccgtcggcgagggaagggggaaacggcgacggcgcgacgggaggtcgattcgggcgagctagagcatctacgcgactccgggaatccgtttctagcgtcagattggacggagacactacgagagaggccggcgacgtgtgggcgctaccgagcacgggcggcgacggcggcgagcacacagcgagcggcggcaacggtcggggcggcgccagctagctacggggaggctatacaagcttctaccgaaagctaaggggaagaggaggaacgaggagggagaacggggaggatgcactaccgctgtagaggagggcgctgtgacgagaggccgacggcacgggagtgatctctccggcctcaggccggggaagaggaagaagacgagcgcccagagtccccttccgcgtcctagcgcacaccggctcctccggcacacgcgacggcagcggtcggcgatagagagacagaggggatggcaatggcgtggtggagcgagggggaatggggagggaaaggaagggagggcgccttggtttaataggagggcaatgccggtttggaaaccgacctagggcggtcaaagagcaagctggcgctcggcggtcacggccaaaacggcgatagggaggatgacgccggcggggagaaaaaggaagaaaggaagggggaaaggagacttgcctcttgccactttgggaaaagaaggaaggagagagagggcgacgaggcagtgggaggaggagctctgcctccaatccttgggagcatgcgcggtggtggcggggccgggtcgtaacgacggcgatgacggcgggggcggtttggaagggcgcggctacagggcggcaggcgctgacggcggcggcgactggccggtcggccaccacggcgcgcgcgcgcgcgggaagcaatggcgcgggggattcaaaactcgggggcggggctcgccgggaagagagagacggggagggagagcaggagaacgagaaagagggagagctcggctcggcgtcggctcacgcgcacgcgcgtgcgacgcacgggcgggacgagggagaggagggctgagggagggagagagagagagagagagatgggccgagaggaaatcggcccaccgaacctaagagaggaaaaatagacttttgcggaggaatttgatttggggaggatttttggatccgggatttgaatttgacgatagatcgaggattcgagatcagggattggcacggagactgacaacaagcaaagaaacagatttcgcaattagggtttttagtatttaaattttcccgctaggcgccacgacggaacgggcgctacaacaagtacggaataaaattatcataactaatagcaatggccaatagagtaattaactactaaaagaagaagagcattttgagtgaatcaaatacctaggtccaatcaccagtattgttaggtagaaaacaaagtaaatctttcggacaattcaatgcaacaatcgatccgtgcttctgcaccagaaaaaaaaaaaagagaagagatcgacgcctcctttcttcgaccctggctttgttcttgctctagggtttgaattgttccactagaaggagacaaaggaggaaatatcggcacggttgagggttcaagatgggccgatagacggctaggcgcaagcgcatcgggtaatatctcctctgctcctatacttatttacacaattgattcgttatttacatagttaacaaattccttcgtataagcgactaaaatgagatatccctttctgttcttcttctagggtttgaatagttgaacctgaaggatatagggtcgagagagaagctctggtatcttgtttgttaacctaccatagcatgttcagatggatgcaatcattagaaatattttatctacagtttatgttttccatgaataaaatgcaaaacttaaattgacgtaaaccttgagtgatatttgatgttcttgggaacaaaatataaatatcaaaataactatgcaaataacgtaatggataattaatgggaagagttctacgatattcttgggaacaaaatataaatctagagaaaaccacgtaaattagaactttaatgctagtactacctccgtccaaaaaaaagtgcagtcgtggatatccgtgtccaacatttgatcgttcgtcttattcaaaaaaattgtgaaaaatttaaaaatatttagtcacacataaagtactattcatgttttatcatctaatagtaatacaaataataatcataaaaaaatttcaaataagacgaacggccaaacgttaaacgtggatagtgcaaaactgcacttattttgggacggagggagtatcatgcaaacaacttaactggtgccgacgcggtaccgatctaaatttgcagacaactctttcctctcatctctactagcaaatttatctttttgcccttggtacctaaggctgtgttcgcatgccctggtttggaacccatctcctccacacggaaaagggagcggttcattagcacgtgattaactaagtattaataattttttaaaaaatagattaatttgatttttttaagcaactttcctatagaaaatttttgcaaaaaacacaccgtttagcagtttgaaaagcgtgcgcgcggaatacgagggagaggggttgggaacatggagcaaagaacaatgtgtaaagtgcctatgccaatactcaaataccttttacagggtacttttcattatgaagcgttgactctttactctttttgaaatgcaaacaccgtgaaaggtctcatttctcatacaacatccttgtgttgcctcctcaagacctgaatgattgatatactgaatttctactgcgttgtggtcatgattgcaactcaatggtagcattgaacggtggttattttgtaaagactaaaacttggaagagttagcgtgcgtttggattaggaacgaagtagaatgaacttgactcatcctcgcatttagaggggaagatcctaactatccatacaacatgagaaatgggattatcttgtttttgagagataggataatgtggtccgtatgttagcgagagagaagtcagttagattactccgtcgattttcactgtataaggctggcatgaacctaagggaagaatattaattttaaagactgatcccatttcacgtgtctctaaaccaaacaggcaaacaccctcaagaagttagcaatcccgtgctgtggcctgaacctatggattgagtggtctctgttggccacaacccataaaaggccctcatcatcatctgtcattctgttgagcttgtacattttgtggatgatggattcagatcaatagtatatctggccttgtttagatctaaaaaattttggctaaaaacatcacatcaaatgtttgatacatgcatggatacattaaatgtggaaaaaaaccaattgtacaccttgcatgtaaattgcgagatgaatcttttaagcctaattacgccatgatttgacaatatgacgctacaataaatatttgctaatgacaaattaattaggcttaataaattcgtctcgcagtttacatacggaatctgtaatttgttttattattagtctacgtttaatacttcaaatgtgtgtccgtatactttaaaaactttacacccaaagaactaaacacacccagaactattttcaacagcggaaacaacataatagaaaattagcatggagtcattcaagttcatacttcatactactacataccatcttttgtcatacgttctgaagtcctgactggaacacagatggtagtattgaagtgaagcggcactgcttggcattgaaatgcaggtgatgaattttgtgtccaattcctggtgcagtagacttccttttacagacatgggaatgatgggatccacccacaaattactgcgggaattcaactgttttactgtttttccgtgaaattcttgcaaaatttctacaatattcatgagttgtgtattacttattggctagacatgcaaaagataaaccattctacagtactaggttgcattctttcccacagcttcaaagatcaaattagcacgcattccaaaatattgaacggtatgttttgtctaaaataattttatatataagctccttaaagaaataagtaaatccaaagtaatttcgttaatagcttatctagtgctaaaaatcaaaaccgaaacgctggagaccctaagcttcagtgcattcccttctgggacctggctcgtgtagtcgtgaacttgggcgtggcagcagcagctctatcaatgcggatgctgaggatggccgcctcgccgccgggcacgccgtgcagcatctccggcggcacccacagcagcatccccttgtccgccgccgggaacccgccggcgaggtcgctgctcctcaccatcgacgtcatcatggccatgttgtcgtcgttgctaggcacctccacccacaacttgcacttgtaccgcgccaccgccgccgcgttgtcgccgccgccgttcgccctgacgcagaccacgcacaccgcggcgcccgcgccgacggcgcacgacgacacgaggaacacggcgcggtcggcctccccgacgaggacgtgggcgggcggcggcacggcgagcttgcgcggcttcccgtaggcgatctcggcgacgggccaggagtggccggcggcgaggtggccggggagcgccgctggcgagctgcggaagcggcagccgggctccgggcaggagcatggcgcgcacgggcacgcgcgctggtggtcggcgacgcccgcgtacacgacgtagctgctgcagccgtacggcgcgtgggcgcacggcaccttggcagtggcgacgatggcgtccagctcggcgcagtggctgtacacggcggcgccaccgcacagctgcccatggtggccgcagcggcagccggagcacacgatatgcgcctcatcgcactgcaattaatcacaaacacaacaacaagaagaacaagaagaaattaaatcgagataggaatcttttttttaacgactcgcacaacatagtgtgaaattctattgatagatagagtaggaaaaaattacaggattataatcctaggccaacaaagaaacatggccgagatcgttcaaaacctaacccttataatcaacacaagcctcgctctatcaaagtcttgagaagttaagaagagagggtgagaaagaaggatcaagataggaatctttgcatccgaattagatcaacagagagcagtgaccttgaagacgggaggcttgagaggttggaggcaagcatggcagtggagcaaggcgacggcgatcctgacgtcgatctgcgtctcctcctccgtctgctccatggcggccatggtcaccagagggaaagctcccgtcctttgggtttcttcttggctcacttctccttcctcaacctcttcttcttcctcttgctgctgctcctgcttgacctcgccattggccctcgccctcttgttctgctccaccatatctccactccactccaatggacggggtagctgaccacctttttcttgggtcgcagatagatgcttttggcttcggtcactactgatcatttcaccaaaagtgagctgttgagtcatgccaagattgcaatgtgatttataagtacaattaactcgtgttgttgttgctaactaactacctacaaacaagcaacataacacgtgcatactggtcaattgattcagttaagctgaacatgaggcaatcaaccaacaatcaagtgccagtcagtcgctactgacgattgttgtgtctcttttgatgatgataacaagaagccgactgattacgcatgttatcacttatcagcaatgtactactcaatgatttgcccttgaaaagatgaacttttggttttgcactgaagacccatagcaaagaagaagatgatgttgagggagtgtgtcgtgttgagttgtcattttctgtatattgatgcctcaagtctgaagatatcgtaggctttctcagatcagtaataatcattcattgccactaaggtcagttcatggcaccaagcaccataaagatgggaattttgcgcctaaagatgtatagttgggttcttgcatgctttcaaagcaagttattcgatcgcaagcacctataaatatagccatgatacagtagttaggatcgtataatgcacacaacttgtcacagtattttctttggcacaaccttcgcatccacgtgtcggcttctagattcatgtatacgaatacagaaaaaattgctgctaacttttgttgcatgcagcacagcatctgaaactcctatcaggagaagaggtctgaagtctgaacctatatgatggacttgtccctgttggccaatatccacaaggcatccattatagcctctgttgagcttgttctttttttttttttcaaataatcgattcagaacaattgtatatctatttgcacacttgcatgatcccatcaatggagatatcactatcagtagactctaatgaacttgtaatacgtattgcaacagcgctaattgagctcacttgagctcgacgaagacgaggaggccctcagcctcagggggagcatccagcatggcgcccgggacgaacaggaaggagctcgccctgtacggcgccgtcagccgccccacgctctccgtctcgccgaccagcgacagcacgccgccattggcggccaccatgatcttgtacctcagctcccccttgtcttcttcttcttcttcttctgccttgagcctgaccatccacagcgaccagcctcgcggcgcctcgctccggtcgacggcgaggaggaacaccgccctgtccctgtcgtcgccggcgaggtacaccagccgggccggctcgccgtggcacattctgagcggggagagggtggtgcggtcgacgcgggtgcggccgatctccgggtgcttgcgctcgaggtgttcgaccagggacacgccggagtaaggggaggaggagcagccgcggatcgggcagtagcacggcgagtgggcgcacgccgcctcgtgcgcctcccgctcgccgtagggcaccatggcggcgcagcccttgtggttgaaggagcacggcacggcgagggcggcgaggaagtgctccatggcgcggcagcgcgtggtggtggcctccggcgcgcggcaccactggcactcctgccccatctccgcgacgcacgtcgagcaggtgatgtgccctctcctcatgcactgcatgattattaacaacaactataagcttaattgtcttcctaagctttcgcgtctcatggcaaacaacgacatgaacaatgtgatcaatattatagcacgcagattctcaagaattcaggatgtcgtaaggagagtatcgaaatagaagtagaaagtgttcaggcatggaatgctggttcagaatgttcagacagtcctataaatctgaaataatattgtagtatgatcaaagttcgatgattattcagcacatattcgtgtcagtttgttgaaacttgaaactgaatgagtaatcactggacgttctactacaaagagttaagaattgagacatttgcagataatgcagatatgacctgaacatgattaaagtttcttttctgaaacactgaaaaacttataacacgaagagcaaagtaaatactaataaacaaacttgtaaatggaatcatgatcagcaagaagaaggatcaatatatgcttatttacctgataaagtgggggagtgagagggccgaaacagacatcacattccagaacctcaggatctacagtgacagtgatagccctcttgtctcgagctgcactctcaccatccacctttcccttcttttctgaattgttctgctgcgtctctgaagctctcggacacgacctcttctcacgagccatctgtaaaaccgccatgttggaagcgtatcagaattcagaatgtttcagagatttcagggctgtcgaaattaatcccaatcggaattaggatgctaagcaccaatatgagaacaaattgatcacatatcttaaggactatactcgcaataatcacttcaatagcagttaatctaaatcctaagatcatcatcatcttcatctaatcatacagcccgtgttttcctcgcaagaaactcatgactgaagaacagaagaagcagatcgattttggtccaagagaacaaacaatcgttgaaagaagaaagttgctcaccttggtggatgatgtatcgccttctttagtggataattttaattctttttgtgtcggctaccttggagttggggattagcggttatcgaaaaattctcttgacaagccctaatattatcctacgcgatttcctcaaatcttacagcccagtctggcccggcccgttcgttcaaggctgtggcctcttttaggccgcgtcacatctttcagcccataagagttggcagactctactcacatggaattcctactcacatcccattttgatcaacacctaaggttcttaaggtcttttcaaaataatcatcattttacaagaaaatgtgttgcatgcgaccaactaaaattaatttttaggtttatttagggttaatttgatccatgccagtgcaaatatgccattccatataaatgccattacaattcgtttatttgtaaccttgacattgaaatttacaaaattagaaccgtgccactgccgtcacattttccatccatctcctcatctgcacgtgggtttcacacatcagattcatcttcttcctcgttactcccctcttctttctttcacatctctctccaccacttatccacctccccaccaatccatcctgtcctctcctctcatctcaccagacgcagcgagtatggaggttggtgcgagagcagctgtgaggaggtcagcgcgaagggcgagagtgatttttctttatgttaaatctgtacttttatgaaaaatatattcttaattctgtatttttttatgtagtgaccaaagtgcatataatttgtagaatttactaaaaaaaattaaaggcatattcagttgtagccaaaataaacatgccaaaattttggcaagttagcaatattgtcaaaattttggcaagatttcttatgtatttaccaaagtttggcaacaaactaagcgtagacacatttttagcaactaagctaaaaaatagtatgattgaaaatggcactaatctcagtaggccctaaataggtaaaaaaaaaatcgccattcgcacccacgtgccgacgcgaggaaccggtgtaacaggattgaatttgttcggagttcgtaacactcggagccgggcgtacgtctggatccctgacttatctgaatctgattgtgaagcatgcttttgagttgagtacaaacagaagatggaagaacatagcatccacaattgctggcctgaaatagtctgttaaactctgagctgtctctgtggttacagctctgacacttaatattcatattcatattcatttactgccttagattttcatttactgtaatagtctgttaaatcacttcgtattcatttactgccttagattttctagtgaaacatggctcacttcataattcaaaaccatgccaaaaggtcctaaagagtgtatagaactcttccccgcaaaaaaaaaagtgtgtatagaactcttaataacataccataccagatgattagcccaccacagtactactcaaatcctggcaatgcatgatattaaatagttagtgaggtgccatgggcgcaaagagcattgtattaaccacaacagtaagaatccaaccaccatcacccactcttcatttttctcaatcctgtatgggagcacccagaattccatcagttctataaacagtcgcacaagtcattcaactgatcactaataattacactgcctattagctttggtgctccgaccatcagcactctgacttccaactaagctagtatgcgctatgcagtgaggcccttgaagccatgacagttaccaaaaaatctggaaagaataaacccatctcacctttggacgtgtgcttgtaacccaggtgcaaaaatgttcgctctggaagcgttaactgctgaagttcgtgaagagcccctctatgcaaaatgagaaaagctcatcgcttcaaacatgggaagtgaaatctcgcgcttcattgctgctattgcttgcatgagttgttgcctgatgcagattcctctatgatctgattcatatgtttgcggaacttctcagcctggggaccaggtcttacaatgttgacattgctccattgggagcatggatcattgaaccacctttttctgcctgtgcaccaggcaccaggaacaggtctgtgacgccaacggtggagtactctttcatcaatcttgtccagcagcggttcattctcccgaaactttctagcaaaaggcactccgctctccactatctcatcataatgtgtcgtgttcagaaaatggggttccatctggggtggatcatcccattccatataccgcatgtcgctgttaactgtggagttacggaagtctgagttgcatacaactgagtggaaatacccttcctgaggtagcattacgtttgtgaagtacatgagaagagttcgagggagattctcccaaccaaatatgcaatactctataaaccgtcgatttagaatgacccacggagaacctgtatgtgaggaaacccatgaatcacagaactagttgatcaaacgaaggaaaatgaagtgaaaggagtcagaaaatgcctgtgaagaatttgaaaccatcaggagtatcacgtttctctgtggcttggaagaactgatttcttcctgccaagtatattccagcatctactatgattggttgcactctctgagtcctgtaacagtattacccacagcatgttggtgaaactaatacttgcgcagataaattatttataagttcagatataacatactctttccatccaatatcactagtgtgatcgatgaagttgagatgccttggcactgaggagaagacatgaatcaagtctgtagcaagggacaacataaaaaaacataaatatctgaaaagcaaggatttcaggctgtatcaatcaccataaacatgaaatatcagtcaggaaaataaatatgtacatgcagcaaacatcaactagaatgtaaatatcacatgcgaaactaaacaactgataggttgacaatatatagaagcggttcaagccaagtcgagaacgtaactgattttcttaaaaaaaaaatcaacaaagtaggttttctcaaggagataaaaaaatgacaggcagcacaagatctggggactacatattgcgatatggaactagtagtttagacatactccacttagtaaggaaaaatacgagatattcgtagtaagtggtcagatctaggaatgggtaaatatatgtattatactattaactatactacgagaacatggcactgtaatgtgcctgtcttcccatagaggaattccgagttcagtaaagggttaattacattggtttgcttgcagccaagaaaggaagaaagaaaatcccaagctttttcaatgataagcagagattgatgaaggaagagatgaaagggattcagcaagagggactccttggtgtacgcaggcatcagctgctgcgcagttggttctgatagcactgagaatgtaagtggtgtaactgtggttttcactgtcactcttttctgtttctaagttggaacatgcctttgtttcacacactagaggtacaacaatagtaatgtgctgtgcagtcatctgtcaccgtgttgcatcaaacttcattttcttctttatatgcaaaaatgtgcatggtatttgtgtgttctcaaaactaatgtattaacatgtgatcattagtaccggaattgtttaaaaggaggacaccataaagcctctgaataaagtaaatttaagaatatgcccatgaccacattacattgcacaatctaagaacaggtatataatattgctagaggacaataacaccgtgtggctcctacgtgcaatgcagattaatacatttgacaatttgaggaggggaaatcaagggaggatgactttggaaacaaagaagaaagataaggtttctacactcccactgacttgtgtactttacaccaactagactgcaatgcatgcaccctgtatcatggtaattatttgcatatgcgaagcaactgaaaaatagatgagacagcaaggatgcaaagataacagtatcagagcctcaaatggtatattcaagataaacctacacaagactacagtgcattctcacagtgatacataatgttaacttccaattgatctatcccttccccaccttctcactctcttgtagcgcccattcattcagttgtttgtaacaagccacacaataaaataaaacagaatgccgaaaccaactttgtctaatcttaatggtataaaagtgaggacttaaaaattaagatcttggtatacagatagtggttattcagatgtaagatgatcgcatgaatgctgtgcaatttccataacataaaacaattccccaactttctatcagtaatttggtcctggtttatcaatatgccaggttgtaatgagttgtgtcagaaaaaacaatcaagacaaaaatgagcggtcatatgagtatcacaaacaatcacagatagagtcgcatagctcaagactgacagtaatggccatggttcatgtgtcatgattgagttgaggaacttcactatgaaaagagaaaataataagtcattgagtggttgagttagatgacacctagaaactgaaaacatgccaattgagtattgtggtattagatttccacctaggacagcttttggtacaagtgtccaaaagaagtactccaaacaaagaggttcttccaaattgtccaaacctagcagcaccaccaagctgcttcctagtgcattggtcctttcaaggtatattattatgcatataagtgtacaatgtgacgagaaacattaactaccacttaagccaagttcacctcatatattgtgtaaaggaaaacaattattttttcctagctccagcaactcctatagtactaaactagcaaagatgctcctattgctaattttcatcgatgacatcattgatcccaaattcagagaaaagaaaagcttccgatcgaaatgcaattctggggtagctgtaacgaccaaaagtaaaagcgtgggattagtactagatccgggcaaggccgtgcagaaaccagcatgttccgaagcaaatcatgctaatcggaggcacgaattgtgaaccttaccgtcctgggtgacaagggggtagtcggcggcgttgagcgtgacgaaccagtcccactcggaatccaggcgcagcagcgcggccgcggcgcggagcgtagccgcgagtcccgaggatcccatcggtgtgccagcggtggggcggccaacgacatcgacattcccgaaggcgcgcacggcgggcgcggcgcgcgacacggcggcggccagctcgacgcgctcggactcgggcgcatcggccgagaggtggagcaggtagcggttcctgggatggtagaccgcgagcagcagccgcagcagcttcctcccctcccctctcccccccgacagcacgtacgcgaaggacggcggcgcggctgccccgcggcggacgtaggagggcggcgggaggcgcgcgaagagcgaggaggaggcggagaagcccgagagcgcggagaggaagagcagcagcgagacgaaggagaccgacacgagcgggaggagccacttgtcggcggctcccatggctgggatgtcagaggcggaggaggaggaggtcacggccgcagcatccggacggcggcggcggctgcgggcggcgctaggactccggcgcggtggtgggtgggattagggtttggcgagatcgcatcggggagatcggagtaggagctcgtcgcgtcgcgtacgtttctctctcacgcttcgcagacacgcacacacagaagaagagatgaaaggaggagacggaggaggagggaggcgagcgttgtgaggggcgctgtcgctttctacacccggaacacgtcgtaccccgcgcccgcctagacccttctgttctaccatcactgacatgtggggcacactctcctcctggcccaccggtcagtgggctctttctggctgggtgtacggggtatggggtgagtcgacgtgtgggtccctcggctcagagtaacgggggcggaaggtgcgttgtcggacggggccaacggcgcttgcctcgcatggggcccttgctcacgtggcagggtgtcgtcgtgggtcccacctggcagtggcgctgatgcttccagagagtggtcagcttggtgaggagaaaggcgatttcgctcgctgtcattagttttcgtttttttcaagataaaggacgaaatccggactttacttctcattagtcgttttctcttgttgattaagttaaactatttcgtgacttaggagtaagtaagtatctaccacgtactacaatctaccagctctgctttgtagtactttgtactgcctctgtgtgaaaagtgacgtggcacccacagattggctctgcctccacagatactaaaaagttcagattatgcttggctggctaggaagtttggaaagcctatctatcatggtctcgatgggtattgtttacttgtagtatctcaatttgatctccatggtggtcaccctccctggtccctaattaaccaacttggagtaaacaaatttgatcacccaaacaaattgttactgaagctagcttaccactaccaagctgaagtatagtagttactccagccaagaagaccaggacgaactgcaattaagcttccactgtctgaaagccaaaatgtcagaaatctcgtcggtcctctccttaaatcacgttataagaattgcaatcaattctgctaataactcggacgatccaaaaatgggaagattgctaacagccgtgagctgtctgtactacagtagcactttgagtttaggcactagtcacgggtcactctcattttcagcagatgtgtatctgaaatcagcagcatctctgaagctcctgagttggatgtcaggtggcacaacctggctgattctcacttgagagtcgtttttaacctcgctgtagcaaacagtttggagttttctgtgcagctagtagcattttaattttttactaaccgttcaaaaaatacaactctttttttttttgctatatagcaaaagttgttatactatctccatcctttaatatatgacattggtcgtcatatactgtaaaagaacagagagagtattttgggaccaagataatacactccattcatgaaaaggtcaaaattggatcggccagaatgaattttcagcgatgtaaatcagtaataaatccagccatccaagtaagtaactagctgcatatgctgttgcagcttgagtcttcagtttgttagttcagctagttttccttgagacagatgctgagtctgctgagatgcacatgtgatgtgcgtacggcatcaattgctgcgtgcactcacttgtcgtcagtttacacatacgttcagcatgagtgcagctacatcaagattccgtcagcatttatgaattcgtgacggagtttttgaattggaggaaaaaaatggaccaaatttgcagttccaatccgctccaagatttgttttgggtgattattactattattatttacaaataagccctcagctaatactccgcgcctctgcggagtaaggtacgtaaaaggtgtagccatgggcctgtaggctatagcccactgcaacagaaggcccagcacaattgggtgttacttacaggtgggcccatcagcctactacgcaaaaggcccatgacgaagaaggcccaaggcccattcgcatcggtcgcgcaacaaacaaagcaaccaccaccacacgaactccacgctaaacccccccccccccctcgtcttcctcctcttcactcctcgtcgcacgcgacgtgaaccttccagaagcttctagaacagtcgtcaggcctctctccgctcgtcccccgcgcgcgcgcgagatggaggtcaggggtctgggccagctcctggccgcgctcgccgcggcgctgttcgtccgcgccgtcgccggcccgggcccggcgctcctccctccggccgacgacgaggactccgacgccgacccggaggccggcggggaaggaggcggcgtgcctccggtgacgataaggtgggcccgcatcacctgcgccctcaagaacaagcgcggcgacgtggtgagtcgctctgcctcgaatcatccattccgttccctctcgccggaggagtcgcattggtcggcggcgctgcgcgcacggaaagaaaaaaaaaatcatctgcttaggattagccaggagagccgcgtgctgtctgagagactgacactgggccctacctgtcgatgtggcactgactcatcacattttagatgaacaggttgctgaaatttgtttcgcacttccgctgttggctaacgggctaagtaattgcgtggcattctgcagtctgtatgtagaattgtatattaatttgcgtcgaacaagtaatttgcgaaatttgtttcacactttcaccgtctgcactctgcagcttcaatcagtagatgaacacaccgaagctgtgtattctgtatgtagaattgtacattgagtgccatcaataatcggaatttcttgcttctgcgcgtctctgggtgattgttgtaatggttataacgtgctgcatgccaggcgaggtttttgctgtcaaatgcgtctggggaggcgaaatcggggaggctgcttnnnnnnnnnnnnnnnnnnnnnnnnnnnnnnnnnnnnnnnnnnaatgtgcttgctggtcagctcacagcatcaccttctttgcaccttctgggtttctgtacatcaatggccgacctatctcagaaggtggctataagtaagcttaagctatgcttcttcagttggctttcacattttttagtcaggtttacagagaagagctatactcattgcttttccttgtgtaggattgcttacgtgaggcaagaggaccttttcttctcacagcttactgttcgtgaaacgctctcgcttgctgctgaacttcagcttcgccgcacgttgactcctgagaggaaggaaagctatgttaatgaccttttgtttcgtcttgggctggtaagttatccatgatggtatatggtctgctttctaaagaaaaagttatccatgatggttaaaatgttcgaagaaattgaaccaattggttttagtgcactacatcaaatgttggatacgaacttgtagtttctagcactggtggagaaaatctgtcaaattacacatgaaaagcattgttattttggtgctcagatagatgacaagtatgctaagtttttcaattgatgggcagaacctacataatatctatcgctgtctgttcaagtatttccctttttattttgtatcaccaggtatttatttctttttattataactggttgtaggttaactgtgctgactcaattgtgggtgatgcaaaagtacgtggaataagtgggggtgaaaagaagcgtctctcccttgcgtgtgaactgattgctagcccttctatcatctttgcagacgaaccaactactggtacttttacctgactgtagtgtttatttaacccttccttggttgaataagcattctcatctcctcttaatgttttcgttaggaaatacatgactagttgcaagcaaatgttctgatcacttcttcaaatctactgtttctttgtaaatttgtgccatgcttcttttttttattggaaccagcacgagaatgtgctttttcattaaatatagcaggagaaaaatacagcccctaagggcaaagaaaaagaaaatttgtagccatgccggattcaagtgaaaatagattgccaatactgcgatagttgcattaaaatggcttcaatagatacaccacatttttctcatgccacaagaattgctttaagatgatgcatgtttcttgtactaagactgctactctaatggttaacacatgacatatcataatcttggtggcatctttaatcaagcaccatggtattgggacttgccttattagatttgtcattgaatgctgcaaacaaaatatattcttgatatgatatacaagctacatcccttctggacaaagtgttgcacatttactttatctgaagtgttgagcttccatgattagagatagcgcattcat

SEQ ID NO: 26231 - DNA, 12839 bp, Oryza sativa
atacatggggccagcaaaagaggaaccgttattgtactttgcatcattggggttggtattcgctcaccttttcctttacttggcatttcctgttgttttcgatgtgtgcattgtactgattttatttagactgtaatactctactaccttggtgcataacatgatagtggtcatatttgtccttgttagtggcactatccaaaattccagtgtacggtatgctagaattttactcagaattttaattaggcatgcagattctggcttgtgtacttgttcacaccataatggagattatcttgcttttataagttcttttatctattatcagatgtgttggtttctatattctatgtatactgtcaatatgctatgctgcttgtttttctgcctgctattattgcttatcaataacttgagtttgattacttcatatttttcaggtatcattgtccagatcatgtgaaccctgctgagttcttggctgatctcatttctgttgattatagttctgctgaaagtgtgcagtcatcacggaaaaggattgaaaacctcattgaagaattttctaataaagttgcaattactgaaagcaacagttcgctgacaaatccagaaggctctgaattttctcccaaacttattcagaagtccaccaccaagcatagacgtgggtggtggagacaattccgtttgctgtttaagagagcatggatgcaggttttattaaaattcatttaattctcagttgcagcttcctcttttaatctgcttcccgctgcttctttaaatcaagttgatatgtttatttattatttgctgtggaagttatcagatactcgtgaggcttcctttcaaaaaaatcgtttttcttacatattcttttagcctgagtaaactatatacataatgtaatgaatttaggaggtttagatcgaacatgttactatatttgagtttggatccatgatttagtttttgccaaatctgtgcctcaaaaaggtgtaatacgcaactgcccatgaaacatacttgtaaacaaaaaagaaacactttgctaatggaactatgaggatttggattgtggttgattgtaaacaaaaaggaaacactttgctaatggaactataaggatttggattgtggttgaggttatctgactaatgttcaagccttttatagtttgcctgggtacccattaataatctgagcgcagttgcttagatggggtttagctaaagatttactgccacgctgttgtgtctgatattggaataggaccttctgtgttttaggctttccgtgatggaccaacaaacaaagtgagagcaagaatgtccgttgcttcagcaatcatatttggatctgtgttctggcgaatggggaaaactcagacttccatacaagacaggatgggacttcttcaggtagaatatgttggattttttatgactcgttgagttgaatttgctaggttgcacatgcttcagattttggacttacattcattctcttcctaatattgactttggtacaagctttttcattgtgtctgagcatttttctgattttgatctgtccctttttcaatttatgagttaaggtaactgctataaacacagcaatggctgcactgacaaagacagtaggagttttcccgaaagagcgggctatagttgacagagaacgggccaaaggttcctatgcactaggaccatacctttcttctaagttgttggctgaaattcctattggggctgcattcccattgatatttggatccattctttatccaatgtctaaacttcatcctacattttctaggtaagtattatcctccctctaatttagaaatgaatctgaggcactttattacatgccacgcagaaatagtagaatatcgatagttcgatactattttgtttatgctccatcaaacaacattccatgctacactttcagatttgccaagttctgtggcatcgtgactgttgaatcatttgctgcatcagccatgggccttactgttggagctatggctcctacaacagaagccgccatggcccttggaccatcccttatgacagttttcattgtatttggaggatactatgttaaccctgataatacccccgtcatttttcgctggatcccaaaagtatccctaattagatggtaaccctcttccttatatcatattttggctcctaagctaggtgggaccgtgggatagttaatgaccctatatttcaactttgtttgccattgatttcagggccttccaagggctttgcattaatgagttcaaaggtttgcaatttgagcaacagcattcctatgacattcaaactggtgaacaggtacggttgttcatgtggacctgcaaaaggcagttttacatttttactgttacaaaaatgcagacacacacttggttaagtgccagtgagatattgctcgacctaagttaatgtttgaatgataatgcactcaaacagaaaattggcccagacactattcatgtgttatcatcacattcaattaaaaatctgaattgaaaattttccttgaattgtaactggggcctgggtaaaaaggtgaacctttggcatatctttcttctatggaggggaagtgatctgcttttgacacattacttctatggcaggccctggagaggttttcattaggaggaatccgcattgcagacacgcttgtggcacagggtagaattctgatgttctggtactggttaacctaccttcttctgaagaaaaacaggccaaagtatcagcagcttctaccaccatctgaggaagatcaaaataagcagcaagttaaggaagtgaaatgaagtgctgccagcaacattttgccagcaaaggtaaaagagacattagcattaaccacgtttcacacaatggtcctaatctcctgaaatattttttgtcaggatgtactgcaattagaaaacgtaactgttgtatcatattgagcattagttgtatggccctttttgtagttaatattctttttgtagcatctgaatgggaaattatggcctaaataattttgggggtagcaagcattccttcattctatagtcttgcatctatagaagacttatccccattcccagaatgactgtcttgttatcaagcacatcgtttttagttgcccagaaatgcattgtcatcaagttgttgtacccacttagattaacattgctagaagccgagaactctgaagcctttataagatctaattgctacagatatggtgtttgggaagtagtttagttgacagtagcataaatcaggaatcatgacccatgttgtaaacttcaagatccatgcatcttgtgtttcttgtgacctctaggcactcaattctgcaattgcttcaagtcttgaacccttgagcccatttgagtagctttgctgatgatgccatatactaatatctccttgaccatgtgccaactgatggcagctagggatctgcactagcattcaggctatgtgataaacaacttagccaatagtatgatagtactataatttctcctctttgccaattgctaactgttttctttttttttttcttatcagagagaagctgcaccttcttcacagcatctcggcatgagaatgagaggatcactaaatcatgcggcaataaaacaattagccgcccaagcccatcactttgaagcagtacatcaactcaactgaatgattaatttcctcttttcttttttgtcaagcaagtactcgtagtaatagtattcaactcaataatgggagatggccggtgttggttggaagcgacgagtcgctgcattcgatgtgattacttctaaactatttattgttccatgattccttccctgaataaatcaccggccaaaatgtgccatgtggactagtacttcctggttgggcacacgtgtctccacgtggttggtccagacgatgactaaatcagttttaatcttcacgcgtttgcttactcctatatatatatgtacccatttgaactagatttctcatcagctcagagattgttcatttgttccattgcttcttctcttgatcacttgctacctcactactgcgatttgccaacaatttttttggtttttggatggccatgtcgtcgtcgatgtcattgcttacgtcgccggccgagctcggccggcgcgggccggcgttgaaggcgaggaggtcgtcgccggcggcgtgctgcgccttccggcgagaccagtacagcggcggggcgctggtggactcgagcatggcggtgctccggcggaggatgagggaggcgaggatggcggagaacaactacgaggcgccggcggggtggtcggcgtgggagaagcggtactacccggcgtacgtctccgacgtgtccgccgccgtcggcgcgctgcagctgctgctcatgggcacccgccccagcgtcgccatcgccgccgccgcgctgctgttcgccggcgtgccggtctccgccgtcgccgccgtgcaccacctggcgcagctggcggcggagtccgccgtgctcctgcagcaccacgtcgttccttgaccggatcatcatctctaccttgcagctaaaatgttgcctgaaactgatttccaacttgtaaacaagagtgtgttagaaaggaattaaccctgcattattatcgcagtgttaaatgtagatagaatgatatgctatacacagctgatcttgtgtagttgatcttaaatttaatttgttggtgattttataagataatgaaagttttattaaactcaatcaattatatcgggatgatatatatgtctatagaacaatctcagcctctatataactaaaatatacacggctaaatacatacactcacaaaccaaggtgaaaaaaattacaggaaatattaaggtaccatcaatcctgattttgtcggtgatttatcttcaagggtgtttgttcttattactttctttgtacactaaatgacggtttcgattaaagttaaatatcaaaatatgtctatatccgatgcgtccagtggatacagttgtccgagatggagagtctgcttggtagagctccaactcctaaattatgctccaggagttgggtctagagtggagttgtgaagcattctaaacccagctccacctctctagttcattctgtgagagtgctccacccaactccgctcccatttccagtggaactgaaattaattgtttggctaggctccagctccaggagaggtggagttggagctggagctgtgccaaacaggcccagaatctagcttgaacactgataaaacataagtggagataaatatattccaaatgacgaattatatgatttcttaaagcaactttttaatatatatactccctccatttcacaatataagtcattctagtatttcccacattcatattgatgttaatgaatctagaaatatatatctacctagatccattaatatcaatatgaatgtgggaaattctagaatgacttacattgtgaaggaagtattttttaaaaacatgtttttagtagttccaaaaaagtgcgtacgaaaaacgaaaaagttttcctctatttaagccattgaagaacgcggccttcagtaaacaaaggagatttgtaatacaagagccatgagagggaaatgtcctcctatatgaagtactattcaaatatcacaagtgccaacgcatgaagtagatcagacactcactatgtgggaaaatgtacaataatattgataattgattatggaaggagagatggtgtcagaaaaaataatgtagaaagtcaaacaaatgtgctaaataaaatgtgcaatttgacctcactcaaaggaatcttcaggaaattatatccaataatcgatatggaattataatacgtatatatattcgtctctgaaggaaccagcaaataatcaggagcttgatcttcagagatgaccttgctgctgattaatttcaatggaccttgcccaacaaatactaggattatatttatataacgcagtatggtcaaagctaaaactaataaaccggcatggaaattatacaaccatttgtgcgtcaggcagtatgtcacatgaaacatatcttgttgtatgattaattaaacaaacaaaacacaaatagtaggatccacctgcatattaattagctagctagcctagctagccgatcgatctaatcaattatatccaggagaaaattaaagcccttgaaaaaacgacattggctagctgccaacattgaagagatatcttgctgtgttgaggactggagcaacgtttcgttcaatgcatcttggatcgatgacggcgacatccacaactccagtaaaaagaatgaaaagatgacagagctagctaatgccaatattattattattattatatattgtgccagaagaaatatatcttccaaaatccttttatctccttgcaaaaagaaaattcctcttagctagaagaattttacaactttctttttttggaaaaagatcatttttacaacgattttcgatcaatcaatcacgaaatgatgagaagctttcgttttctttcgcttaatttgttttgtttcagacgagggattaagctgtcgtccaaccaattaattaatttgctgttcccccgtttccctgctacttacatgatacactacgactaagccagtactaacatttggtgagaaattaagtgcatacaagaattaattaattgacgaaatgcgcgttgcatacgcttttacgcgtcttgcacatgcgtgcgaacgacatttacgtacgtagtaaacgatcaccgtcgtttaattatgagcaagcaaaaattcttattatgaataggtaactcagctccgacgaacggcgacaccggctgattagctatatacttcccccgtttcacaacgtaagtcattttagcatttcctacattaacattaagattcattaacatcaatattaatgtgagaaatgctagaatgacttacatcgtgaaacggagggagtagcaagtgcgcatgggttagcttgatgatctggtcgtcacatactctgctgctcttttctgcttcatggacaaatatatatataaatgtgcacattttcagaatttctaaatggtgggaatttttttaaactaaactttccacatataaacttctttaaaattttgttttaaatatgtatattttttaactttataataagttaatttattcattagtactctatcggtcccataatataaaggattttgggtggatgtacaaaaggagtagctaaaatattatgaagtactttctctttccaaaaaataagtttatttttttactcatcccacacataccgatataaaattaaaaggactagaatacccttactttatcaaatccgagtacaattattcctcacttacctatttttgatgtaattatttcatattttcataaaccctaatacaatgattactaaaaataaacttattttaagataaataggagaagcaaaaataaatttattataagacgaagaaaataccataaatcatttagttattcagtccttccagcacaaaataaatggtcataatgcagttatgctaggctgcttcttgcttatgctagtactccctccgtctctaaatgtttgacgccattgacttttttaaacatgtttgatcgttcgtcttatttaaaaaatttaagtaattattaattcttttcctatcatttgatttattgttgaatatacttttatgtatacatatagttttacatatttcgcaaaagtttttgaataagacgaatgatcaaatatatttaaaaaagtcaatagtgtcaaacatttaagtacggagggagtataatctataatttgtgcatatatgctggaagaaaagtagtgcaagcaaagcgaagatagctagctgcatgctgcagggagcagaagaccagggagttaaggaaacgcgtttcgtgtggagccaatcgccggccgcttgcttaattacaacttgacccactattgatgaacagcactggctaggatattcacacaatgatgcatgataggatcagtacaagcaagcaacagcatgatatggtacagcaatttccaacgaatttcgatccactcgatctctcaacgcgtatatatatcggccgaccggcgtcacatcgatctatcgtccaaatccaaccgtgtcgcacttaatttcctatatccgcctacgttaatccgcaatataaaataatgattaaacatgttttaggctcatttggaagaaaagaactgtttagtttttcctgaagcatttgaatcctggaaataaaattcatatgaagttatctggaataaagagcatgtccttaaaagttttctatgaacatcctaaggaataaagcattccattacaattttagactaaaacaaacatgagaaagtccaactcatggttttctcttcctgtacatgtctacaatttctttttttttttgcgtgtgtaatccaaacgactgttttgaaatactcttgtgcagttgtgcttctaatttatgtaggaatttataaggcatgtgacccgtgttctttatatttttgtgctttcaaattcgtgtgtttcaaaggactcttagtctcttgggtgcgtttgagacgaggggaaatgaattgtttacagcaacttttttagagattatttttaccaaaagcgtacttcctccgggttgataatacttgtcgtttcgataagggcacggtttccaaaaaaaactactttaaccattattttttattataatatgtacaaaagtgttaataaatatatgattttattaaagtaccttttaagactaatctatacatatagtaaccatattgaaagacaaatattttaaaaataatttataatcaaatattctaaagtttgacttcactcttatctaaaacgataagtattatcagcccagagggaatatcatttaacagcttgaaacgaacatagccacgtcgacgtgtttcaaattcctatgcttgaaagcactttcctgtaaaaccttttttttaataaaaaatacgttgtttagaaatttgaaaagcgtacgcgcgaaaaataagaggtacaagttataaaaagggataaaagaacacacatttaggctctgttcgtaattcccaactccttccgcctcgtttttcatgcgcacgcttcccaaactgctgaacagtgtgttttcttaaaaacaattatatatggaagttgcttaaaaaatcatattgatctatttttaaaaaaaaatagctaatacctaattagttatgtgctaatggaccactccatttttcgtatgcaggagatttaagttttaattagtgttcccaacccattccagctaacacagcctaatgtctctaagagtccatgtcgacattctaaatgttgaataggccgaaagaaaggggtcgagggaggaaacaattaagaacagaagaattataataatttttaggacatgatatgatggagcttgtagttaaatttaactcatttctagaacagctctcctttctgttaagacaactaatgttatcttgaccaaaactatcctggatgccacaatgtctgaacttttgcagaaaaaaaatgataggtaatcacacggaatcagccattggaacgttcttgccacgcgtttttttattttttttaaattttttttgccaacaacgacgcactatatatataaacccaagcaaccagcccaagctccaaatcaatcaaatcgcattccaccaattctccactctccatcctcctctaaaatccatttcaaattcgcgattctgattctctccttaatcgaatcgcgaatttcgttagctgaatcaaatcacagcattcgctagctgcacaattcttcttatcggaatccaaaaatgcaaccggcgatctcccaattccccgccgccgccgttcgcctggctggaccggcgctcccataccggcgaccaccacagaagacgacgacgtcagtgacattgaggaagccggcggcggtgaggtcgcggcggcgcgacgacgcggatcagttcttctcgggcggcggcggcggcggggtggtggacgaggggatgatcgagctgcggcggaggatccacgagatgagggcggcggagagcgggtgggagccgccggcggagtgggcggcgtgggagaaggagtggtacgggagctacgacgccgacgtgtgcgcgctggtgggcgccgtgcaggccttcctcatgagctcccgccccggcgtcggcgtcgggatcgtggcagcggtggcggtgagcgttccgaccaccgccttcgtcctcgtctccggcctcctccatgcctcccagtctctcctctccaacctccaacactagaagcttagcttccaagctaaccatggatgatcacacttgtgttctttctagtttatactaatttaattttatctaaaaaaactagtatatgtaatgtttgatttgattatcgtttcaattacaggaaaagaaatatagattgtcaaattaacatttcgtctacatgaatattcctttgtatatgagcaattatgaattactcctaccaattgttatctccatacaaaaatgtgattctgacaatgcattttgacaagtactatttgtccaggtgtataggtataattattttttgggcgacaaagttaatattgttcaagcacaatagctagcaattcttttgatagcgtaatcttaacttataattctggtcctcgcaaaaaaaacttataattctgagagaagttgagaacttgtcctgtacgccttcagcgaaaatcagagatgtaaaccatttctattattaaaaaaaaagcgagctagcaaatggacctagtggtcacgcatgttttggctcttgttgggcatgagatcaatcagaaataaagtctctacaatgaagatacagtgtgctaaaaaaaatgtgaaaaagcagctgaaaaccggagagtatcgctgtttgggccggctagcaaatggaggcccataaaaacaaagatgaacgaaccagacgacccacaaacgaatcggatcatcacacatgagttggccatgggttcgtcttcctcgtcgatcgccgtcgaccacgccgccggccggccacgaagatagcaagctcggcggcgcagcaaatgcaaggtactagtaaattaaatggatttgatcttatctgacactcatatcgatctgtaactcgaaaaacctagataatttttggtagatgtcgggaagtatcattgtttgctacttttaattcggcggtttagggtaatctgcaagatatataacattgaatggactgatatagggtacgaaccgccagttgctgtctaaatttttcaaataaacaatctgggtgaagagcaaaaaggggactatgtgtagaaatttcagtgttacagattgccggactaaataacaagcaggaatggtttgtgttacacttcggaattaaccatatagaaggaaaaagagcacccttctcggtagaaatgattaattatccattgatttataagtacaatccacaagtacaaaaaaatatcttaaaacttggcatttgagtattgtgaaacatcattcagatatacagaatgacaggactagcaagcaggaattgttttatggttacacttgggatttaacccaatcatcaactaaagaaaactttctttgatcaacgttctccactccatgccggcaaaggtttgcatcagtcttccatatttctcttcttccaaacaatagacatcatataatctccattctccaggacggatctacacctaatatgtttgcatcagaatcaatctcgacgtgttaatgctacaaaaaaaagagcaattaacaaagaagagcatatgttgggccaaagaaagagaacatgcatagcatgatgcacggttgccagtgaggccaaataaccacagctgcacactgtcagtgagtagtacagtacacataaacagacgaacatgtgatgaccggtgtacgaagcaatgaaaatactaagagcggctagtagatccaagcataagggtatctgatgcaaatctatcagaaccaggtgtagcaaaagggaaaaaaagagtggacacaagcagtgttcaggagagatagatcaaactgtccaaagagcaaagcaagatctaacaacatctgcttgtccctacaacagatggacaacacgctggtgcaaagacaaacagtgatggaataattcaacagtgacataacatctcaccaacaagggaataaagcgatgcaaagtacaccattcaacgcaatgatacccaaaaaataaataaatctgaatctcttgattagctaaagagatcatacttcagattgaaacataagaaacctttacatgtaattaaaaataacaacagtggctgaagtaacgccaaaacaacgaagcttgcaaaaccagatcatctctccatcgaatatgcaggtgctatatatgactggtttgaagtacaagcattatcaaaaatcattagatctacacatggggaaccaggaaaaaatcaaatccaacatgaacagggggcaaatatataagacatgcaatcagtagtgacatgtactactatatgggatcaagatgcagagctcccttcaatccaaagagtggtcagcaaggagttgattcggctccttggtcatgcaaaccacaagcctatctcttttcctatgagatagaatagtgggaacca

SEQ ID NO: 26232 - DNA, 689 bp, Oryza sativa
gatccccccggttttttgactttatttctcttcttacacatgcatgcatgctgtcatatgtacagtgtacattgtctgatggatccgcacgtactctctcatctgctttgaataattattaaattatcgccgatgattcgaatatatttgtacacgcacgatcgatcgtgtggttgctactagcttttgatctttgtcgtcttgttcatgttctattagtatatgatcacaatcaaatgccctggtcaccaaagtatgctgtttcgaacatgtttgaagtcaaactttaaaaattactctctccgtttcatatattataacacttcaaatttatcataagttatttttttaaaaaaaattagctgagttcatagaaaaatgtaggaacattttcagcatcaaaattagtttgatcattaaatccacccttaaggtctatttgttttgtgttggaaacggtgctacatctttgtatgtactgtacacttggacaaatttgaataaatttgacctaactatagatccaaaagcatcgcgtaatatggaatagagcaagaccaacaccaattttattaaaacaattatatcagatttatcaaaaatatatttttagatttgccttgaaactttacttccacaaacactattactctctccgtttcataatgtaagtcattctagcattgccc

SEQ ID NO: 26233 - DNA, 408 bp, Oryza sativa
gactttatttatagtgttggctttacataggagccagcggcaagaacatgaaattatggaatttacaatcggtaatccatcctcatctgtgttgacagaggatatatgaccttatccgataagtgatcaatgatgtgaaaactgggcgaacgactgtcacagatgtcatacatcttagatgggtttcaatattcatggttcaattcacccgtcacggataactcatatgtgatgggttacaacccaaaccgattattaaaggtgactcggtcgtcggtaatgagcgtaggcgtagccgtgaagcccaatcttcacattctcgagaaaaaaaaaaggtccaatctttgaattttttttttgtctgacacggatgaatacctgacaaatcgccggcctccgtcagcccgt

SEQ ID NO: 26234 - DNA, 405 bp, Oryza sativa
aaaacttcactgtgtaaagaccattcatttaattgagccgctctaaactgctcgaaatgggtagtttattttgtgaatcggcaaaataaactgctaaagctatccaatagaacacaaaacatgaattaaggtaaactgctaacaagatccctcagaaaacttttgtttacattgtagtcctcccgccccttgtaagtttgaacgcgtccgtcccgttgagttcggttatgtggaatgtatttataacgcatcataacttgttgttgaattggctgtttcaacaaagggaaattgacatttcaaatgaaccatgccaaaaatttgacaacatttaaatgcgggtattaggacttgttcagttcatgacctaaatgaattacaccgagaattcagcagcatttaaag

SEQ ID NO: 26235 - DNA, 1167 bp, Oryza sativa
gaaaaagtacgaattactcccccgaactatcgcggtcgaccgacttacctccctgaaccacaaaaccggacattcttcaccccccaactatgcaaaccggacgaattacccccctcgacccaatttgcggtggttttggtctacgtggcatacgcgtggcagcccagtcagcattatatttataaaaaaatgtgggacccacatgtcatactctctcattcttcctctctctctcttctctctctcgctctctgtctcactcttcctctctctctctctctctctctcacggtcatgggtcggcggcggcgggggacgaggaggaggtggcggcggcgccgacgggggacgaggaggccgcagtggcacgggacggatggacagaggccatgacgaggaggcggcggcaacgcgggatggacggacgaaggcggggacggcgggggacgaggaggccgtggcggcgcgggacggacggacggaggcgggggtaggttgtgggcgggtgtggacggtgccgagagatgcgtgctggtggcggagctggtgcagatgcaaggcatcttgaggcaactggaggtggaaatgggcacacatgggggcgttggcggcaggggtagggcggcgatgtcgtgtaccacggcgaccacacctgcgcgcacggagcaacatcagcagccgacgctgccacagaagtagaacgccgtcggtcgcattcacctccatggccgtcaacgcatgtcgtcgtcccccttcgtcgtcgtcctccactcctccgtcgccatcctccactcctcatcccccgccaccaccgacccgtgagagagaaagaggaagagtgagacagagagtgagtgagagagaaagagtgtaagagtatggcatgtgggtcccatatttttttatataaatagaatagaatgctgactagactgccacgcgtacgccacgtagaccaaaaccaccgcggattgggtcgagggggtaatttgtctagtttgcatagttgggggtgaagaatgtctggttttgtggttcagggggtaattcggtcgactgcgatagttgggggggggtaattcgtacttttccctttttgttatgtgttcttctactagaaccttattgcttttagtttgaaacagattattgagcagattgttgcgg

SEQ ID NO: 26236 - DNA, 790 bp, Oryza sativa
tagttgtagtagatagcacactgttcttgtggttgaacataactagtgtagtgatctgatgggctgaaatgtatattctgacttcagttccctgactgtaatctagcgctggcgagctaattaaagaacgcataggctcagctagcatagtttgattaagaagcgctcttctgacttttgacagtggactctgttttcttgtagttaaacgagacttggaacattttttttcctagttttgagatatagcacatgagattagtaggcactagtaaagaaagacaagccaaggatcctaagagataatctgctggtgtttggactttggacagctacacatgatgatatggacatgcaccaaactatacactagtacttgtgcgtgtgaagtacatgtatccgccactaccagctaaactagctagtgagccaagttagtgcgtcacgcgagaaacaatcgaaaacgtgacagtcacaacaatatggtaatgttaatgtactcggaagtgccaatctatggagcaaaatgtagctagctgttgttgcaacgattgcattggacgcatctacctactatcgtagaaccaaagcagttttagttaagatttcccatgacgcattcactcgtccaggtactagtacatgtttatttcctcgtggtgcaactagctagggccaacgaggcgaacgtgaacttggtaactaaccattaatttgtacatgtgagacggttctcttgataaatcagagtcagattcaaacagtgtaaacactgtaggctcgttcgtcc

SEQ ID NO: 26237 - DNA, 1145 bp, Oryza sativa
atatgtatatacaagtgttgattaagtaatcactcatttgaatacgttgttacttgcacacactgaattgagccataccgggtgcattctcctcttgttcttgcaaggccgctgcacgccatgagctcataaacccgtagcaacggcggcacaagatattgttttgcagcacggcaggagccggctggaccgctggaatatgctgctgaaccgccgttcgctttcgccactatttgttgcgtagaaatgtagaatcgcgtccattttcagagatatggtgatcttgtgtgggagcagtgctgcagcggctctggtggggtccccgacgattcctccagcccgtagttactatccatccaaaatcattttgcatgacgttgtcctctcgatctcgattttccacgttccaaatatgcgatggtagttcgctcttgtcccaaaaatggaggatagcgtacagctcagtggatattcactttttttaaaagaaatacacagtacaacagacactcacaatgcacgcatactcacccctataaaaacgcgtaagcaacagtggcggattcaggaaatcgattcgttggtgtcataatgtgtctatcggtgctatagtatgctaatcatgcttagattatggtgttataacatatgggtaaacaattttgctatagttttgccaaaagtcgtcggtgtcgcctgacaccggtccttcttctactgtatatccgccccttgtacgcaaaccctacccctataagcatcttcaaagactggaccagcaaatcaaatcctagagattggtgaagtcactttaggcgtctcactgtcgacgggcacgtcgcctactactgaaagcacaataccgttaaatcctgaaaaatttgctcccatggggagtcgaccccagcacctaaggtgctaaaatttcaatgcaatatgaatggaatgcgaacagtaagctgctacctacatccataaatataagcaattttagaatgagtacacgtttatcgatctaaatggaagaaaaccgataattgagccttgcaatatccattaaagggaaccggatcatttcataaaaagtgaatcgggattttttttttcttagtgctataagattgaaataatgatcttccgatgct

SEQ ID NO: 26238 - DNA, 936 bp, Oryza sativa
tggttgttagtacagcgcatgggcttaagttcacacaatcgaagatagactaccatgacaggaacatcaaggacatgctgtgccagtacgctaatccaccaatcaatgtgaaggctgactttgcttctgtgatggatgttctccagaacaagctgaatggtaagatctgagctttagttaaccccccatggccgttatcttgcttattgtcaccatgaactcctttttctgcatcttattcaactgcagttgatgaacttggtgtgtcacagtaatctttaatttgtagtactaggttttgaggctcttctaactatacacataagtggatagagctgttccttgtactttatatatgtatcatataatatgacaataagtggttatgccctagcacttaattgaataattgtttcgaatggatacctgtgactgcctttccgattgcttttactcactattgtctgtcaaattgtcaatgacaataagaaaccctctttggttgcatggtttgaagtctgaactgatagaatttattaaacatttcagttgctgcaaatcgctttagttttgttagtcaagaattcttttctgaaaagcataatataatccttgttctcaagacagcaagtgttatatagcaccgttgtaagtatataagaaaatagttttattagaactacatagcaatgttccatgttcagagtaaactataagtggatatcctaaatttagttcggttaaaactgtaaaatctctagtgtgctggacctatcactatttctgaatagattgtcatataggttgactgcagtaccacagtctttccatttagtagctttaagcctttaagctagattgtgttacaaactgaccaatcattctaggtggtttgaatatcctgtgacaacaaataaaatgtgagattgatctttt

SEQ ID NO: 26239 - DNA, 1733 bp, Oryza sativa
cctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgggcgcgcgacggccaggagaggcgggtggcgcgcggcggccgggcgaggtggggaggcacccatgaccccgctccgccgcagcacgtcacgcagatgcgcgccacgccacacgaaggttgagatggcgctggcagttgaagccgacggtctggcgcaccatgttctgctccttgtgttggttgcccgcgcaaaccaacgtgacggggaactccacggtcaagctgttccatggtggcgagcaatgagtcgtcgagcaacatcgacttgttcccatccaccggcgacaaccgtcggttgggctccaagaccgactccgacgacgatgacgacataccaccggactgaaggtagttgtaccactcgcgcctcgaggtggagcctcccgtcaatgacccatgcgacgaggccacctctgacgcagtgacgcgtgggtgcgtcgcacccggtgtcgtctggctcaccggcaagcacccctttaactccgagccgctgctgccgtgcctcatgcttgacggtttcatcacgccgacgccagtccactacgtgtgcaaccacggcgccgtgcccaagccggactggtcgacaaggatcgtggaggtgaccgggctcgtcaagcgccccgcgaggctccaccggcgcggagccaacttttattcaaccgagtcagccattgttgccgaagaggggagagagaggagaggagatggggagaagggaaaaggaagacgagagtgttaaccattggacgagagtgttggggcctgcgtgggtcccatgctaactaagcttatcatgtcagctaaaaccagacgtaaatactgcctaggacctcatatgatccggttttgtaaattgtgagggactcgttatatctggtattttggtatagggacgaatttcagactcgacaataatttgagggacgactcgacaataatttgagggacccaaagtgaacttattcctaccatatattggttaggaataagtccactttgagtccctcaaaatatatgtataatctaactcgtatccccaaactgtaataccggatatcttaacccctcaactattaaaatcaatgtattttgactccctcagtggcttcaaagcagtttttacaaaggtgtcatgtttacctcggttgacttagcatatggaaccatttgtcagtcacccttctctttcttctcttcatttccttacccatatttcctcactctctcacccatatttcctcatgacggcaaaatggcagcatggcagcggcgagataatagggtggtccggcaacagagggtgggagttggggactccgttgttttggcacccagagacggccacagtagccatcgagcggcagcaagttgagggagatgggtgg

SEQ ID NO: 26240 - DNA, 905 bp, Oryza sativa
tggtttgtatttcgtttcgtcgatgaggatgctgtagtttgaagttcacgcatgtgtcttttgcagagatagattagagcaaaaattggatcacgtgcgtcagtacatgagattcatcgatcaaaactgtgaactcggagtgaccattgaatcatcggttcattgcacattcacacaggggcttcgttaaaatatcgtcgtatcatgtaacatttcttctacttttgcgtattggagttaaatcttaaaatcatgatcttaggctatgcacgatcacctaatttctcttatacagaatttgatggtgtactgaccggatgaagaagccatatggttgccttagatgcgtcggtgtagtagttgtgaggcgacggtgatgaagatcaccatgcagtgacggcgatgggaattcgcccttcactccccttcaacacgccttaaaatcggtagtttgagggtttggagaattggcttagcgtacatgagtcgtcgctcgtgcacggggttaaggttccctttttatgcgtattgaggggatcaggggtgattccttctcgaggaaaatgacgcttccgatcataaagctaaagagagaaacgtgtgagagaatgcgtgagactcgttcctcaatgttagggatcgcgtgggctttggtgggctaagcccaacgctctcctttctggctcggtggccagacatcaaccaacattgcgtactcgttttgcacatgtactatcttggtgttatgcatctatttatatatgccctctgcgttccagacttccgggcgtccccaacctgcaatggaataagttcactttgagtccctcaaatactgctccaatctgattcatacccctcaaccacaataccatatatcttgattcttgacccttaaactatat

SEQ ID NO: 26241 - DNA, 1939 bp, Oryza sativa
aagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcgatggcaggacgtggtggaggaggagagctgcggctgctggggacgtggtcgagcccgtggtgatccgggtgagagtggcgctggggatgaaggggctgagctacgagtacaccgaggaggacctctccagcaagagcgaccacctgctcaggtccaacccggtgcacgagaaggtccccgtcctcatccacggcggccggccggtgtgcgagtcgctcgtcgtcctggagtacatcgacgagacctggggagccaccgggacgccgcagctcctccctgccgatccctacgaccgcgccaccgcgcgtttctggaccaactacgtcaacgacacggtataatgactggacatcagaacggcagataggaattctgtttgattggttgatttcctttgcaattttttctgcagtttttcccgtcgtggaaagtgctgttcaggtcgacggcggcggagcagagagctgaggcgttcaagaacgtcgtccctcgcgtggaggcgctggagcgagcgttcggggagtgctccaaggggaaggccttcttcggcggggacgacgcggggctcgtcgacgtcgcgctcgggagccatctggtgtggatcaaggtggtggacgaggtggccggcgccaacctgctcgacgaggccaagttcccgggcttggcggcgtgggcggagcggttcttggccgtcgacgctgtcaggcaggtgatgcccgacgccggcgatgttctgaagcagtacaaggggttcctggccaaatggactgcaggcgctggttcgagctgaacctgaacacaacggcgttgcctgctttcgtcttcgtggattttctaggtgtagaaaatactttctgcttcggggatctgtactttgaggagtacgttgacacgcgtgatgaataacagttttcttttttgtttcataaaaggagggaaatgttgacacgctgttcagtgaactactttagtgtttctagacgaaccacttagttgatttgctaagcacacttttaaacggcaaatatcgttcttccttgtcacgaaattcgtatcgttccattaagttgcattcttttggaaaactatatttcatccttaaggtacatcccctcgctttgcatgtcacccaaaaaatcatctaaagtcttaaaaaaagaattggtatgacagattgatctatcatgtcaaaaattttaaaacttttttgatgacacgtacaaaacgagcgtatgtcttctgttaagagataaaatccacttcctgttccttttaagcgtccgaagacatttttggaggatgacaaaatggttctccatgtttgaaatcgtggactggaagtagttacagacaccaatatacgatatatactgtattatcttactccctccgttctattttgagcgcaac

SEQ ID NO: 26242 - DNA, 1271 bp, Oryza sativa
gacccccacgaccgcgccaccgctcgtttttgggcgacctacttcgacagcacggtaatcgatggcatcttcctgaagaaatcaaccttagatagatagcaacgttcatgtcggtgattgagaaatcaatattagagagatcgacatttttgttttgatactgtattaagttcttcccgccgtggagggcgctgatgagggcgacgacggcggagcagagagcggaggccttcatgaacgccgtacctcaggtggaggtgctggagcgagcgttcgtggagtgctccaaggggaaggcgttcttcggcggcgacgccgtcgggctcgtcgacgtcgtggtcggcggcttcgtggtgtggttcaaggtggtggacgaggtggccggctccagcctcctcgacgaggccaagttcccgggcctggcggcgtgggcggagcggttcttggcggtggacgccgtccgggaggcgatgcccgacgccgggaagctcctggagcactacaagggatttctggctaaattggcttcgccagctggttctacctaatggcaatctatctgccttgctcgcctgctttgacgatgaagaagttgtttggtactgtgtcatgtgaaaatattttgttagtctctgttgagcggtgttcagaatgcaaatgtgtacatcttgaataaaaggagagcaaaatagtgaggcgacttttagttgtacaagtataattttgctcaatcagcagtgtgatcacaagggtacagatatgagggggcatagatgaggtgcacgattttttttttaaaaaaaagacgaatcgactcgagtcgattgcttcaagttttttttttcgcaaattgctcttcatcaatcacaaattatttatcaacatcgcaaatcacagaaagtgaatcacaaatttttggcacaaatgcattactactcaaatcagaatccatctaatatccaagtattacctatccatttcagcatcaaaggagaaaacaacatcaacaagggagatcggaaaaaccaacaaatcattaccgaatccataaaaaatcaacttgccaagggtatgggggagggagccaccgattctgctagtggtcacctccgtagtcgtggtcccatccgtgccggcactcgctataggtgaagtctgcccgctcgctcactgacatcgagtgacccacttgcgcgtggatctagccatccccaagttctcggtgatcgaatctagcgccgagctcacaggaaccagcaacccatggtgat

SEQ ID NO: 26243 - DNA, 738 bp, Oryza sativa
acgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaatggaggccgccatcaccatggatgagaacttgggacgaagtgggtcatttcgagctgcgatgagcatctttggcgaaagcatcaacgggaggaaggcagacaagaacagaggaactgttccagcccaagaggtagtgtctgaattcacacgct

SEQ ID NO: 26244 - DNA, 696 bp, Oryza sativa
gccgggctcgtcgccggtggccacgtcctccgctgtccacgcgctgcaccacgtcggagctcgtcgccggcggccacaccgaagctcgtcactggaggctgcatcttccgccgtccatagccatgcgccggagctcgttgtcggaggttgcatcctccgccgtccacagccatgccacgttgggagctcgtcgccggcggccacgccggagctcgtcgcttgcgaccgtgtcctccgccatccacaccccggggtgtgccgcaccgagctcgtgcagcagtcatgctttgagagagatgtggtaatatggtagaatagataaggtagaagaagatagaatcgatggattggttggttgctaacttatcccatccatcatggttgggacgggatcccgtcatatagcacttctgtaaattctgatagagtttttaagagaggaagcttctagaactgcaaaatttagtaaggactctagcgctagcccgggcgtgcttctttccggaccatgcgtgcagcacgacaggtcgacgacagctgcaaattaggcaaattttgttggcttatttccgcattcttcccgttttaatgacctcacacaaactgttcacacaaagatgctcctcgcgaacacagatttccggcccgatctgtacagctacttcatacgtgttgcttgttaaggcggtgaacgtg

SEQ ID NO: 26245 - DNA, 628 bp, Oryza sativa
tttcttgagccttgcttacaacaaactaacagggagcattcctggtgctattggtttcttgccaaacattcaggtgcttgtactgtcagggaaccagctttcagggccaatacctgcatcgctgtttaacatgtccagcttggtacggatgtacctgggcaagaacaatctctctggctctatcccaaacaacggaagcttcaaccttcccatgctgcaaacagttaatctcaacacaaaccatttaactggcatagtgcctcaaggctttggggcatgcaagaacctgcaagagttcattctattcagcaatggcttcaccggtggcataccaccgtggctggcttctatgcctcagttggtgaatgtctccttgggtggcaatgacctttctggtgaaatccctgccagcttgggcaaccttacaggtctcacccatctggatttcaccaggagtaatctgcatgggaagataccaccggagctgggacagctgacacagctgcggtggctgaaccttgagatgaataacctgaccggtagcatcccagcctctatcagcaacatgtctatgatctctatccttgacatatcctttaactcattgactggatctgtgccaaggcca

SEQ ID NO: 26246 - DNA, 2385 bp, Oryza sativa
taagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataattattaattcttttcctatcatttgatttgttgttaaatatacttttatatatacatatagttttacatatttcacaaaagtttttgaataagacgaatagtcaaatatatttaaaaaagtcaacggcatcaaatatttagggacagatggagtaatattattgttgagcggtgttcgcctggtatgtgggcgcaggagttgcaaaccagcatcagtgtgtcacttaccttgtttgccgttgagcaaaatttgctaagatgaaaatcatatctgaaaaacccgtaattagctaccaaaatcttcagctcaatttccatttgtattatacagcatcaggatatattatgccggcggcggctagatgatgtctacaccgtagggttgcatgtgccggccgcaaccacccacaggttttatctgatgcggtgaaggtcagtgtgaggcaggcgccattgcaccgaccgaaacacacgaacagcgacaacagcaaacagatactagagcaaagcccccacaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagcttctcagccaccgccgcgtccactccttccgccccgtccgcgcggacgagctcggccgcctcctccg

SEQ ID NO: 26247 - DNA, 9075 bp, Oryza sativa
  unsure (1)..(9075): unsure at all n locations
tgctcttgaggctccagaaagacatggactcccagtatcccctcaccaccatgaacatcaaatccatcttgattcgtaagctctcctccccgaactccggctacttccccctcgtcaaaaacgaaatcctcttcatgtaattcgctcgaatccaggacatgttcggcgcgggcagcgagacgtcagcgacgacgctgcagtgggcgatggcggagctgatgcgtaacccggcggtgatgcgccgggcgcaggacgaggtgcggcgagagctcgccgtcgccggcaacgacagggtaaccgaggacaccctcccgagcctccactacctccggctggtcatcaaggagacgctccggctccacccgccggcgccgctgctcctgccgcgggagtgcggcggcgcgtgcaaggtgttcggctacgacgtgccggccggcacgatggtgctcgtgaacgcgtgggcgatcggccgggacgcggcggcgtggggcgccgcggcggaggagttctcgccggagaggttcgagcggtgcgagagggacttcaggggggcggacttcgagctcatcccgttcggcgccgggaggaggatctgccccggcatggcgttcgggctggcgcacgtcgagctcgcgctcgccgcgctgctgttccacttcgactggaggctgccgggagggatggccgccggcgagatggacatgacggaggcggccgggatcacggtgcgccgccgttcggacctactggtgttcgccgtgccccgtgtccccgtgccagcgcagtagacagctggtgttatcttatctaagccaatatgagtaatcgcaattaatggcagaatttaccgataatggccgtctttagattattttttttctaaaaaggtcacatcgaatgttggacacatgtatggagcattaaacatagaagaaaaaaatcaattgcatagtttgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcgtgctgctccttgccaccatcccgctcctgttcttcaccatcaagcgctcggcgcagcgtcgtggcggcggcggcggcggcgaggggaggctcccgccggggccgtgggcgctgcctgtcatcggccacctgcaccacctcgccggcgacctcccgcaccgcgccctgagcgccctggcgcggcgccacggcgcgctcatgctgctccgcctcggcgaggtccaggccgtggtcgcctcctccccggacgccgcccgcgatatcatgaggacccacgacgccgcgttcgcgtcgcggccgctgagcccgatgcagcagctcgcgtacggccgggacgccgagggcgtcatcttcgcgccctacggcgacgggtggcgccacctccgcaagatctgcaccgccgagctcctcagcgcccgccgcgtccagtccttccgccccgtccgcgaggccgagctcggccgcctcctccgctccgtggccgaagccacctcgtcttcctcctccgcctcgctggtcaacctcaccgagctgatctccgccttcgtcgccgactccacggtgcgcgccatcatcggcagccggttcgagcaccgcgacgcatacctgcggatgctccaggacgggctcaagatcgtccccgggatgacgctgccggacctcttcccgtcctcccgcctcgcgctgttcctcagccgcgttcccggccggatcgagcaccaccgccaagggatgcaacggttcatcgacgccatcatcgtcgagcaccaggagaagcgcgccgccgccgccgccaacgacgacgacgacgaagacgaagacttcctcgacgtgctcttgaagctccaaaaggagatgggctcccaacacccgctcaccacggctaacatcaaaaccgtcatgctggtaatcaagctctccctctctctatctcaaaaaccttcgtgttacttgcagagtccctgatcatggatcacttcccatgtttcatgatcctaggacatgttcggcgccggcagcgagtcgtcggcgacggtgctgcagtggacgatggcggagctgatgcgaaacccaagggtcatgcagaaggcacaagatgaggtccggcgagcactcgccgggcatgacaaggtgacagagccaaacttgaccaacctaccctacctacgactagtcatcaaggagacactccggctacacccacccgcgccattgctactgccacgcaaatgcggaagcacgtgcaagatacttggatttgacgtacctgagggggtcatggtgatcgtgaacgcgtgggcgattggtagggacctgacgtattgggataagcctgaggagttcgtgcctgagaggtttgaacacaacgggagggatttcaagggaatggacttcgagttcataccgtttggagctggacgaaggatatgccctggcatcacattcgggatggcgcatgttgagcttgttctctctgcacttctgtaccactttgactgggagcttccacaagggatggcggcaaaggatctagacatgacagaggattttggagtcacaacacaacggcggtctaacctcttggtgcgtccaatccatcgtgtatcggttccagtagagtaaacatacttgtaagatatatttataataaatgtaattgccaatgtacgtatattagtttcagtttaattttgtttttttataattggtaaaagtcgagtttgacattatatgtttgtggagtgatatatatatcatattaatttatttttattttttttataattatttaggtgacatgaaaaaagatataagaagatgtatcctcaagtgatgaaaatctctctccagatatacaatttctatgtatgtcattacttgttcaatcttctataactagggggcagataacttggttcatttgggctcattatcctctaattttcctcttgggtggtgcatcagtatattctccaatgttaatgttctctctgaaacctataaaacgttttgcactaatcagtaatcaagtataatcagttcggtttccgcattttgaaagaggcatgaataagttgtgtccagtgtggttttgacgtgagatgcacggacacagcgcacgcagaacatgtgcacatccgtgcagggcttcgtacttgtagaacgcaaacctgttcgtccatgtcgcgttctcccagacatccgagccgtgtcgatcgcgtgagctgccatggccggcgaactcgcgttctatctgctcctcgtaggtctcgttgccgtgccattgctcatcttgctcggctccgagcggcgcacggcggcgaggacgcggctgccgccggggccgtgggcgctgccggtggtcggccacctgcaccacctcgccggcgggctcccgccgcaccgcgccatgcgcgacctggcgcggcggcacggcccgctcatgctgctccggctcggcgaggtggaggccgtcgtggcgtcgtcgccggacgcggcgcgggagatcatgaggacgcacgacgttgcgttcgcgtcgcggccggtcgggcccatgtcgcggctctggttccagggcgccgacggcctcgtgttcgcgccctacggcgaggcgtggcgccggctgcggcgcgtctgcacccaggagctcctcagccaccgccgcgtccagtcgttccgccccgtccgcgaggacgagctcggccgcctcctccgcgccgtcgacgcggcggcggcggccgggacggcggtgaacctcacggcgatgatgtccacctacgtcgccgactccacggtgcgcgccatcatcggcagccgccggctcaaggaccgcgacgcgttcctccggatgctcgacgagctgttcaccatcatgcccgggatgagcctcccggacctcttcccgtcgtcgcgcctcgccatgctcgtcagccgcgctcccggccggatcatgcgctaccgccgccgcatgcgccggatcatggacagcatcatccacgagcaccaggagaggagagccgccgccgacgccgccggtgacgacgacgacgacgacgacgaggacttggtcgacgtcctcctcaggctgcagaaggaagtgggcgcgcagtatcctctcaccaccgagaacatcaaaaccgtcatgatggtaagctcgacgccgccatggccgaacaccgaaagctcgacgcgcgcgccaaagatgtctccaccatttttctccctcgcttctttcacaggacatatttggcgccgccagcgagacgtcgtcgactacgctggagtgggtgatggcggagctgatgcggagcccgagcgccatgcgtaaggcgcaggacgaggtccggcgagccctcgccgccggcgccgccggccacgacacggtgaccgaggacatcctacccaacctcagctacctcaagctcgtcgtcaaggagacgctccggctgcacccgccggcgccgctgctggcgccgcgccggtgcgacagcccgcgcgaggtgctggtgctcggccacgacgtgccggcgggcgccacggtgctcgtgaacgcgtgggcgatcggccgggacacggcggcgtggggcggcgcggcggaggagttctcgccggagaggttcgagcggtgcgagagggacttcaggggggcggacttcgagctcatcccgttcggcgccggccggcggatgtgccccggcatggcgttcgggctggtgcacgtcgagctcgcgctcgccgcgctgctgttccacttcgactggagcctccccggcggcatggccgccgacgagctcgacatggcggagagctccgggctcaccacgcgacgccggcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatcatgcccatgaacattggcatcagtaactgtaagttgatgaatggttcatatttgatacatatttccttttgttgactacttggatgagattctgaatctttttgtagacattttttgctgttgaaataactacacttttgacttgttgttcatggatggcatcgatattttctatctgaagaagactaaacctgatgctttacagtaagctgcactggacggcgaatactaatcccttatctcaacaatggtagagcaggtacaatagcaggctataaaccagctataaacatattttaaaaagataaagaaaaatagagaaaagtagcgggctatagatctgtagccagctgcagcacggactccaagacgtaatgtgtgtatgacaggtaagattaggtattaatagtatagtaaacaattgtatgaattggttattacattagctataaatgatttggagttagtattgggctatattattaaacttgctcttaatagcttatctactgcttgaccatggagtacgtcacagttgctgtcacatgaatacttttaacttttcttgcttgaaatttccaagctgaaagaaactcttacaaatagaaaccctagtgttttttttttaaaaaaacagattgctcaagtgagttcttacatttttttatttaaaaaaattcacttataaatagattggtagccaagttaagaccaaacagtagtagcaactagcaaaggcagctcagctcaagtttagagtgagaggtgagagctcagcggcgcgccatggcggcatctcggcttgcgctcctcctcctcgtcctcgccgtcgccgcggcgcgccacgcgctcccggcggcggggagcgacgcgcacccggggtacgacggcgcggaggacacctgcggggtcccggcggcggcggcggcggcggggaggatggaggagtacggcggcgggcggatcctggacatcacccacgcgtaccgggcggacctgccggcgttcgcgccgggggcggtgacggggccggtggtgcggctcagggactccatggcgaacgggacgctctacaacctgtcggagctcaagatggagtgccacatgggcacccacgtcgacgcgccgggccacatgaaccagggccacttcgccgccggcctcgacgtcgacaagctcgacctcgacctcctcancggtacgccctcgccgccgccgccgccgccgccactttacttgttccccttcctgctcgcgcggcgacatggtcgaggttttgtgtggtgcacgtgatgccaccgatgccggctgcggtatccgtaaaggagattagtacagggggaatttgggataaatttggagatgaactcgaagacgagatggggaactatagataactattttgttctgctacctgcagcgctagatcagatcctctaccttaagtcacatgaatttattactaacatagtgacatgtgtgtccaataggtaattgttagtgacaaaggcacggtgacgactttaaaggtagatgatctcagtccgtacccaatacgtaatttgcacttacatatatatgtttttttttaaaaaagagaggcaaacttgctaaaatatgtttccacaaaaggtgtggagaaatactacgatttgtatagttcacaaataggataaatggtacttatagtacatatatcgctcaaaatatcaaatacttcctccgtttcacaatctaagtcattctagcatttccctgtctagattcattaacatcaatataaatgtgggaaatgctagaatgacttacattgtgaaacagagggagtacttctcaactttagtatgtgctaatacattaacatgttttacgtatctacgtgtacatttttctcagaattttgtaaagttcacacattataaaatttttaaatgggtgtagctattcctagatccagaaagaaaaaggctatgggtacagaactcatacagatgctgatgtggcatgccacgagtaaaccaagatttcttgtaactcccatatagtaaaatcaaacagttgagagctttgtttataagagttatgtaagatgtttttagttacaaacttacaatagtgaattgtccagtttgggagcagttctttacttttttttttgacgcaagttctttacatcgatatgaatctaagttaattgtctcctgtgcttctcctgtatacgtctatcgctctctgattacagttttgcctgagtggaaaaccaattctgtttggtttggcgtctagacgtttgtttggaattggaccccacctaactacatcaaaagttctcatcacaccctactcatttagtcattttgttattgcaaccaaatcgggtgtgtgctacatgcctacaattttttaaaataatttgaaacctagttggtgctctgtgtctgtcctttctcctaccaatcattaagatgagcatagaagccaaacctgtctttctgattttgcacgatctccctttgcatactgacagctgacaggatcaagtgaattagacagctccatttcagtgttaggtgctagtattagtctgccattgttccagttgcttctctcatgcagagttgcagagcacagcttcttgtcctgctgcttgcaaagatcaatttttcgttggctttgttccagcattgaagattcacctgatatgatttgatcaacaaaattaacagtttagctgaagaaatgttgtgaaatacttaatagtagctgtgaaatgcctattcaacaattctttcgaagtgcactctctgtaatgtaatgcattcctaaggaaattgcaaatgaaacttgagtgaaaatttgtcaggtagttatagatatttgaagttccccgcaaaaaaaaaaagaagttgatcgatttcctctttgctggacaggtcctacattattggttgatactccaagaaacacaaatataacaggtactattatgtatacttttcttttttccaaggagctacctgctctatcacgaatataattaataattatatgatatatctgatgaatttaccacattcagcagtgctgcccatgcccccatggtcccacagatatgacaaaaacatgaatatcacttctatgtcttgtatataaaatgcatcactgtttgcatgcactttctttatacagctaaagcaatggagtcgttaaatataccaaaaggtgttcgtcgagttcttttcaggacattgaacacagataggtatgtactcttttctggacatatattcatgcataatattcacaccttttcccatagtgcaggctcagtttttagaacaagtggtccgttgtccatatgctcattttcagcatttctcttttgcatctttacaatacagatatcattagttcatctatataaccaattaaactgtaagcaaatgatttgcaggaagctcatgtggaagaagggaggtgatctgagttatgtcggattcacagaagatggcgcacagtggttagttgacaacactgacatcaagctagttggtatgtaattctgagatatcttacacttaacagtggtattgataacttctttttccttgatcaagctagtattaagttacatttatggcctttttgtcggtgataaagatatgtatgcatttatcatttttttttgtttgatgagaatttaatgctatgctattg

SEQ ID NO: 26248 - DNA, 1875 bp, Oryza sativa
acattcatataaatgctaatgaatctagacacacatatatacctaaattcattagcatagacatgaatgtaggtaatactagaaagttttactccctctatttcacaatgtaagtcattctagcatttcccacattcaaattgatgtatatgcctagattcattaacatcaatatgaatatgagaaatggtagaatgacttacatcgtgaaacggagaaagtacattataaaacggagggagtaactttgaaagcatgccattgctgcattacttactgacaagttttgggacagtgcttgctttactctgttttgatgttgctgcaaagaatgtttacaccttcatgaatgggtgatttagagcacgatgaatctagcatgcaagattatattactggctgtaaccattggttgatttgctgaatttgttctttcagaatatcatcctagtcgaaggcctgaagctagacgatgtcaaggctggaatctacatgctgcattgcttacctctgaggctggttggatccgagggctcaccaatcaggtgcatcctgatcaagtgattgcttcatcactgctcctgataatggcgacactgcagatcatgccatctgatgctgctacatcctggctgaggccttgagagtgccaaggccagctcagtagaaaaacaataataagtgtaaacgtatatatatcgtttgtttgatcagtaataattcaatatagcacttaaagtaatttttcatgtaaaaatgcagcagatattaggaatgtggtgaaagaaactgacagactagtaatccctttgttctcaaatacgaggcgtattagctttttacatggtctacaatttgaccgtttatttatatcataatatattatcaactaatgcggaattaacatcatataaaaatattttttaaatacggatctaataacgctacatgtatgacgtcaaacctatgttactaatttaattattagtaaaaaaattcaatgttaaactttccaaaaaataagagtattttataactgatggtgtaacagttattgagctggtttagtacctatctctactattataaaaattgaagatgtttccgcggtccgtcatcatgtttgagtcggttttaattttatgttttagttttaatctatatttcttctctactattataaaaattgaaaatgtttttaccggtattttggtacgtcatccgtatatgagttggtttttaagttcgtttgcttttggaatacatatccgtatttgagtcggtttctaagatcgttcacttttggtaatacagaaggaatcatataataaatctgtttaaaaaactcgcatgctaacttgagatgatcggattcctaaccacagctcatgattttctatatatatatatatatatatatatatatatatatatatatatatatatatatatatatatccaaacgaactcctacagtaaatttcgtcttaactaaaccatataataataataagattaaaatagttttcacccgttgcaacgcacgggtatttttttctagttaagtataagagtcaaagattagtgttatcattggttacggcatggtacgggacttattgtcgaggtctagtaatgaaaactgcttgatatatcaaacaactttactactgtatttctcttttcaatacagctcgaatcttaataaaaacatacaaaatgactcaggatgtaagtgcacatgcatttgcagcgtcaaattcctcttcaactctacaaatacacacacattattactgacgagagtggaacatacagattaatattaataagaggaattgcacatggccataggctttttttttctttaccaca

SEQ ID NO: 26249 - DNA, 630 bp, Oryza sativa
tatctgaggtctgtcatcatatccgatccaacaaatcgatggaatggttctattatgttcagtattccatctactacgactagaagaatcagcacaatccagtcatacatgtgtaggcgagcaattttggatccatgagatgttatgtacggagttggaactcccagatggatggatgccgatggtgccggcatatcgtacgtactgacttgaattcccagattaggttaagcaatccaattcgcaagataaatcagatggatgttttgcctgtccatcaaaagaagtacagaaatcatactcagaaccttgaattcgtgctatttaacaatagttgtacttgtccctagaactctaagaactagccatgcatccaggatagccgaacctcagcatcatcagtaattagcatcaacacagcaatacggttttcttctgaaacggacatgagagatgggacaccgaaccttacacgaagcgttcacgacggaaagaacggccgccttggcttgcgcccggacaaatctctcgtcgtctcccttctggcttctcttccacttctccttttccccggacaccatgcgatacgattcacaattgagatatccttccgtgcgggggatgaaaaag

SEQ ID NO: 26250 - DNA, 174 bp, Oryza sativa
ttgtgtcattcgctagaatagaatgatgtggttatttttggaggtaacaagtagctgtactattagcctagctgtaacgatagcggcctagtcgccgacgatggcggctggctcctccgcctacgggctcgcttcggccgaacgctacgccagtgaccgtcgctttgcgccctt

SEQ ID NO: 26251 - DNA, 508 bp, Oryza sativa
cgagtattttcgttccaagtgccaggccccgaggacttcagaaaccaataatgtatttgccatgttcaatgtcaggttttcacaatgcgcacgctagtacggtgtgagcttgcaaacatttacccgttgtgcctgtttctgaaatcaaaatctagttatttgccccgtttggaaagtttatttgttggctcatattgcagcagaaccttattatttgctcgaagttggattcgggacttcacgtcttccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatat

SEQ ID NO: 26252 - DNA, 657 bp, Oryza sativa
aatctgacttgatcttgtttaacttgataactacttcattcattggaactctgtcatcaggtgcatctcttgagcaaagcaagcccaactcaattatggatgctagacagatattcaagatgattgaatcctcagatagcttactcgaatcctcagtaccacccgtatgaccatcttgttgtagactacagtcggcgacatttgagagctcatatgggaatgcttgactaatccattgcctgaaggtcaactcattgacgaacattggatcagttggttttttccttgtgaagacttcgaggaggacaattccgtagctgtatacgtcacttctgcgtgatgcttttcctgttgatcctaactctgtttgcaccatgtcaaaagagaactggtcagcttaagttagatgaaacaagaatacagattgtacagactttacaagggttatcacctggtgccatgtatcctacagtgcctggcatactcgttaatgtgatagagttgtcatctccaaacagcaacttggaattccgaagtcggcaacatgtgcaaccatatcattgtcaagcaaaatattgcttggctttaaatcaaaatgcaggacaacctcaaagtgatggtggtgtagatactccattgccatcgcaacatccagca

SEQ ID NO: 26253 - DNA, 1496 bp, Oryza sativa
aaataatacgtgaataaaacttttatatacgtgttcttagtgatctaaaagcaaatgctgaaaaataaactttgataaagaaactttaaaatcaccttcaaattttaaggttgaaaattcaattttgatgataaggataagtgtaagcgaaaagatgaggcgcttcttctcccttcatctcaaaatataagacgaataaccttttcacaatgtctcataacatatggtatatacacgtataattaactagcacatccctctactgtaaatttgtttttttaatcctttagtacctttgataccattaggtgattttttttttaaatccttcactcttaatatttctaataccattgggtgcttgagccttgaggtgaccaaagcgaagaaatgataataattctcttatggtatttgtgtttagagctttatattttgagattgagaaaatatttggatttgccacaagtttaccgtgcaaataatgtactatcgtactataaatcatgtagagaatcaacgtgacttgcacaaatgcaacttatttcatcatccgttaacaagttcaatgagataaacgtgtccgaatgtaagtggtcaatcttacataatcgacgagataggatagtgtactccgtttcatttcataaatcattttgacttttttctaataaaaatttttaaagtttgattgagtttatagataaagtagcatttccaacacagaacaaacatattaccaatgtatattcattgaatctaatttagtgttctcaatgttactaaatttatctataaatttaataaaacttaaaatgctaaactaaaaaagtcaaaataacttataatattaaagtagtacatgatacgacctacgcgcaaatcgcatgcaaattttgaagtcacggggcaggcctatctgatcacgtgagtgggaagctgtagctgcaaatataacacaataacggcccaaacctcctgtgtggcaaactgtgtcgacccgaaataaatcagaaacaaaacttgacaacgccacagaaggaatacaggagtgatgacactccaaatggtctattgtacatgtggttaaaagaacagaaaaatcatacgcattagattgcactatgacctggacctacaacaataaataggtctgcttcatctttaacccttacagataaaaacatgacttctaaaattgtacaattgatgaagtcagaggaaatatgggacagcagtcctcggtcctcgcatctggttattctcctctgtctctgtgaagaatttgacctctctttcctgatgttttagacaaaggatataaaagatcagaatcagtgcgagcttagagctcatgaaacaaatcagatacttcacagcagtatttgcaaaagaagacatgttaacatattcagatcaactaatgcaagagtcagaccacagataagataacaatttcacactagtagcaagaaatcttccagtacttgtagatg

SEQ ID NO: 26254 - DNA, 563 bp, Oryza sativa
aatactactactattctttatctgttgcccatcaagaagacgcaccaagtctccggtttagaccccccaagtcttcccccccgcgcaacagcactccggttttagtaatgcatacgccgcagttttaaattgcctcattaactttgtagtggtaccttgcttcccccactggcacactacctagctggatcggggtatacatccaacagtggcatatatctggtgtgtgttgtgttgttttcagtttacacaggagtattaaaatcccacgagacgagaggagagatagcacagctaacacactcatcactagcagccgcgcgcgtgagagagaaactatggagagcggaggccgcgcatgcgccacgcaagttgcaacgtgcaagtcgccgctgcaattactctactggttcgtagcgagtccacttgcgcgcgtcgcggtcgcggcggccatatcgctcgcgccccggttgctgcttggctttggcattggcatacgcattctctctcaaagtacgcccgcgtcgcaacaaatctggccaaatttctcgcgctgttgtttt

SEQ ID NO: 26255 - DNA, 1050 bp, Oryza sativa
cgagaggcatccacgccggcgactcaccccacccgcgttgccggccatcagatccgtcgtcgacgcatcgccttgcaccggatccgcgcggagatggaccccaacggcttcgatttcttctcccaagatcccatttcgtccgccgccggcaacatttggtcgtcgcagccgtcggcgtccggcccttcccacggatccgttccccgcgccggcgtggacacgctggacctcaacacccaggcggcgtcgggccaggagttccctcacctccacgagtacggtgccttcctccagggtggcggcgaggaaggagctggccgcggccgaggctccggtctccctcccatccgtgcaccacgctctctgggagtgagggctggtcgagggggcgccgggccatctcgtgctgcaccgcgtgcccgccagctcaacttcggcgcggtaggtggccgtgctggacacggtggaaatggtgggtcgtcgtcgggcatcggcggcggcggccctgggcgaggcagctcctcatcaggggcaacgggtcgccgtcggcagcgcgccatggcaaccaaccgtggccgcgaccgcggacgtgggggccgcggttggcgtgtgccgaggagtgtcggcacccaggaagcacccatcggcgattacgtcgaccttgacgaagaaggtgcatgggacgatgaggtggaggaattaggcagcttcggcggccctccggtgagcattgctgaccgagctaactggactgataggaataatagtattttgttagcattgtgcatagagcaagtaagagcaggccactacaatggtagccaaatgaattctgatggctataatgctatagccgagggctaccatgccaaaactggtttgatgcacatcgtctgcagctaaagaatcaaattgggattctcaagagcacgtactccttctggcgttacttgcaaacgcacacgggcttaggaagaaaacctgatggaacagtcgatgctgattctgatttctggagtagtcacatagaggtacttttctaccattttt

SEQ ID NO: 26256 - DNA, 518 bp, Oryza sativa
acaggtcaaatccaatcgcattggtggccactcccgagagcagcatcagcgggtgattcctcttgggcgcctgcacaaaccaagctagaaccaaatcaacaaccataaccactaaccagccgccaccctctccgctgggaggggaataagcacgcgcacctcaggcggcgggcggtaccgccagagcgcgagccgccactctgtgccgggcacgggcacgtagtgcagctcatccgccgtgcagatcgcgggcttcgccccctgctcgcacgcggcggccgcggaggcgagggcgcgggatggcgacggcgaggatggttggggcggcggcgggggaggcggcgaggcgcggtaggaggcgaaggcccggacgcgcggcggcggcgggggagccggagggggaggggcggacggggaggaggcgcgcgcggtggcggcgggggaggagaggtgcgcgaaggcggcgccggcgaggaggacgcggaggttggccgcgtggaggagcggcatggcggttg

SEQ ID NO: 26257 - DNA, 668 bp, Oryza sativa
tatcatgaaaaagaacatagactctgatatactaaatgataatatctattatattcaaacaaaaaatcactttatcccagttatgtgtaactcgtctatcaccattcttcgcaaacatataagttaatatatattttttattatacatttgatccacctgtgtatgtacataggtaatatacaaaataatctatattgccaaaattattgtgctaattgttaattaaaagggatataatattgtggctaccacctgagtaacctaggtctcggtgttcaagcatgagcgaagaatgcagcggcagacggcatcgtggttgagcatgagtggagcagatggtagctggcggcatcggatcatgaatgggagggagtagatgaggtgatgaccgttgatgttcgcaagagagctggagaagaggatgcaatggtcgacaccaatgcggcgatgcgctggaggtagcggtcaatggaggaggcagggaggtggtgtacgagcgtacgagggagatcgggaggtcgctcaatcggaatcgggggaaaggttgatgcaaaattataatcttaccctcccacgaccaaaacacgattggtacacttgctctcgcatgggcgcaatatttggacggtaccgggctctttgagctgttagatcacgcgtaattaac

SEQ ID NO: 26258 - DNA, 739 bp, Oryza sativa
tcttcaggaatcaatatcaggaggaatatgtctggcacggttcgagtttgcatgatttgagagttttgaacggttgcaaaggagaatgtcctttgcaaaaaaaatgctcgaacctggaatatgatggcaaccgaaccgatggttggcacagcggtactaaggctttcagcgcaaagtttggattttgattaaaattgaaaatgatatgattgaaaagttatgtgtgcatgacaggttaatgtgatggaaaagaactgaagtttgaagtttggatccaaattttaaatctaaacacagcctaacacatggtgtttgacttgtcgtgagcaaccgggcagccggcgcgacccgaccctgacagacaggtaagcgacgtgagatcaggctcagcagcgaaccagcaccacggatgtgagatcacgtgaggatgatccgaggccgctgcccgcgggcgcgccggccaaaccaccccaaccaggcacaggcagaggatgggcgaagcagcgaacgctgcggaatcacggcagggcggggacgcagtcacgcagccgcacgcggtagctgtcggctcggtgactctacggtgcgcgcgggcggcaacgaggcggccgcgtgccaaccccccacaatgcactcgttgcacctccgcccgtgcgtgcgtgcgagattcttttgttcgttacgggtggacgagggagaccggcggcggaagggcatgccttctccgcgccgttggaaa

SEQ ID NO: 26259 - DNA, 850 bp, Oryza sativa
gcgcgccatggagaagagccacgccaagagcgacgaggcggcggaggacgcagcgaggaggaagaaggaggaggcgcaggacaaggcgctgctgaagaccgcggaggccgagctggacgcggcgaagaaggagctggagacgatcaaggccgggagcttccagttcatgacgtccatggactgcacgcgcaccgagatcatgcgcgtcgccgaggagatccgcctgctcaaggcgaaggaaaagaaagcggacgcgcaggtgcaacagctgaacaccaagctcctcaaggcgaaggcgcggttggaggccgtcacggcggccgacgagaggtcgaaggcgatcgtgtccaacttggcggcggcgatgaagcaactgaaagccgagacggaggcggcgaggatggaggaggacctcaccaagctggagaaacggtgcgtgatcgcggaggccgagaacatcgagaaggagatcgccacgaccgagggacggatcaagcagtcggtgaaggagctggatgcggcgaaagcgttggaggccgaggcgatgaggaagctcagggcaccgtggagagcacgatgcaggccagggcgtcgtcggcggcacggcggcaggggacgatgaccatctcccggttcgagtacgagtacctgaccgggcgcgcggcgctggtccgggtggtgaccgacaagaaggtggccgcggcgcaggcgtgggtgcaggcgctgaaggccagcgagaaggaggccgcgcgcgcgccaggcggcggagcgggaggtgagggagatggaggccagggcggcgcatgtggcggcggaggcggagaagacggcggcggagcagaaggagctg

SEQ ID NO: 26260 - DNA, 8858 bp, Oryza sativa
tatcttacaacaggttatttttttttattgttatcatactaaatttcccgcagcaatgcgcgaggtttcacctatttttttaccacttctttaccactgcaccccattgtccaaatcagtgcacgagatacgatatcaggaaggcagtaacaatgattgaacacatttttcgttgatagttaagaaattcgtaggaagtgccagtaataatgatctagaaagcattaagcatcactgccataaaattcacaagtttgtaagataacatagcatgtcaaacatcacacaggaaacagtaccagtaaatttcatagagctccccagcattaatcgatatttagaacaacaattcagtatacggcaggagtcatgattttacatgcccgtgcttcgaactgtccaacattcgctctctttcctgcatcccagcctttgaagaccttcatctagaccccattgagagtgatcacaattttccgggaggaagcattgtcacgatgttcacagagccatataccctacacaaaataagtccatgaaataagtgctcaaaatttaagaagtgtgctctatgatctagacgggttttataattagttattttgctaggttacagctttgcaccggatattatcactgaaactatgcctgaatatgggatacaaagcaccgcattgccttaaaagataagtttaaactcgcgtgcaacataatcaacacaaatttcacatgcacgattgcatggtctcctaaaacttcatgacaactttttatctcctgtatatagattcgagaacttcatgatgaacttaaggtcgctatataaaacaacgaaacatttagtacttcaggtttaacctagtggctaaagtggtacttgttaggctctcaaaccatagagacaagtttatttggaaagttaacaaaaccagaatattttcggttagctccatgtataaatgattatgtatgaggatgtagtgccaaggaaggatttaatttggaagcttagaattcatttgaaaaacaaaatcttcctctggtatttaaagaagggagtgattctcacgaaggacaatctaacaaaaagaaattggaagggcagcactaagtgttgtttttgtaaccacaatgagacgatacaacatctcttctttgattttcatgtggctagatttgtttggagtaccctttttataacatttgggataaatccgtctaacaatgtttctaatatgtttgggatttggctaaagggtttacaatctaggctaaagcaccaaatctttatagggattgcggcgttgttgtgggcaatgtggatttgcagaaatgatgtggtcttcgacggctccaattttaactcttacttgcaggttattttcagggggacatactgggctcgacaatggttcttattgtgtaaagaagatgagcgtgatgtgatgaatgaaggatgcaaactgttagagacatctgtcatgcatttctttggtaaagatggatggaacatgagaaagcggttaaaggagttatgtggtcgttggtttgtttgggaagtcttttcactttgaaaggctttggagtctttgtgctcttttagttttataaattcccattatctaaaaatttagtactgcaggttgacaacaaaataaccagaaaataaaggatagtcaattgtgaaaatgatatcctatatgtttctattacctgccaagtgcccatattgagatgcccatcagttatagggatcctgaagcaatgcaaaagaagaatctaatttaatattttgttggctcacttgggagaaaattgacatggggaaaagaatgtagggattagggaacacatacgtcagggcacaaccaaacattgatgatttaatatgtgctggcatgtcatcaggtcctgcaatttgaacagcacagttatgactattgactaatatggcctgatctgaagaatagtacagtcttgactcttaacaaatcaaaaaaccgtatgctagagcaatttaataccatctgctactagttcagtacagcctaactggataccaaaagtaacctcttgtttctcaaaaaaaaaaaaaggaagtaaccacttaaataaccttctagagtgtgcttccaaggagcagatcggccctgaaaatagtgaacacacaatgaagtggctcttacatgatcccttgtttgatcatgatcaaagacaagacaaattgcaaccactgacctctggtacaattcggttaaggaaagtttcggtgtcagcttgtacatcggagtcatagttctcattgatggttagggaagcgcttgtgtgctgcactgtatagtgaaaaaaaaatcaatactacaatcgtacattcgtacattgaaaacatgtgtttacttggacatgcttatcagcttacgaacatgcatataattgacattgtcattactttaaagaaaatgaggatggtctattttcttatgatgccattaattgatgttgaacttatattacttccttgtataaattggttcacacggattcaaaacgattccagtcaaccacaaatttattctctcaagtcaatcccatgcacaagataaaaacaagtttttaacatatcatcatatcagaatagtttgctaaaaccctcgcaataattaaatcccacttaggccatattcggttaatccctaagagagagggagggattggaggggaataacttcacaccccctcaatccccttcaaaccgaacaaggcctgacggatctgaacaagcacgcatcacatcagcatcagcatgttcaggggaatttacctacaccgtatgcggttatccataaagtactttcagaaaattgcctagcacagcaatcgatcaacaacaaaatcgagctatctaagcaagagcgatgatgaatgaatgaaccgatcatgagttgagttgagtgtgtgcatctacatacagaacagatgcgccaagccgcacttgaacccggacaggtcgccctcaatctccctcagaatctgcaaaaggtctcagtcaagcaaagcgctggagcaaagagatgtacggacatggcgacggggagggagggagagaccttgggggtgatgaggtggcatccccggcgctgggcggggatgacgattgtcttctgcgcccacttggcggccatggaggagtgcgccgcgggcgggccggcgacggccaggccaggggatgcgaccggacggcgcgcaacggcggcggcgggttgtttcgcagtcgccggcggggagcagcgagcgagcggtaatggactggtggtggtggtggtgggccccgcgctctggaagcttcggatgggtgaatgccaacgcactagcattcgaggccgtcggatggatgatcaacgcttcacagaattcctggagaaaggtgcggaaaaagaaaaatactaaaatgagtaaatttcacgggattcctgtatgtttaaatccttagctctaattttatatttgagttataaatgttcacattttgtgattaggatcccgtttgtttctactgaaaaagtggatgaaaatttgagtactcatgacacgttttttaaactactaaacgatgtgtttcatacaaaaagttgctctaaaatattatattaatctattataaagtttataataattaaaacttaattaatcacttatttacagaagaaaagaacaccacctaaattgatatcatttactatatttcattttaaattcgttgttctatgataaatttaattttatgatacatcctattaaatacgtagttctataataatttaaccaaagtacacgtagtttttatggaatttacctttctcaaaagaaataatgtccgagcacgatgggccgcaatcttggcccagtcacagtaaaaaaaaatctcgtaaaattgagggggttttacgcattttttggaaaaaaatagcagtagccgcagcggaagcggacagcagcatcacaatcagcgagatgcaggcggcgctcctactcccagcgcggccgtcggcggcggcgccgcctacgctcttgcggcggggggcggcttctgcgtcctccgcgcgcgctcccactcccctccctgcggggcgcctcagcggcggcgtgctgagcgctgtgcggcgccttaccgtggcggcggcggggtcgtcgtcgtcgtcgtcgggccctctctacccgacgcctccccccaccgagcaggacatcgagcgggccaagttcgagcaggtgcttcgctaatgccgcacccccctttgatctgtctgtgcctggtagaggtgcctctgcttgaagtagggttaatcgtgtgttcgctgatattctcgagaaaactcatgttgctgtaccacttggggattggggatgtatctagtgttggattatgtagtggtcgcgtgttttccgatgtgcatttgggtatcatgaggtttagggttcaggcatcgagcgattagtaatctgatgtctctaagacagggaattgttacaattaagcgaaggtaatgatttttttagagatatcgtctgtaagcgactcgttctcttttctgtatattgtgatgacgttaatcgcgcataattgttggattcacttctgttagtttatcaaccttgctgcattaagttttccttatcgtgtgtcctgtcacatctattgctttctgattgaagtctttgtgaagcatctggttaaacaatataaatatataatgtgtcattcttcgctaggatatgatttataccttttggttactctattatcctaaagacacggcatcattggcatacttcgaattttgataccagcataccaccacttcttcctacttgtataacagaataccttcctgattatgaagctacgccaaggccatctttttgccttttagtttgatatgccatactcaatttggtttgtaaagatatttaatattcttgatggaccttgttggttaaccttcatgatatttttttttaagattgggaatttgctatttcttcatgcttgagaattttacataataatgtatacgccacaccttttaacttctgtatatgcttgttttagcctaattgacatttttttttgcccatttccgtggagtaaatggcaggttgtcaagagactggggaaaacagcgaggtatttcaagaatttgggtactcttgggttctggtcccagttggtgtccacagttgtttccgctggaattttgtcattttctacagttattactgggaaggtgacagcaccttttacattctatgcaactgctgctggtattgccgcgggttttatttcagtcttctggtcatttggttacatccgcctttctgaaagacttagaaaaacagcaagtgaacctgctaaggtactctctttctcaaccccattccctgttttataatgtctcaacactgcccttaactcattttcgtacttgtctgacttctattggacggctgaactggtgctttcacataagtgtgttatatgtctgcttttggagttatatattttaggtggttattttgtacggcaagtttgatattcttcttatttgcctttttggtaataaaataaaactgtgaattgctttccaggctcctccacgtgctgatgtaattagaagtctgaaaaatggcattgtgctcaatatgctcgggatgggtgctgcagttctcggcatgcaagcaactgttggggctttggtagcgaaggctcttactacctctgcagtaccttactatcaagcaacttcccctggtcaaagtcctgttttggctctagatgttttcctagttcaggtatttgatttgcacatatcctttctccccttgaaccattttctctccaaattttcagttgaaaataagcaccatggttcactctcatttttctgcattcaacattctggtgctggttttcaagtacttaactcatttctactaggaagtaatacgtttgtacacttgcagtttttttaagggcccctttgaaatggaggattggcaaagattcatttgcctaacgaattttcctatagagccctttgatccataggaaaacttccataagataggaaaacttccatagaatagctttcctatggtcaattccataggaaaataagcaagaggttagacctcttgtaaaactttcctttggttgagttttttctgtggtgcaatcaaagggcttcttgtgctctcaattcctgtaggattgaaaaaacatactaattcaattcctgcgtttgccctattcctacaattttcctatcttgcctttcaagggggaacctaaacgacatatatttgtttatcttggtaaagaacgctcactgagaggttcatgtttacatgatattctatactatcatctactttaaatgatttgtctgattctatatatttttattaacgttaaggatcatgtatgtgtaatagcaacgagataaatccagcgtactatgcctcactctgaataacaacaaaatataactaccctaaatatttccaaactttccctgcttttaatcatataatccttcttccatgttgagtagaaacttatattataaccatgttatcatttgctatgatggaaaatgaactactgaattgttgtttttggtcatcattgcacactccagtttatgatctgacccgttgtagtgccattaatcatgttgaacaatcatgatacgcaggcttcagcgaacatcatcctgtcgcatttccttggcctggcgagctccctggagttgctgcgctccgtggccatccctccagcagaagctgctgcggcgtgagcatatcagcgcatatgccaaaggcaagggctcccgttgatcatcttgctcttcatttgctgcttcgggctttggtattcgctaggagtagcaccgctcgtccgcctgtatgtttcttgtccagacaaaatttaaaaaaaatctagctttcactgcgtaaatttcatcttgcttgatgctgagtagcagcaggttcacatgaacagcagtacaccggggagctggtggtggtacacgtacggtaagcacacaggctttacgagttgaatttgtgagcgtacaatcgctaaggttgggccgagttgttgggtggtggcactgctcaccaggctgcaggctacggcacgggtggaccatggaatgggctgggccctgctcccgcccgtgcgactgtgtcctccccagcgcagcacgagcggcggttgcgctcacgccctagagtagaaatcaatgaaacccatgatgcccccccccccccccccccaaagcgaaagaaaattagtaccactacagtactaggagtatgtgttgaggaatcaggaaacttgacatgttgctaaatgacccagtttatctaggagtacttaattttgaagagtccgtcgtgtcaaaaataattggaagagtccgtacacatactagtggttgtgggtttgctctttgtacacataaatgtgttgcactgttgcttgtttggtgcctccaacgattttgcagtggttatatagtagtagcactactccgtctattgttagcatgcacttccaattatgcaccttgacaatccaaacagttgtttaaattaaaattcaaaatttcattgtactacacgtactactcttaaatataaggtgttagagaaaggtacataaggagattatcgccctcattggatggcaaatgctttggctgataagccatttaagcaaaataagctaaccaatttgtattgaagtttggctgaattggaggtagctttggctgatcagccaaagtatttggccaaccgatgaggccgtataagaggatgttataattagttgagaaaataaaataaataaagaattaatatagtaaaagattatgattgattgagaaagatgagtgctagtccctttaaatttgactaagtttatagaaaaatatactaatattttcaatacaaaacaaacatattatcaaaatatattcgatactaaattcaataaaactaatttgatgttgtagatgctgctaatttttctataaacctagttaaacctaaaaactttaacccagaaaaatgttaaacaaatatattactaactgcactctactgtgtccgtttgtccgctcgcgggggcgccggaatctctccgctctccaccacaggcagacacacacacggcacccctccctccgcccgaccacgcccaacacgtccgctcccgcagactccacaaccgcagttcagttcagttcagttcacgcacgcacgcgctgacgcgcccgtacaccaccagcccggccggggagagagagaaatcccgagagaaaacgagaatatcccgcggcgtcggcagatcggcagcgggtggttgagctggtactagtacgactagtcgtcagtggagtgccggcacgtacggattggaggcagacagaccgggtcgactcacctcataatcatttctttcaaaaaatctgcagagatcgtggctgtccgtcttgtagtgagaagcaaaaaaacggtgagattcgattcgcggctttggttggttggttggttggttggttagctactgcaaaaatcacaaaacaaaccggtctccggaagttgcaaggaagctgcgaaacgggtggctgctctggttgtatagtactcccctggatctcacgcacaaatttatgggcgtgtttagttcacactaaaattgaaaatttatttgaaattgaaacgatttgacggaaaagttgaaagtttatgtgtgtatgaaagtttggatgtgatggaaaagttggaag

SEQ ID NO: 26261 - DNA, 8946 bp, Oryza sativa
  unsure (1)..(8946): unsure at all n locations
ccatattttggaactaaacacgtgcgtgtttagattccaacttttttcttcaaacttccaatttttcagttacatcgaactttcctacacacataaacttttaatttttccgtcacatcgtttcaatttcttcaaactttcaattttagcgtggaactaaacacagccatacacaaccgagatcggtaagctacagtataactcaatcaaacactaatttcgttttttttcttctcttgcgtggagttggattggatggggggtacagcgcagtacagtaccggcccggtgtcggtgcggtgggaggccgttaaagccatcgccagcctgtccctgcctcccagatccacgtcccctttcgccctgccatgattccccctcctcctctgacttcctttctccacactcacacactctcgctttccttgcgccttcgtcgttttcctctccccgcatacgcgtcgacgcacagcagcagtagcagtatgagtgcctgggtgtggggcccacaggtggttgtgtacgatagcagtacactacaccctctcttccaaaatacgtaggtttatttgtgggctcgatcattaatatcgataattactatttatgttttatcatctggtactaatcatataaaagttttacataatatcgataattaaatattgaatacagacgattataaataaatttattttgggaaggagcaatagagaacgtatagatcgacggggagacacctgcgctgcgggtagtgctgagctgtgcccataaactgccgcgccatgcgtccctcccctccccacgaaatcgcgccggtttttatctaccagccacgattttgcgctccagcctggcgcccctgtcgttttccgcacgggctaacgatacacccttctcctatcgctgccaggtggggtcggtgtcgtgctggggcccacgcgtcagtggcgttgggtcttcccgtcggcgcggggggtgtgtgggcgagcaaactgccggtcgtacagtccggcttgtacacacacggtacgggcggggcccggcggcgggttggacggttgcgattgaattcggcggggtgatggggggatgggctccggcgcgggctacgccttcggctttcgcgattgcaaccaaacaaaccccaacccccgtcgccttcccaaatgcccacttccaacaccaagggggatggatggatggatggatgcactcatgcacgcttgcatgcatggctggatagatggatgataggtcgatctatcatccacccgagttttctccttcccaacctagcggatggataagctcgtcgtcgttgtcgccaccgccgctctcttttcacattctctttgcaaaatatctatactgtttttattttaaaatacaataatttagtatgagatgtaatacatttagtgctgtgaatctaaagacagtgatgaaaaagaaaattagcataacgaaaatataaatatgaagtactttctccgtttcagattataagactttctaacattgataacattcactttctgtgaatgttatcaatgttagaaagtcttataatatgaaacggaggaagtatgtacgaaatccggttttaaaatgtaaactagtatgatggcccgcgcagattgcgcggctagcatcattatattttctctcatataatagcatatatgttttctcattatattattcaaatatattaaaatgataacataattttaatttttgcaataactttacaaaactactaatgtgtaatattcatattatattttatatacctgttagttattaattatttttaatatcaaattttagttatttgtaaattatatattcctatatagactttagactcgtcttttaatatttcatttttttaatttcgcattttctgtaaattgtatttctatatagactctatgcttttcttccagtattatttaattttatttctgaatttttattatttctaattgtatttatatgtggactctaaactcatctttcaatattctttaatttttagtttcgaatttcagttacttctaaattgtattcctatattgactttaaactcttcttcccatgtttttcttaatttcgaattttagttatttgtaaattgtatttttatacggactctaaactctacttttaattttattatgttcattccaaattttagttagttttaaattcctatacgtactctatactctatttctaatattccttatttttaattccgaatttcagttattttctaattgtatttctatatggactctatactctacttctaatattccttatttttaattccgaatttcagttatttcctaattatatttctatatggacttagtctcctcttctaatattccttattttttttaattccgaatttgagctatttctaaattgtatttctatatggactctagttttctcttctaatgttacttattttttaattccgaattttaactatttctaaattgtatttctatatggactctgttttttctttttctccgattaatgtaagaatttctaggccatgagaacgaacgtgggagctactttttctattactttaataatataatagattttgttggcagctcatgagtagtaaaattattttggcactataaactgaaaaataaaatggatggagacaccgttctcgtcttgggttaaccgctccaacactttcataattgagttttcaacggattttattttttttcctctctgtgtgtgtttgactgtacggaatgagaaggattattcaaatttcaaacggcacagggacccgccggcccccgtgtaacaaaccaaaccaaaacggccttcgtccacactactccagctcgaggaggaccgcgtggagctccctgacacgtgggacccaccaaacctcttgtccccacccgccatccaggtaccgaaaatgacgcgcctcgccagctgtatgccaccgtctccttccccccaccgcctatataatcccctctccctcttcctctcgccatcgagtccgacacgtccacatcgccattagagcagctcgaggaaggaggaggaggaggttgattcgatggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtgagccccgggccggggagcccgacgggatcggagcgcagcgagctcagccacggcggctgcggaagcggaagcggcggcgggcaggtgttccgccccgtgccgcgccccggcggcttcgacgccatcagcgcggcggacgtcgtgcggccgccgcggcggcgggacgacaacgacgacgacggcgacgacgacccgctcacctcgctgtccctctccctctccctcccggggttccaccacgacagcgcgcggagccacttccaggagctcccctccccctcccgctccccttcgccgccgccgtcgccgccggcagcatctccatccgcatacccgttcaacgccgatctcgtctccgcgatgcaggagatgatccgcacggaagtccgcaactacatggccggcgtcgggctccgcgccggctgcggcccgggcgccgtggccgagtccttcatgccgcagctcgtcgacggcgtcatgcgcgccgccgccgagagggtcggcgtcgtgacccgccaataaaaccccccaaaaataaaaaaaaaatcaaccatcccggttcaaattcaccacaaatgcacggtgaaaaaccacctgttaattatgagatctgtgtagtattattagcactagaattttcctggttcatctttgtattttactttgagtaaaattcttctgctgctctgaaacagagcagcggtgaaggggaggtaaaaaaaaaatcagaagcgaaatgctagtgcattgctactaccagcacagcagcagcatcacggacaggttggccgttttctgtacaggaacgaggtgatggtgagatgtagcgacaggtttctccttccctttgaaccgtccgtgcaacgaagagtcgaagactacttgggcatcgatcagatgtgcgagttgaaagtgatagtagtagcagcatgctgtactagcagtacgcatattggacatttcagagcatctaacttttaaatgtggcaattaaggatttaccaaccacaatctataacatatgggtaatctttaattgccactttaaatagttaaatatttttattttggagctatatggccgtactcgagctgtaaataaccgatgatcttttctttttggaaaaaaaaaagcctttgtttcgaatgtataggaattttctgagaatctgaaagtacttatattcctcagaaccgtaagaacttgtttcttattggccgctttgcgtcgtttaaccgttgggcatttgtctctatcaactctatgtgcgtatagaatggatggattccgatctcattgtctctttccatcagtctatgtgtcacgtgtgtagagaatgatgaattgatttatactccgagtagaactcttttgctaagctaattcattcctattcccaaagaaaatgggcgtatgagtctcatagtaatacgagacaattcaatgcccaaaggaaattgatttctactgtagtgagctgtactgtccagcaaaacggttgtgtactgttgaccattcgaatcgatcgttggtgcagcgcacggtacaacgaagtaattcggccgcagcggccagaggagcagggagccaatatgagctggctcgtagtaaatcgagtgcaggacgagtagtagtaggagtgagctgtgacagttcacggttggcggtatttataccagcaagtgatgaagctagctgtacacagctgacctgaccagctgctccccccaaacatccctttcctgtgcagaacagtagcttaaaggattcctgacactgttgctgcagcagcagcagcagcactactagtagtagtactactagcaagttaattgcaaatctgcaatttgttcagcagcttgaaagcagatgcttgtttgttgaggccgtttttgccggtgatggttggtagtctggtgtctctgcaggaggcaacataggcctcggtaattctcacccatcgacagttcaggcccggcccaaattggccagatgagcccactgatcttaagcccaatgcaagtgaaacgcaagcatgattttgatcggaaatgcaaaatggtccatatattgcgaggccgaatttataccggaaaggcacacggacgttacatggacaagtcgtcagagtctcacacaaacaagttcaagaacggatcatacggatgctgccatgagggtgcacggcggcgatcaggcgggcggcgcgtcggcgtcgtcgatgttgctgccggcgacgtcgacgacgaagcggtagcggacgtcgttgcgctcgaggcgctcgagggcctggttgacgtagtccatcttgacgacctcgatctgggaggtgagccccttgtcgacgcagaagttgagcacctcctccgtctcggccatgctcccgatgaagctgccggtgatggccttccggccgagcatcaccatgggcgagatgaagctcagcggctggttgatcacccccatcaggatcagcttcccgtccagcttcagcagcgccaggtacggctccagcgggtggtgcaccggcacggtgtcgatgatgtagtccagcgagtcgccggcggccgccatcgccgccgcgtcggagctgacgaggtaggcgtcggcgcccaggtcgtccatggcctcgccgcgcttcctcgccgacgagctgatcaccgtcacgtggtgccccatcgacttggccaccttcacgcccatgtgccccacgccgccgagccccaggacgccgccgcggagacctggcgacatcagcccgaagtgcttcagtgggctgtacaccgtcagcccggcgcacagcagcggcgccgcctgctccggcgctagccccgccgggatcttcaccacaaacctgcacacaaattcattactttttttactagtttcttaccatctcactaaccaaatattttaatctttttaagacgtgacaactttcagattaggcaggtggatcaaaaatcacgggatgttttggtttgatgccagaatttgccctatcaaatagttggcactttaaatagtaccatgtatatgtttgtaatgatgtcaaaatttaccaaaggtaatacaactcttagagcaggtacaatagcaggctaatagcctgcttacctaatattttaacatatatgatagagagagggaaagcagagagagcaaagcggacgacaatccagtcaccggctcaagcacgagcgcctaggcgctctggccccctgcagctcgggacaaccaatcgaaaattagaacttgaacatgcagaagttaccaacacctgacaggatgccttggttaaagcatgggtgtagccaattactgtatctaccattgtttagttatctcttaaataatgtggtgaattttggagccggcagttaactttactattgaacttgctcttataaaccaactatactaaaatattggtagtgccaaatcttgaccatgatttgacgctaccaatgatttggtagcgcaccaaacaaaatgagcccaacatttcactgtctctgctagtttaccaactgactacaacgacgctatgcaacaatccaacttttgctctgttcaagaagcaattcttccaacaacaaatggactaatggaccggggtaggtgaggacttatcagttaatcaacactttatacctaactttggtgacttctcactttacactcaacacagtaccgacttctcgacatctctttcagtctcagatgacattttctccacaaaattttctaacagactggactttactttggatgttcggaaaagtccagtctagttttctctacctagaacactgacaatatgataatatgataatgatatcgtgatcagttggttggtgattacttgttggagtaaagctgtgtttagcactcacttctggtcgacgaccatggcggaggcgaagccgccctgggttggccggccgtcggtgtagacgtcgttgtaggaccaaatcctcttgttgcagtactgctccacattggccttgcacggatggcactcgcggcagcagccgacgatgacgccgacgccgacgacgtcgccggcgctgtacttggtcacctccggcccgacctccaccacctcgccgaccacctcatggctgcagacgagaagaggagagaattttcttggtcaccgacaaaatccaacacatgactgaatattggtacgacaatggaagtgtactggaaaaaggaattcttggtcaccaactaattaatccaaccaattattgttgcatacttagtacgacatgcagatggtgtagtagtactaaattnactactaattaggcatcatttttcagcctggtgttggggatctatcgtgtgcttatttaaagcccatcagatcagggaaggttctcgctgaggttttctttacacgtgtctctgaaactgatggtgcatctaatctgtactatacctgtcatgaaaggtgttgatcaaaaaagaaaaatgctaaaagcgatgcactaacttatctttctgttccaaaggagtgtgatatagtggtgcatgtgcatctatgccttttgtaaatctgaaaaaagcactgaccagatttgctagttactagtgcctactcttttctgatatgtttgttatcccaatcagttaataagtttatcttcagtctactatagaatacaccatcaaatcaattgctagtagaagatctccattgacatgagccatgatccatctagataactgtgaataatcttacccagggaccatggggtacttggaagcaccaaggtggttcttggcctggtggatgtcagtatggcagataccacaatacaaaaccttcaccaccacatcttcaggcccagtcttcctggtaccaccacatacaggaaaaaaaaagaacattagttgatctgttgcataagatgcttcttcagttattccattctacaagaagacaactcaaggaaattattgatatatatataatcctccttttctttaaggaggcatggcacgagaattgcatagcaaatatatatattagaaaattataaagaatgcttctgaaaatatatatatgtggagccaggcaactagccaaaaagaactccatgcattctgtctgtttgccacaactgctccggattcagggattctgttcctttcacccaacaaaaccaagacgtgacgatgattgcaatagccaattggcggtaggtgaagcagttttggtagtacactagtactacaccactatactcttcatgttggacttatactaggagaggagcaggaatacaaaatagagtcaaactcacgtgggaagtgtggaatggatcgaatggaggagcccaaaaaagaaaaaagaaatccaattgctctcttcacctcttcacactttggccaagaggcagaaacaatctgagtgggctgcaggaat

SEQ ID NO: 26262 - DNA, 8448 bp, Oryza sativa
  unsure (1)..(8448): unsure at all n locations
aggtggccgaaggcgtccctggcggcccacccggtgacggtcttctcggcggcgaggctgcccatcgtctctggacacgaacacgcgacgcacgaggcggcggcggcggcggcggccaatggatggatcggattcgggaggaggaagagaacaagaacaagaagtgcagtggctgattcgctctctctcgctgaattctggagagggggtggtgcgtcccgcagcgagtatatataattaaaggaaaacatcgcgttggacgggtcgtgactgagagggggaagaggggttggtgaaggctggctgcctcggagatcgtgccaggatcttctgtggccacacggcctcaatttgattcgtttttgtttttttttttgttttcgtgcaagacagtttttaaattgaaggggaaagtgccaaagtgggtatcgaaatgggaacaaaaatgttagtagtaggacaagtagtggaaatgtttggtcgcgtaggttttcctaccaaggttgggaagtggttaattagctggtgcgtacgagtatggatggagtagctatatcagctccttcataatgttttattccctcattattaatgttaaaatgattaattacctattcaactactttatccgtatcaaaatatagtaagctatcatactgggttagataccatttagtaccataaattcgtaattcgtagtactgaaacatgtcctggttcgtagtctattaagtggtgtctaattgactttatctagattcgtagtactgaataagatttaatcgagtactcggttattacgttcactatccttttcatatttggattctgtcgacatttgatgtcgcgattccggtatttgcatagtatggggatctttgatactaggatatacgcgagacttaggtaaaagagacggaaacagatttttatacaggttcgggcccctgaattgtcaggtaatagccctacaacctgttggccgaagccggtcgttgctcttattcaccataatcacaccagtacaaatattggggtagcctatctaactgttgtcgacatggcggtctgaagttcttactcatagtcgacaacagggtagccttcctcctcgaatccgcatccaacgagatcagagacagcgctatatctctcctaacagtagccataggtacctaggggactagctatgcctatctctgaagtcgatatctggcatcttgtcttggcgtatattggcttgtatgttgatcttctgtcttgatctattgttccgtgtcccctctcctcctaggaggccttgtatttatacccataggtgtccccttgtccaagtagaactagggaaaccaatatggatacaatccgagtagttcttgtcgtttccatgtagaactttggttgttttttcttatccggaactcccttcatatccgaagtcagttcccgtataagacatggtatgtggtgggtcatgccgagatttagtcaactactattaggtatgtggtatccataaccctaacagattccctttatacaaaagcatggatatactctatatagaggtgcaatttaatttagattttttgagcagattatcaatttgactacaaaataaactatattttgtaaaagtaactttacaaatagcttaaacaagttgtatacaaagcatatttttcagaacacggagcaaataattcgatttaataatctgattaataagcagaaaagaacataaccttgttaccatagggtaaactcctataaaataaaaacaatatcatatttattaatagggtgtaaccaaataagtcgccctacaccatttgtatgcttgactattactcctgatattatctccgtgctattagtctcaaccttatatagtgagctacaggacaaaaataaaatacagattgagtcacaaatctctctcttgctcacacctacaaatcgaaaattcaaaatgctcgaaagtcagaacaaacataaccatgaaaaagcgactttagttagtagcttgactacttcccctctaaactgtcacacctatcgtggattagtcgtggatttatggatgattttgcagtgattaattttacctcacaaacagtagccatcatgtccttgtagaagatctcgtttggagaaaaggaggaggcacgcaaggcacgcgtgcttcgcatgcgaagcgaggtgacgtggcactgtgccagtggctgagtggactaaccgggaggggagaaaagttgcagagaacgactccggggttggtggccgggcccatcgcggtaggtgggtggggcccacttgccatgtctggtgacgtcacggatacgtcatctgaacggctgtctgtgaagagagagactgggacatgccaaccttcaacagcacgagtggttcatggtcaactgaggatgatagaaaaagagaggataaaattaagctttgatttttattattatagtactagtacttatcatttgcgtatgttcccaaaaaataaatgttaaaatttcctcttgaatgaatgctaaggggttgttcagatgataatattgctaaaattttggcatgatttcttatgtattaaccaaatttgacaacaatttaaacgtatgtttttttttgacaactttgctaaaaaatagtatggttgaaaatggcatcaaagtaaatatgccctaaattttcatatgaatgacgagtgatttttttaaaaatattttgaaacgaggcgagtgaattggtttataggcacaaattgtggcacttggtgacgaaacaatttactaaaccaagcatttttgttttaatttgttgccgcgtgtatagcagttttcgtagtgatacaatcatacaaaagttgccttttgtgagggactatcagttgtgacagcaaatacgatatgatttcaacttcatatagtgttccacatttgatattaaaacatcaatttcggtttctggttttcagtggtgacacgttgtttgtatgcttgtggttgctacttgtgtacttacaagaaaaaaatttagacttacaaatttgcaagttgcaaccacaccaaaatctcaaaaaataaagaatcataagcacccaaaactgatagctacacatatgtgccggtatggattaattgtcgatgcttgggatcgttggatgcaacatacaactctgttctggtgaaaggtcaatttcagatcgtaacatatatcatatcgccaactaattcggccattctttgcacaccacagctagtttaatcgatcaatttgagtcgcacagctagctgcatacgagccatttcgctcttatccaagtagatatggaagaagatgcttatcttaggtagttcatggttcatggagatttgttgctagctaagtcaaggatgtgatcactatcataatcatatcaagtaggagtaacgataaatatattaagaaatccgctctaattatacctccgagcccatatatgccaccaactcgacattgctaataatgagaaggggtaggagatgccgatggacggtggcctaggcgcaaatagagagagggcgagccaaaggataacaataaaagcctattgggagtttagtggggcttctccccctccctcggtttaggagagtttttttcatagcaatcattttttacttttgtttttcctttttctttgttccctatccccggcaatggccttcggctgttgcgttgtaaaaatcaattttttcttcttctaatatagtagcgtgcaattcttttacgcgttcgtgaaaaaggacaacggcagcgtgagcctcctcccaactataccctcatcacataacctatcattattggcatcgttgtgccacctcctcgatcgagctctagcatcagttcgagttgtgatgaacaaaaactttcatgactccatcccccaatccctgcgtcctcatctacaaaggatgtactccatacattcaaaaaaaaccaatcctagatttaaatctggatatacatgtgtatatgtgtccaggtttaattttagaattaagtattttttttagcggacggagtagttgacgagcccacgaaggacactagtggatcggcgagcttgttggagagcttgataatggccttgagcactcatggtcgtggaggtccatcccttctcttaagcagtgccacatggcaggtcgcatgctggggagggaggagatggtaaatgaagcatgacaagtaagaagcatgtatgttttttgaaaatttattttctcaacttgttaactggattagcatgaggccaaaccaccgtcaaatgtgcgtatataggactgataccgccttaagataggtttgagtggggagggactagggtaaattcatccggtttgaagagtttccgtatataaaatgtttttgtctttcatttgtggggcatcaattggactagggcaaaagttaacgaagttatggaacctcttttaccatataaaaaagtattcacttggtaagcacggaagaaaaaaagtttgtcttaccttggtacggttattgaatgctaggtatatatgactccatccattaacattacgatatccatatgtattatagtctcttttattttcttttttttttcagaatgacaagtgcgtcggatcgcaggccaatagctcaatagcaaatttagatcataataacaaggattaagttcacttcagatccctcaatttgtcgcctagtccgatattcatccctgaattgcaataccatatatgatgtgtctctcaactcctaaaactagtgaaaataaaatcccaacaactcctaaaactagtgaaaataaaatcccaagacggtttggacaacggtctcgactgacgtggcacatacatggtgttgatgtggcacttaaaacagaaaaaaaagagattcacatgttaatgagtgtttggttaaaaataacaaaaattgcaatggactcatgccatcactccctccttttcccctattctctccctttcctcctcatcgtcggtgacaacattagtggcagggccggtgaggcgaaggtgcgcgtgagcacgggcgggggcggccgagggcatggagggagttgctcgatgcgacaatgttcttgcgcctggagagctacggcgaggccaaggcatgggtgtggcagaatctctcctacttttgcgccaactacgcgggaggagggtgtcatcacgacaattgggtgtccacggcgcgtgaggccacagagtgcaagcggtggcgactggcggtagcatggagaaggttgtcggcgttgacgcgggaggagggtgtcggtagcgtagtcatgcccttgacgaactcgcggaggtcttcgatgatgccatagtgctcgagctttgcggcgtctggcttcggcgtgacggcggaggggatatgtgggatcgcagggatggaggggacggggaggtcggtagtgaggtgcttgatttggttgactaggaggtcagcctgcttgttggcctccgctgtgatctcctgtgagttggttgtggtctctgagaagatctccttgaacttcttcgccgtctccaacatcattgccaacgagtgcgtggctgcctccgccgtctcccttctcccttactactgctacggctacttggtaccacatggcatgaccgtgccattgacgcccagtcgccacaccagcgccttgctcccatctgtgctaccaagaaaaaaagattgagagaaaaagagagaggggaaggagatgacctgtcactcacaggtgaggtcccccaatatttatatttttatttagaccgagttgtcctgtcatgtgggcctcatgcttgactcaagtcaccgtgtcaactaaaaccgaccactatgctgccgagagaccaaagttaacacggtattaagttgggagacggattatacctgctatttcggttcaggtatgaatttcagactccgcgacaaattgagagacctaaagtgaacttattcctaataacaacccataaacgcctcgttcgagagcgcatgatttaaggtccattcgctgccaaaccaggctaaaccctaaaccctaaaccatacaaatgcccataagcaaggcccatttagaaccatacaaagagaagcccagttacagcatttctaggtccatggaaatagctttgcacctgtgctgattcggttcatgtagcccacaatcttcgatatatgggctgcatgtattgtcaacgttttgcatatgcgcacgatatttttttccctctctctaactctcttccattccccagtcaagacaacaatcacgcctgtcttttgtttcgcaagtaaacgtacggtcctaattaacgattacgatgtgtggtgttcgcttatgcgtcttaattgcgaaaaacctttattttgacgaccttcatggtaatgccattttgttctcttttttttttaaaaaaagaaagtctagcagtgtcactccatatatgcattgaatcatagtagtcatattctgttgcatcatttatatacaaaattccaaatttagaccatatatataactacaaacatgtccaaactaaaatgagagtacagcaagtactaccactatactaaatgttgcgttctgacgtgttgttttttttggcggtttgtctaccgtgaaaaccttttatatcaaagtttctttgaaaattcaaactaaccccctcttaactttataataattaatattcgattaatcatatcataatcatttttcttattttgcatgcaaaacataagctcatcataaactccatatcgaatgcagtctaacacctgtagcagcgtgtagaatttggacattgcaatccaatgaaaacagagcaaaatccgaacgaaattatgaactctgatcgggcccatacatggccgggcgaaacgaaggcagcatggccctccacgagcaaccaagatctggtcactgatgcaacagtagtagtagtagagtaggagagacaatagtacatgtgtttggttacgagtactccgtagtagtccgtactaacacacacatgggtccaattctactgttactgaactggaatactccagctagtggttcaatactgatcacctagcgacagagtaaggtatgggtttatttgtgaggcacatgtaatcagtggcgcccataaggccagcatcatctatatggatccggatccgctacagtcgctactgtgactacaacttattctctccgataaaaaaaaacaaatgtaggactgaatgtgatatatcctaatatgacaaatctagataggtgactgtccacattcgttgttttatgatacatcacattcagaatttgtatttttttatggagggagtaagcgatagcagtgcacatcattggatgtaaatcggaaggtctacattacacattgtactgttcataacactgaagcaaaactactgtttgcaccattactgtaacgtggaatcttgaccgttgataggaaaaacgaacggccaaaattatatgcggtggttaacttgcagttccaactataactgcacttgatatggattcaatcgagatgttccaattataactgcacctgatatgaatccgatctatatgtagctcgtcagtgccaatgttaatatcaactcaactatgatgagtgaatattcatgtgggtagaaagatacatgtatgagttaatgagtagtcgagtatgccatttttaaataaatgacaccggaacccttcaccatcaaacattgtattctcatccttttttcaagagagttataaatagatgaaaagatgttgtaattagcagtcaaaacacgtgtagtaatccacactgtcaaatattttaaaatagagggagtaccatatgcatcaaacaattcaataagccatataatatgaacatgttcatttgacaacccttgaactcttcactttgtttgaaacacatccgaattcaaaagccaggtatttgacaccctccaactttcaaaattattcaatcgaccctctttggtccaaataagttgcatattttttgttgatatggtggttcaataagccaaaacataagataaaaaaggttggccctgcatgttaggtaccacctcatctctcttctccctctctttctttcttgtctcctccccgagcaaatgagattggcaccaatgagcttgagctccaccccccttctcggcgcgttgagtactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26263 - DNA, 13529 bp, Oryza sativa
attcctgcagccctgtatctgcccagacttggatggttgaatttagtacttgatcacatgatgtcgcaaccatagttcatacataaccatgtggaacgcgtcgtaaggaagaggaggtgaatgccacacaaagtgtttctgtacctgcaatcccaattaaacatgttacagtatagtaccgcactgctgaaacttcagtgcctctaaacaatggctgaatcaaattatttacacgcaaacagacctgagggcagctaatgttctgaacaagacaagtgacacattacaatcttgaccaagtagcttatttgtactatgaatgtgatctactatatttattttccattacagttaagtacaacgctgaattacatgcttccttttgtaaataattcggcggcttcatagaaaaaaaggagggtcaagagttgcaaacctgaacaagagatttgtgcaattcaacaaactcttcctgtgatatagatttaagtatactttttagttgatatacatcacgctccttaagtacaacagcaaattttctccagtctaggatatcattgaaaggcaaatcgtagtagtctgacaaaataactaaaaggatgaaacaaaatggattagaactcaataatcagaagggtactgaaaatatcagttcccgtgaaataggaaaaacagcataagtagagtggcatgtattatgaatgtcactgggtagaaatactaaccaggaacacaaccgtagtgtattgaatcagatatacgggcactattaacttgagagccaccaggacaaatacagaactttgtgtggtagaactgcttctggtaaaccagctctccaatagctctactgatccgattgttactgatagcaagctctgtatcattctcccagacttgtgccaaaatgactcttattttagaattgcgatggccagcccaaaatccaaggattgtcctgttgccatggcaaaagcaacaaaagacaaattttgtaggagtgcaaatagatgttcaaaccatagcatcgtcacaaatttatggtcatgacaactttcattttgctacaaggtgattcgttgcacatgaacaaagtgctgaactaaatgtaaaaccatgtagtcttctgaattaatcataggttgtaagattcaaggcatgatcaacaagataaccacgtgagtaagtgtgagtgttttacagaatttctcaagtaaacagatatttttcacttgaaggcactattactagaaaagtctagaatcatacatggaggcacacatatatagtcagtctaggaaaaagaatcattcagaagtcccaaatgaacaatttttttatgaagacaaccatagaagaatataagatcacatatatagcataagaagcagtaagtgtcattccaacctgttctcaacatcatttcctccttcaggcagagcaaatggctgcaatacttgaggaagagcgatatccttatgcggtataaagtcaacattatagcttggagaacagacaactctaatagaattcttcaccatgaatggaagtccttcaaaagccctaacacctacatcatggcaggtgacaaagaaatggtccgctccaagtgtcctgttccagtaaggatacttgtttatcaagccttccacataatccttaactattattgtcatgttctcatatgaagtaccctgcaaagacagacatatgcacgtcaacaattataaaagatcaattacaaaagatatggacaaccaacatacaatttcagtcacatctaataacaggaaattcgttcctgtatcagatgaaaagaaaaatgcatttcaatgtttgtaagccgacaaatttccgaaaccaaagatcttgcaccagactatactgctgactagaaacctatcggcacatctacaatatcgttctactttcgcttcaataatgacatgcaggtataaacaacacattaactaatactactttgagaaccgttactatcccaaattcacagtgcaatgttccagctataggctgaagaaaggaattttacatcataaagcgcattctactattaataaattcatttgccgattgccccaaccacacagcaaccgagcaatactcaatgcaccaaaacggtgatgccatcctaacacgacaattaggccctgtttgatttagattattgagtggaatgttgtcacggattatctacttgattataggagtaaatcgaatattatattaagaaataaacttaacaaaatagcttgaaacaagtgatctaaagttctaaaccatacaatacagtagacgatattttttttttgagaaaacgtatttctcgaagcatggagcaaacaatctgtttcaataatccgatgaacgagctgaaaagaacatggccttacaatgctatggaagtgtaaatagaagtagagcggagaatggaccttgccgcgcatcttgtggggggagatggggacgaagaagaggtgcgccttgtcggggtcgccggtgcggaagcggctctcgcggatgttctggaagaagtagccctcgctggcgtacttccccgtgagcttccgcggcgtctggtagaacgtcttggggtcgccgtccgggtacatgtacaccttgaagctccgctccatctccgcgtaccccgccgcgaaggcctcggcggagtggtacaccgacggccgcgcgaaggaggaagggcgggagccgccgatggcgagggagggtggggccgcggcggggcggagcgagcggagggagaggaaggtgagggagaatagggcgagggcggcgagtagcaggagcgctcgggggaggggcgccgcggcggcggaggcggcgccggggaggcggccggccatcgccggagttggggggaggggaggctggaagagtgatgcgagggtggatcggaagggtgtgggaagttgagggtgttaagtgtaaaatcagcgttaagaatgacatgagattgaagggacattaggccctctttgtttagggttataagccaacttataagccgaaaagtctaagaccctttttctttcagcttaagattattataatctagattattgagtcagattactataagctagattgttataatctgtagtagaataagcggttagttgtttcttttctagattattagagcctagattattgggtttgcaagtctaaagagggagtggagtggcatggtgagtaatttttcacccaataatctggaaaaagctcacctaaatgagcttatcagattataataagctggactccagattataataagctgcttcaataagttgtatgtttctttcagcttactcccaataatctggattataataatctcaagctgaaagaaacagggcctaagcctgaacaaacaaatagttttttcgtttgtcttttttgaagccataagccactctaacactattaagccaaaagctaggttggagaagctttttttggcttacgtgaggtagatgcatgactccaccattaaacttaagacattaaatccaccagcttataatatataaatcatataagcaaataagctgacttaaaaatctaagccaataagcctaagcctaaacaaatagggcataattatttgtcacgtgccaattaatgatttgccactcgatatcgatatctatgatatgtgggtctagtggcaaattctttagaaccactcgtaaaagtggcaaaacgttaattattccaggatttgaaaacatgaattaaagatggttcaatcatgtttcaaaactcatacatatatgctcgtgaggatccatatagtatttgggaaaaggaacaacaatgtttactatttggcacattcacagattcactatccaactacgtgtgacgacgatcatttctctttgctcgtctcctatatttcttcattcgagatggttgtagcttgcatcaacgaagtaacccacgttatcatggatgacattgccatacggtgttgtgctctgatcattcaacaactttgatataaacaccaactccaatagtagtagggtattgagctaggatggagatcctctatcttaagtcacatgattttgagtcattgacatgtggaacttttttgatatggatctacatttcagtaatcctaaagtcacgtgatttaaggtagatgattgctatatgtggcggatgccggatggccttgagctcaagtccgaagaatagtgagcagctacaagcgaacataatagtgagcactaagcagtgagccatgcaagcaaggtgagctaacaatacgttatcccaattaattgcactgtaagctccatttatatatccatataagcaattaatacttactttcattggactgataatactcatcgagccatcgttttggacaagaacatgatctccaaaaatatcaataaatatataatgctattgaagtggagtaccttttaagagtaatctatgtatataatctccgtaattctaagataaatattttagaaattattcatattcaaagattttatagtttacaatcggccttgttaaaaacgacaagtattatcaggcctaaggtagtgatacaattaaaatatgttatatttgtaattagctggaaagataagactgacatgtgtcgtgcagatggtttgcttcaggctggaacagattagttttaaaaccacgtgcattcaccaccccctcttctttttctcatttggagaaccgtggagcactggggaagaaataaatttgcagattgattctatctagtaaaggcgaagataaaatcagtaacaatatggccaaagttccctgccagcaattaccacccaggaggccaggacagaattgaacataaaaggtaacaaaaaaaaacaactacataggagtatatcctaaaattatagccatcaatatatattgctcctatactactagtagtacaatgcatgatgtatccatgtttcagtaaataatttgaccactgtatccaaaggagccagaagctgggaaaagatcgagtaaaacagtttcagaagaatggcagttctatacttctatacaagctttctgaaccaatatacttctacatttcatagctcttcagaagctagcatacaaataaggaaaataatatataaaattgtacattaggggaaaagggtatgttagtgtgcatgcaagcctatgttcagatataagattcatggatgtgtctgaactcagaagaggactgagttggcatgcgtcgcaacatgcaatattgcaaatgaagtatcaccacattcagttactggagttgcgacgactgaggtagaagaacaatgcagtacatgcggctgctgcataagggaacacggtccacatgccctggtttcaaagcaaagcataatttgattagaaaaggtaaacaaagattttactctcaatttttcaggagaggggaggagatttaccacagctgccgcaacacttgcgagtgcaacaacaggccgttctctcaggaaaaacccaacagctagctgcaatgagacatcattagtgtcagctgtcgtaaatacagattgaagaattcttattcatgtatttaattcgattgatctgtaagatgtttgaatataacaatggtgtcagcctacagattaacaaggataaacattgtattgtaagacaaaacatttttttagttgccacaactgcattggaggaacatagaaataatttgcagattgattctatctagtaaaggtgaagataaaatcagcaacaatatggccaaagttccctgccagcaattaccacccaggaggccaggacagaattgaacataaaaggtaacaaaaaaaaaacaactacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaataacagtctgctggtatgccctgtttgtaatcgtcagttaaaatatcgggtttatcagaaatttctgacagaatcactgtgagtgaagcctgggaaaatgactaaccaatgcgccagctagaaatcctgtaggattgcgaaccccaactgaaaatcgctcaactgcaccaaacatcacagatattagtgacttctcactgtcagtgattaatgaatgtaacccactggtgttgtttctggatgcactaagtgcagcactataatctggcatttcaggaaaatgctccttactcagatataaactcttgagaaattataatctcagatatataccaaatccaattaggttgccatacttttgcaccgcacgcgatatgcttagtgctttctccttcccaattccaatctaaaaacagatgtgcaaattatatctcattcagagtgaagaatactctttcagtctgttattctttaccaaaattatgaaactatgatataagtaaaaatggcaaataaatccctgctttataccttgctgcttatgtcttcagatgctcttgtttgcctaaaaagtttacctagatagaatggaaccatatcactaatacaaacgcccctgaatggaaggatgggtcaggtaacaaaagatggtccatgattaattgatgatcgattgactgacaaaaaggaactgtgcacgcaccagtaaacccataacactgtggaaattatataagatgcattcattgagaatgaattagcaagagactgccaggttccatccaaacaaaggctgcgtgctaaagaaatcccaacctacatcaagaaaaaaagtaatcatgttcttaacatgcaacaatcaattacgcagtgaacataaaagtttgcagtaagttattgaaacttagttgggcatggtcacagtgaagatgccagtacagaggacagacccaaacatttaaagcttcttcactaataaatagtccaaatccagcagccatgagcaaccaaaagtaaacccacctgaagaaatttattagcaattcgttatattttaaaaagttttggaaactcttttagtgtgactatggtacatgtgtatataaatgattcattttacatatttttcaccatccaccattaatcatcatatatgttgcaatggtgcaaggtggtaatcttaggtagttaggacaaaaaaaaaatccttggtagttggaaattatccccaaaagcatatgtatctagcatgtagtttccactcacaaataaattcacaatctgatataacagccaaaattatggatgctcatggagaatggaatattaaaatccaggaatcaacaatgtatttgtctttgtcttacttcagcagcacatatgcatttttttttttttgccgggttagcacatatgcatttcaggagtaatatgcaacaacacaatgttttaactgtgagtgaaacagaaagataacccataaaattgtgaaatgcacataccctggagtatattccggaacaataactttcttcccaaacagcgaaaaagtatatccgatggtcgctgccgcatccggcggcgccgaagcatcaacaatctgtggcaaactgaaagatggacctgaagaaggctgcctcatgaagagtgaaatcacagtagcagtagctgccacacccagagcaagtgccactttagcaaggaaagaagcagcagtgctgcttgatttcacttccattgcatcgattatctcgctctcatcttccccaccaccagaagaagattcagccccggaggccgatgcccttgcagcgcaggaatccatacgggagaaattacgcgaactgtttgtatttgcgagaattatcagatgaggaatttcgcaattgcgcagataattactgaaaattccaccaggcaattcaacaatttaatcctgatcctatcataagcggttcctcggagagagagagagagaaaaaaaaacccaacctcgtaatgcgaccgcgaccgacggaacggcgtgcgccggcgtagaaggtggcgcgtcggcggaggcgagggatagggagcggtggcggggagccgaagcggccggcgaccgttgccatgggaggagacggcggcggtgtcggccggcgagagtgtctcggtgtcgccgccgtatgtttgtgtggcgccaagcgggttgcttagttggcacgaccgcacgagaggatgatgggctagaaatggaatatgccaagatgccatccaattcgaatttcatttttgtatttttttaaaaatttaattatcggtttatgaatttaagaataccatatttaaatcatttaaatatacgattagtggtcgaaatttaataaaaaaatagaatttaaaaaaggtgaatcatgccccatcagttgcactaataagctaaaaccaaagctaaaatttaaattttaagttgaagatattttaaggcactttctttttcagaattgtatttttagttactaataacacaatttttaaaggttttacttatgcattaattattatgtcttaataagttgttttggtttattaggggatatgggtaaccgataatgctagagacaggttggtgcactgatgagtgaattttactgttttcttccatttttttctgaagaatttaaatattttgttaattgcaaacgatcaagttttggtgcattttttgatatatatctctatctatctatgtgcaggttcatatacacatataatctatttagagaacattatgttacacagtacaaagtaggatacgaggagagaaaaacgcagagaaaacatctgttagtacaatgccatccatcaagatcgtcgtcaatggaagccatgagatggcagcagtatcagaaacagggaagcgacggcggcggccagcacacggcagccaccggcgccggcgctggatctcgccgccgccgccgagctgctgctgtcggtgggcttcgccgccgtcgccgcctcttccggtgggctggcaatggcgacaggcggcaacggcgggtccagcacgtcgcccggctccagcaccggcgccggcggcagcgccggcggcagcgcccccggcgctgccaggtgcaccagcgcgccggcgtccgccggcaggatcgcgtagctcaggttcaggctcagatcgctgcacggactccctgcaattcacacagagaagttaaaatttagagcaaatttcatcaaaccccatatttttataatatcgaagttgcataaaatcctgagcattatggccagtggcacatagcctcatctatttattttgacaaaatcccacgcctatacatatttggtaaatatttacttaccgtttcaaaacatgtaatgcatatgaaacttttagttttttatttcttcattaagtttgtcggtttaactcttcactactttgaaaagtattatttcagatgtattgaaatcaattgaaattcgaatcaaggtgggaatttttaaaacattagaccataaaatctcttatgttttacaagtcataatacctacgattttctgtaactttgatcataaaacgtgaggctttataaaatttacttttaagatgattaatttatattaatttcttgagctgaaaaactagttctagttggtgtctatggctttgtgggaggtaccccttccatttcagattataagccgttttgactttggccaaaattaaactacttcaagctttgactaagtttgtagacaaatatactaatatttacaatactaaattagtttcattaaatctataattagatatattttcatatatatttatttttggatgaaaatgtacttgaagtaatttgactttaaccaaattaaaacgacttagggcctgtttagttccccaaaattttttcctaaaaacatcacatcgaatctttggacgtatatataaagcattaaatatagataaaaagaaaaactaattgtacagtttgcatgtaaatcgcgagacgaatcttttgagcctaattaggtcatgattagccataagtgctacagtaacccacatatactaataatggattaattaggctaaaaaaattcgtctcacgatttccaggtgagttatgaaattagttttttcattcgtgcccttataatctgaaacgaaacggggagtaggagattgttgcttacggaagtaggtggcggcggtggcggggtactcggtgatgaggccgtcggccatgacgtggaaggcgtaggtggcgatctcgatgatggggtcggcccagtagtcgaatccgaggttcatgaactcgttccggagcacgccgacgtagacggtgaggttggcggcgtgcatccggtcggcgacgtcggtgaaccgcgtgaggaagaagccgttcacctgcgcgatcgacccgcggccgacggtcaccgccgtcgcgaactgcttgatctcctccaccgacggcgccgacgcgtcgctgatcgtctcgtccaccatcagcacccgcctgaacgccgggaacttcttgaacgccgccagcaccgacgtgtcgtccgacaccaccatcagctccggcaggtgcccgccctccttgtcgtagctcgcgttcgccagcgcccccgacacggcatccaccagcccgaggcctcgcttcgcgaggaacgatgcgtgctgcgttcaatatcacaattcatcaatcacaaaaaaaaaaaaaaaattgctcagcctcagctcaaccatgatgatgagatggattcaggttgagaagagaagcatggtgattgtttgtgtacctccatctcgaccatgatgccagagacattggtggccttggccaagtctaggaattcaggcaatgtcacgaacttgccggcgttcttcgcggcggggttcctcttcaggcctgcctgggtgtacggaccaagaagatcggctgacgaaattgatcggacaaacaaaacaaaagagcaagatgtttagtgaatgaatatgtgatcatcttggatgaaataacgcatgaaaaagaagatttcaggtgctcattattacgttttaatgtttggatttcgctccatgtgagatcaaaggagaagatgcccgacttgttctgaatttcactgacagtggagattttggtcatgaaactggtggacgccgtcgtgctggtgctgaggtctgcagatggctggcagaaggccacgccgtctttcgacatccggaccgcgcaatcgatgatgtcggcgccgtctttcaccgcctgctgatatgcgaggtcagtgctgcccgggtagacgccgctcgcgccattgtgggttatgatcagtggcctgcctccatctgatcgaattagagaaatcagtgcaaatgtaggaatggtggtaacttatagcttgacaatatgtgacggtgaacagtaaaagtattttgcaacttaccaccaccaggaggaggaagaggattgcccttggtatttgccaaacacgctgcaaaagatcatcaaaatgatgctgttattgatgaataatacagtatgacaattttcattctttcatcagtaaaatttctgcatatgttcttcttaccaacagctcctgatgcagtgggagggaaatccgttatcacgccgtcgacagagaagtttgcattgccaatgtactgcaagtactctgcactgggatcaaagctgtagttgtaactcatggagacatcattggcaaatccagaggcaaaaacttcaagcccaagggcatgtgcatccttgaccaaactagtaggcagccgcagatactggtccttgcccaatggccaaatgtattccttggggacaagaatccctgatgcaaaggccttgacggatttcaggtctttcaggatctctccatacgttttcttggtggtatgctcagcgacgtcttctctaagaaaccggaaaattagcttggtgttgcttttcttgagcttagcacccacgtttttcaagaatccaatttctggtgaggagatgtaagcgacactaaaatcttttggtaatcctaatatgtaatcttcggcacttaatttgtgctcctggagaaataaagcatactgaaagcaaaaaaaaaaaagttaaaaaagaacttgtgttagagagacaatatagcgtactaagaaaagtgcctcagtaagtctgtgggtaatagtgaaataaaaattacctctacattaacccataaatgtgggggcttgagtccgacaagatcttcaagggtaaacattcccatggctccatcaaatgtgcttgggcgagaaaagatgtcctggatcactgagggatgatcaaatcacagaataacaagtcagagaaaagttgcagcaaaaaaaaaaattatagcttcagaatttgctacaacctgctatgtggcgaaccacctccaaggctccattccaaccttatctattcaaaatacataagaaaattatgaatcattcatatatttttatattttgaaattgacttcattcatggagcacaaataaaaaaaatgaatttttatttaaagactgtatgcaatgtttcactttgaagactgaaattactcagtttttttttctgcttacatgtgacattctgatacagctcgtctgcggtgaaatccaaagcaaaccacccatggatttcctctccattcaccttgtatgtcttggccctcttagggaaggcttcggcgataagcgtcgagttctctaatgtcaatccagttttgcagaagcccaaaccatcactggacaattgcagatcacagtacagaaccacatcatgcaagctactcgacattgcaaactggtacgagaactggcttgaatcaggaaacaagccggagaaccctccacgagcaatgacaagaggacgctgacctgtaggacaccaccacaaagattagcaaatcaaaatgcttgatcaggtgaaacaacaatctttccaattgaaaaaaaaaacagcaaagagaacaagaagatgtttacctccaagagtctgccatttctgtactggatctttcaaagccgcatgggctccatgaaaaagtaggaggatcaagaacatgtgaggatatctttctcccatttggacaggaggagcaccctgcatcacataatatttttgtgaactaatcaaacagcggagaagattaaacaatattggagtaaaaaaaactataccaaaacaaatgtacaaagaaaccgctgaaggatcatacatgcaaatcaaaggtgaaagataacctctcatcaaacttatttctttttcagagcagagaacttcaaatttaaattcatgcaaatcaaaggcgaaagataacttctcatcaaacttatcttttttttcagaacagataacttcaaatttaattttgcagagcaacatgctcgagaaaaaaaaagatacatacctcacatgaaactg

SEQ ID NO: 26264 - DNA, 6278 bp, Oryza sativa
gagttagcaactggtgtgacttttaaaaactatatgattagaaacacggggatagtaaggtttggtctttcaaagtcttaaagacaatgaaatagctagatagctatttaataaattttaagtaaaataatacttaaaaatatatgattttgtttaggtgctagccgcgcaattgcgcgggccacccagctatttaatatgaaatttgttttagaaaaataaatgtacatcattaattgttcggaaaacgttacgcatggaaacgagaaagtgataccatctaaaacgttgtacgatttatgctaatgaatactcgaagaagatgataacttgtaacccccatatggcgccaaagcgaaccgacgacggcaaactcgatcggctatgggcctatggcagtggcaagtgataacagggctgcttttgtcacttgacagggtcacctccgtccggaatatccgtggattctgcgtcgccagggcggagctagtatagctaagggggtgtccatgaacccggttaaaaaaaattacctatattttatctattttcactatttatataccccgttagtttaaatttagacatctgtatcaagctaaatttgattcaaatcaaagtaaaacaagtaaatggaaccccttcgttttgttctagctccgccactgtgcgtcaccacatatggagtaggagtagatggagaaggttgcgtgctgcttcgacctcctcaaactcaaagctcacgacgaagctgaccgcggcaaaggcggatgacgatgaggcccgagcagcagcggcctccatctggacatgttccgtggctcgctctgccaccgcatactctcgtttactaacgctttatttagtcctttaaattcttttataaggttttttaaaaaataattaaatttataaaaatatagtaatatgtacaaaattaaattaatcttattaaatataccattgaatatatttttgataaaatatttgttttgtattaaaatattgatatattttttctataaacttaatcacactgtaaaataattaaaataacttataatataaaatggaaggagtagtattttttttctgatttactagtgataaatccctggccataataactttctattaaaaatgcatcattgttacgtaatattaatagaaatcaggattaatttaaagcttggtgagtcatataccacgactccattaccgtttatgtttgtactttctatctaagttttaattttcatttgtgataaaaaaataattttcatttgacaaaatgtaactcatctgctttgaacagaagacagcagcataagcctctaaacgtggaaacaaatgaaaatattaaattccattgacgggagaccagaaattagctctccgcctctccctccgtccttgaagttctacagctcaagttttgttttaaaatgaagctagatcacctaattagcttcattttaaaacagaacttaagcggtataactacgattaattaggggattgtgattggccgagaagagaagaggaagtaggtgaagaaaatgagtgaaaaatggttataattggttgcatgatccgctcaccattagtcgtagttgctgaaccgactttaccaatcattgaccaatatttccgatcaaaaccgaagtcgctacacatgtagcaaccaatatccaattgcaaacaacaaatatcaagcagtaacaatgtgcagtcaccagcaaggacgaagtgctactgtgctagcctccttgattcgccaccaccaagcgaatgggagaaaccatccctgctactaccgcagccaatggctgcggcggcaatggaggcggagtagataaggtgaagacgatgatggataggccaggttgggggtcagcggcccatgaggttcggaagtttttatgttcgattagtatcgatagacatgactccatagaacttatatgtacaccctcctagtcctctatctcctttctccagccaaaactgagccctggtccaagtatagatggccatatgatctgaggcccatggcttggcccaagcacggcacagcccgactagggtcgtaccgtgtcagcctggcccgacagccggaccgagcctgggctgcaccctcgaaacggtgggccggccggcacggcatgatcgaagaaaaatagtagaggaatccaaaatagacttaaataaccatataaggcaaggcccaaagacaagaggagtataaaacagacttatttttcagccattatggacatagccacagagtcgagggatgagaaatagactaattctgtggagaagcacgatggacccgagtcgtattggaccgtgtgtgtagcccgtgggctggcacgacacggcccggcgtgtaggtcaggccgtgcgggcccgaaaaggctcgaaaacctcggcccagacactgccgggcctaggccgtgctgtgccagacggcccatttggccatctatgggcccaagcaagccagttcaaccagagcctccctccacacatcagttgtgccctcctcatttgctggtttatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtggccagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggcacgacgccaagttcgccacacggccgtggagccccaccgtgcgggtccagatggtcgacggcgagggcctcgcgttcgcgccctacggcgcgctgtggcggcagctgcgcaagatcaccatggtggagctgctcagcccgcgccgcgtcaggtcgttccgccgcgtgcgggaggaggaggtcggccgcctcgtcgtcgccgtcgccacggcggcgacgcggcggcccggcgaggccgccgtgaacgtcggcgagcggctcaccgtgctgatcaccgacatcgcggtgcgcacgatcatcggcgaccggttcgagcggcgggaggatttcctcgacgccgccgccgagtgggtcaagatcatgtccgggttcagcctcggcgacctgttcccgtcgtcgaggctggccagcttcgtcagcggcacggtgcgccgggcggaggcgaaccaccgcaagaacttcgagctgatggattacgctctcaagcagcatgaggagaagagggcagctgctgcagctgccggcgccggcgccgtggaagacgatgaggacatcgtcgacgtgcttctcaggattcagaaggaagggggcctcgaagtgcccctcaccatgggcgtcatcaaaggcgtcattcgtgtaagcaagtatacattcttggtcatgttctatctgtgtgataatgttagtattatattagaatataaaattcatgctaaatggtagtaagaaataaatttacatgtacaagaatataaaatggatggtaactagtaagagttaaatgacattaacatatattgcaagtctttaattgcacctctactacttgttttatgcaacatgacttcatgaaagtttcaaaattttcccctgcattctataggacctttttggtgccgggagtgagacatcagctaatacactccaatggactatgtccgagctcgtgaggaacccaagagtgatgcaaaaggcacaaactgagctacgtgattgtcttcgaggaaagcaatcggtgtcagaagatgatttgatcggattgaaatacttgaagcttgtcatcaaggaaaccctaaggctgcatcctgtagtgccactgcttcttccgagagaatgtcaagagacatgtaacattatggggtacgacgtgcccaagggtacaaacgtgctcgtgaacgtctgggcaatatgcagagatcctaggcattgggaaaatgctgagacattcataccagagcgatttgaggatagcaccgtagactttaaaggcacagactttgagttcataccatttggagcaggacgaaggatgtgccctggtttggcatttgcgcaggttagcatggagcttgctctagcctcattgctatatcatttcgactgggaactccctagtggtgttgcgccaagcaatctagacatggaagaggagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgttatgctgctcaacttttttaatgttttctcgaaataagtaccatcatagttgttcatgtaactataaattacgagtttaatttgtgtcgtagttaacaagctcgagttgtttgtgttgttttccctttgctaaaatgctaaaacattcattggagagggagagagtggtgtaagctagtcctaaagaaaattaagaacaccaaactcctaaggtacaatagacaattcagtaattagtagttgagttttgaactatgatgggttcaatactaacattcttaaaagtagaattgaaaaaaatatgtcatatttcaaaatcttcgcacttccaaccggaatggaaagcaaattgaattgactccaccattgatttttttcttaaaagaaaagattaactcctccatggtcacaacgtatgccttgcaaatcgcaagaaaaaaaaaaggaagaattaaaaaatctgcaagacaaaatggcaatacataggttggtggagaggatgcagaaattggaaatgttgcaagcagaagaaatttgaacatggaaaaagaataaggaacaaaaaatgttgaaaaacttgagaagaaacattaaagccaaagtgaaaaggttgaattaatcctaggggaaaaaggagagggtatatacctggaaattgaaataaagggatgaaaaatgtttggatggacaaaacatggaaataaatagaaaagagactgcctatcgaatgtacattcaagagaatttctctcacaaatctgtcaaatgtaactacataattgtaatgaaattacaacataactagtatataactacacaattcgaatgtaagtcggatgtaattcataaccgacaccgtggcttgaaatggaagggccatgcatttaagtctagggttgtgggatcaactcacatcagctactcgcttgtttctcgcatggagcacaaatcttgacacgcatccagtggcaaaaaattgacagattttccctcaattttctgttgaatgtggtacaacagatcctaattgaaaaaagaagatatttgtgttggaaaaaaaccatcaaaatagccacaagacacagagagtagcaagggtccagcctaaaatcaattgcctatctcataactgccactctgccagctg

SEQ ID NO: 26265 - DNA, 22431 bp, Oryza sativa
cctgcagccctactataatatatacaataaataaatgcatgtttacttttattatagtgctttgaaagacaaatctgtatatgttgttctagtttgtttaaagtaaatatttttaaagttattaatggtcaaagttataaaagtttaacctaaccttgtctaaaacatcaattattatagaaccggagagagtatctttttcattgattttcccgacaccaaaattctaaaaaagtcaagcaaagccagtggccaccgctgaactcaaaatagacgttattacataatctgataatcatcatgcatccatctatctcttgcagccatgcatgcatcagctctctttggaagttcatccctagcaattactcccatggcgacaaaatccaactcaccatgacaaagctgcttctgtcacttgccacctagtagtaaacagtaacacctctgcatatatgtatctgcatctgcgtgctgtgtgtgccatggccatggatggcatggagaaggtggcgtggtgcgcttgcttcctcttcctggctcttatggtggttaggttgaggacgaagcggcgtggcgacaataatggcggggtgaagttgccgcctgggccgtggcggctgccgctcgtcggcaacctccaccaggtcatggcgcgcggcccgctcgtgcaccgcaccatggccgacctggcgcgccggctcgacgcgccgctcatgtcgctcaggctcggcgaggtccccgtcgtcgtcgcctcgtccgccgacgccgccagggagatcaccaagacgcacgacgtcgcgttcgcgacgcggccgtggagctccaccatccgggtcatgatgagcgacggcgtcgggctggtgttcgcgccctacggcgcgctgtggcggcagctccgcaagatcgccatggtggagctcctcagcgcccgccgcgtccagtcgttccgccgcatccgggaggacgaggtcggccgcctcgtcgccgccgtcgcggcggcgcagcccggcgaggccgtgaacgtcagcgagcggatcgcggcgctcgtctccgacgccgcggtgcgcaccatcattggtgaccggttcgagaggcgggacgaattcctggagggccttgccgaggggatcaagatcacatccgggttcagcctcggcgacctgttcccatcgtcgaggctggccagcttcatcggcggcacgacgcggcgggcagaggcgaaccaccgcaagaacttcgagctgatggaatgcgctctcaagcagcatgaggagaagagggcagctgctgcagctgccgccgccggcgctgtggaagacgatgaggacatcgtcgacgtgcttctcaggattcagaaggaagggagcctccaagtgcccctcaccatgggcaatatcaaagctgtcgtccttgtaagtactctagttgttctccctttttttttcttttcctgtggatgctaatactatatctcccttaatttcgataggatttattttattttttaaaaaatctttaataccaaactataaatttatttggtcacaaaaatataacttaatagctactccccctttcgcaaatataaagtattttggccatctccaattgtcaatagatattagggattttgaactactatggacatgttttaattgcacctagcacctatcacttaattttgttcctttcttatcccccaaccaccatgaaatcatcttcgcttatttaatagaggatatcattgtcttgttttcatccttaatctcgctaaaaaaacatagcatccattatgatggagtaagacacaactttaaaatataaatccactaccgcaacaatacatctagtttaactactgtttaggtcagaatatataaaatttacctttaaagaataacttatacggataaatggagcgagtacatgaatttcctttttataaaaaagtatgcatagtgaacataggaaggaattgatacaatattttctacactttatgggaaatcatgtattttttaccatgcatataggacctttttggtgctggcagcgagacatcggcaaatacgcttcaatgagcgatggctgagctcataatgaatccaagaacaatgctgaaggcacaagcagagttacgtgatgccctccaaggaaagcaaatagtgtcagaatatgacttggttaaattgaagtatttgaaacttattatcaaggagaccttaaggttacatcctgtggtgccactacttctccctagggagggaatgtcaggagacatgtaaggtcatggactacgatgtccccataggtactattgtgcttgtgaacatgtgggtaatcggtagagaccctaaatattgggaggacgctaagacatttagacccgagcgatttgaggatggccatatagattttaaaggaatgaactttgaatatttaccttttggagcagggcgaaggatgtgccctggtgtggcatttgcagaagcaattatggagctcgctctagcctcattgctctatcactttgattgggagttccccgatggcatctcgccggccaagatggatatgatggaggtgatgggttctaccgtgcgaaagaagaatgatctttaccttgttccaaatgcccatgtgccggttgccccatagttgttcacacattcgtacttgttcatcttgcaacctctgtaataactgatgtaacttctttggagtaaagccaaaatgaattcaattataaaaaaaaaagagttcgaaattgttgctgcgctcctctagggcgcccctaatgcgcgacaagtcgcgcagtcacacgagcgcgtgaccaccaggtccactactactactcatagtcatacactactactactacagtactactacgtgtatatatgcatatgtatatatcttgtatacatacatataaactttgtattattgtatacatacgtataatttttatattaataatacaaagtttatacgtatatatataaagtatatatatacatgtatatataatttttatgtgtaccaaaaaatcaacgtataaaaaatatacacatataccaactttgcatacgcgtatacaaactttgtatatgtacatgttaaaaaccgtgagaaaaaaatatgaatacaaataagtttgtatacatatgaatacaaacttggtatacacacgaatacaaactttgcaatatgtacatcttaaaaaaaagggaaaaaccaaaaacagaagagaaacgaaaaaacaaaaaagaacagaagagaaacgaaagaaaccaaaaaaagggaaaaatcgcacctccgtcatggcgcgccgtccgccgccctctccacgcgcgacacatgtccagtcgcgcgggagagactggctgcccattagctttttcggctcctctgtctcctttccccactcaagtcgagccctgggcctcggccgaagtatgctagagtccagacctatctcactctaaacatcctggaccagttgtcattcagtttttatcatttgttggtttgtttactagctgcaatcaaaatctgaaatttaaaatttagttttacaattaatttggggtttttacatcataatctatttttaaaactttatattggtatttagaagcctaataatatagatgtaaattttatttttaagttcttcagtcgtaattcaacctatcactctgaggtcccgtttggatcatttcgtccctggactaaaattagtccctagactaaaaactttagtcccctactgtttggatctagggactaaaagggaagtcacgtggaccgagggagagagagaagagagaggctatcactttagttcctataagtacctctaaggacattcccaaatcccaacccatggtgtccataactagtgtctatggtgtcatgtcaacaagacatcacaataaaaactacactctacaacccatggtttcttaaagtgggccattaataaatacatcatctctcttctccaccaatcatatttattcttcatttattatgaagacactattctctcccaatgcaaaacttgatagtgtctagtgcatagattctcgtgttgaagctgtgtcttgcatgagactcagtttcttcctctcttcactctctctctcttaattaatatagtgtcatataagctaaaagtcctacgtggcaatgtagttaatgccatagacaccatcctagatggagggttgggactgccctaagagggactaatggattttagtcaaatatgcactttttaattcctttttagtcacccatgtttggattcttagggactaaaagggagggactaatggattagtcccatgaaccaaacagggactgaatcttccaaaagagtggtgcaaggttggaaactccctctgtcctaaaaactattcttttggcctttttttttctcaaaaacaccattgtttcaaaatggggtgaattaaacctttttgatactattttattattttgttatccttttagccatgaaaagtaatactacccgttttctctctcttctcgttttctatctgcgttaacgattaaacatagagtaaatttcctgtgtacccctgaaaactcactcaatccctttcatacccttgaaatttacccgatcccttctatacccctgaaatttcaatttgatcccttccatgcccctaccgttacattttccatcatttcactgttacgtttggttgcaaatgtcctttttgcccttgatgatttaggtttaaatataagcttcaaaaacaattaaaaattttgtttgagtgtacagtatgtgcattttataaaactaaagagactaaataattagtgcataaaattttgacataaattttgaaaataaaataaatgcaataaattaaaatttttatttgaaattttaataggacaatggatttttttatcgggagcattcattaaaagaatgttgtgaacattggtagttctatttttatatgaatgctcctcacttttatgactttttttttaaaaaataaatatgtatttttttatttcattatctatcaatattttttgggataaataatgcatcgaacaacaaactcataactataatagtcttatgcaagaagcttttatatttttaataatgtaattcatgaatttctttgttcatccaagggtaaaatggtcatttttatagaaaatagacggtcaactaacggtgaactgacgggaggggtatggaagggatcagaattaaaaggaagtaagtaaaatttaggggtatagaagggattaggtaaaatttgaggggtatacaagggattttctcttaaacatatagtagtattttgatctcctgcttatcatggctttaactagctaaagctaatgtgaaacaagagtcttttagagccaggagtaatggccatcctacttggaaggccaaaacatgaccaaaaaaaaaatcaaaaaatgaagatctttttgttaggaaaaagtaacataacaaaagccacgagataaataagcaaacgtccagcctctctcaaacctgccagctggtgtcaattaatcttttccccttttgtgatcgcccatttatcatttttatttattttccagccactaaaattctcgtaagcatagccagcgcccagcgaccaccgctgaagtcaattaattacaaaatcggacgaccttaattagagtacatcatcatgcatccacctagcatccatctcttgcagccatgcattgcatcagctatctttggaatttcataattagcaattagtaagcagagatttactcccatggcgacaaaaatccaacaaagctgcttctgtcacttgccacctagtagtaattaacagtaacacctctgcatatatctatctgcacctggacgcgagcgtctggcttagagtagcactcgatcgatctgtgttgccatggccatggatggcatggagaaggtggcgtggtgcgcttgcttcctcttgctggctctcatggtggtcaggttgacggcgaagcggcgtggcgacaatggcgcggagaggctgccgcctgggccgtggcggctgccgctcgtcggcaacctccaccaggtcatggcgcgcggcccgctcgtgcaccgcaccatggccgacctggcgcgccggctcgacgcgccgctcatgtcgctcaggctcggcgaggtccccgtcgttgtcgcctcgtccgccgacgccgccagggagatcatgaggacgcacgacgtcgcgttcgcaacgcggccgtggaacccgaccacgcggcggctgcggtgcgacggcgagggcgtggtgttcgcgacgtacggcgcgctgtggcgccagctccgcaagctgtgcgtcgtcgagctgctcggcgcgcggcgcgtccggtcgttccgccgcgtccgcgaggaggaggcgcgccgcctcgtcgccgccgtcgccgcgtccccgcgcggcgaggccgtgaacgtcagcgagcggatcacggcggtgatcacggacgcgacgatgcgggccatgatcggggacaggttcgggcggcgcgacgagttcctggagctgctcgccgacatcgtcaagatcggctccgggttcagcctcgacgacctgttcccgtcgtggcgtctcgccggcgccatcggcggcatggcgcgccgcgccgaggcgaaccaccggaggacctacgagctgatggacagcgtgttccagcagcacgaacagcggagggttcacgttgctgcgccggctgacggcgccatggacgacgcggaggaggacctcgttgacgtgctcttcaggatacagaaagatggtggcctcgaggtgcctctcaccattggcaacatcaaagcaatcatcctggtaaatgctactacttctgctgctctgatttatgaagaacacacattaattcatagtgttttagtttacatatagaaaatagatttacatatggaagtcatctatttctacattattatttgcagaagagtaattcatttttatagaagagtttgttagtctttttttttaagaatgtctattgcttagttgaggttgcatcttgttatttcatttttctagaagtgttagctagtcttttttttttctaagaatgtctattgattagttcaggttgcatcttcttatttcatttttctagaagtgtttgttatttcttttttttctaagaatgtctattgattagttcaggttgcatcttgttattccacaggacctcttcaatgcagggagtgagacatcagcaaatacgctccagtgggttatgtcagagctaatgaggaacccaaaagtgatgagaaaggcacaagcagagttaaggaacaacctacaagggaagacaacggtaaccgaagacgatctcacaaatctaaagtacctgaagcttgtcatcaaggagacgcttaggttacatcccgtgctgcccttacttctcccaagagagtgccgagaagcatgcaatgtcatcggatacgacgtcccgaaatacactaccgtttttataaacgtgtgagcaatcaacagggaccccaaatattgggacatggccgagatgtttaagccagaacgctttgacaatagcatgattgacttcaaaggtacagacttcgagttcgtgccatttggggctggaagaaggatctgtcctggcatagcatttgcacagtccaatatggagcttgtgcttgctacactcctatactactttgactgggagcttcctagtggtatgtcgcctgaagagttagatatgactgaggacatgggactatctgtccgaaggaagaatgatctttacctacatccaacagtttgtgtgcctctgtaggccgtagtctcttttgaagtgtttgtatgacaagtcatgcattatgatgtgcccaatgacttaataaatttgttgcttgaatcaatactttcgtatatttttcgaaacatttgaaatttagccaagaggcgaacaatacatgttattcaaacctgacttagtaataggaaatccacactatctaaatgatctacctcgtccactcacatatgtgctagtctgctagtagggggcatggcatgtgattgttgaatttctaataatctaagaatagattgtccttctttttatcctagaatatattgtccttgattgtgagcatcattttaattcatggaaatgctggctagaaaagaaatgtaaggagagggagaggtgggtggatcccacatctggagaagaatataataatatcaatgtgaaacacttgtgataattagtgtagtagagaaagtcgagatcaaccatgtaccttacctaccataacatggtatggacaaagggacaaggttgtctcaactactaaacatatcggacctagttacctagtgtgctaggtatacaaaatgatggaggttcgtgtttttcttttaaaactgtaggatgattatgttgctcggagtgttacctaagtttaaaatatattggaattgaatttagtgtccataacggacctcccgctatggttgtctccagatgagcacgacaggaattagccgaatctattgtctaggctcataaaaagttaatcgtcaaaaaaaggctcataaaaaatttaaaatttaatatgtcactgacaagaagcaattatgacatttcataatactattctgatatatgaaccccataaaactcataataataggtattctcatgcaacttgtagggtcaatatcgtgcctcggtaatgcctcatgtgtcatgtaataatatactagacaccatatgttaaagtgtatcttcatatcttctactactaggtatatccccacaataccttattaccttcataagatattcatacaaataataattgattgtctccctatcttaattctcttatattttgagactgagaaagtatctaattaatgtgccggatcccagatatctatatgtaacgctccgcttttcgtgagacgttaaaaactaatttggcaaaatcctaattgcgaaaatttcgttctttgagtgttgagtctaagttgtgccaaagatctccatttaaatccctcccttgtctcgataccctgttatcaaagatcgtctcctcaaaattaccatcccaatgtagtcccgaagctcgattccttctattcgaaatcccctcctggaaccccatccgtgaactttgtcgaatgcccgaatcctaactccgtccaaggattcaccttcgcgtcataagctctctccttggttccttcaaaccgattctcaaattcgaattcaacctctcaggttttgattcatctatctttctccctgtattggttcatcaatctacccttgttttctttctcgaacttctgacccaagtctgaatatgcaaatcgagatcacttccacccttgaactcaaaatcccaagattcaatccctttcgccctgagttctccccaaaatgatttccgttccgaaataatctcaaagtccgaacccttctattcagacttctctccaaaatccttacccacatatctcgttgagtagtcaaactcaaactctcaagttacactctctttctctaaattatccatccccttttcactcgtctccgaatattgttcccttccttgactccttcctattctcccgagaccgagtatcaacctcgaaattcgaatccagactccaactctaaaacctcccaattaaatctctctgtgaaagtctatttaacctccctcataggttggattccttcatcctttttccggtccacctcttccttctcttccatcccatctctctctgaatctcgatctatctatctatcgatcgatccatctatctatctactatggccccgtttggtagagctcctaactccaactcccaactccaaactccaactccagtgagagctagctcctctaggagctgaggtaggtaaaaaagtgtttggctagattactcagctccacatttctacatcctttgtcgccatttcatcgaacaccttctaggcgtcgccttgacgttgccgccgcagccggtcagcccacgagccaccgccgccgggaagcccacgcatctccgccgcctcccaagccgctgcgcaagcgccgccgcacaggccgccgccgtcgcccaggctgcctcctgccgaagcccccgcacgcgagtcgcctaccgacgccgctgccgcgtgccgcccgtcgcggccaccgcaacaccgcccgcagccgccgccaccgcctgccgccgccgatgcgccgtggcctgctgtccccgtatgctgccaacgcagacgccgccacaactggttgtggccgtcgtcggaggatggggaagaagatgggccgccgccacctgctggccccgccgccgcgccgcccgtcctcgtcccccaacagccgctctccgccgctaccgcagccccccgccgccagcctccggccacgcgtgggcgccgcccgtcgtcgtcccgcagccgccgccgcccgccgctgtcactgcccgtcgccgtcgacgctgctgcagcccgccgatgccgccgcactagctcgggattgggaggaagattgggggaggagagagaacgggaggaaagaaggggtgaaagggtagttgagtggcattttcgtgtaaatacactaaaatattagagggtagtgggtcttttggggtggagtggagctgtggagcagcaaaaacccagctccacccccgtagttcattttctaggagtagctctgccaactccactccaaaaaaagatgaatctggaccgtttggcacagctcccgctccaggtaagttggagttgggagctagagttgtgccaaacagggcctatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcatgccgccaaatacaaatccatcccaaaaataccaaaattcccgcttttgaagcccttccttgacccctcccttggatccaccttgaaccctcgtgtacaaatatacaaattgaattcaaattcaatctccacatcaaacttctctccaaaacaaaccttccggtaaaagtctattttacctccctcgtgatgatttgggccgaaacctgccgctggcccatctctccccagctccctccatctccacgtgcgccgcacatgaccaccgaaagagagagcgctgtctctctcccttccctctctcgaacgttctctctctctctccctcgccgcccccaaaccgctcgccgccgtttgaatccgctcgccgtttcccgtgcgctcgcgcgcgtggccgaccgtctgggagacgccatcgccaccctcggtcgtcgcctgctccgacgaccaccgcgtgtccgtgctcacctccaaacagtccccgtccttttgcagtcgtcgccggcgtcatcctgtcgagccctgcgccccacgccgcgtgcgtccaaagccgcgaggcacagctcgtgctcccgccccctctcctcccaaaaacggaagggacatgcctcccttttcaccgtccccctcccctttttcccttctgggctgggtctctctctctcccgcccatgtctccttgcgcccggaggcagagcaccatgacgcagacgccagtggccagctcgccgcccccaccttgaccgctccacgctgccagcccgcgctcgcgtttcaaatttcgccgtccgatccaccgccttcgccgcccaacgcatccacgccatcgccgctttcgcactggccacgaaaccgccggtgccgcccgtgaacaccagccgagctcccttgaccgccaatgtcggtttccctcctccaaaccgacctctcctcctcgcctataaagcccgcgccctcccctctcgtttcgtcttcgcctcgctcgaaacacccgcgccattgttgccggccgccagctgctcgcccccgtctcgccgtcgcacggtccgtcctctgccgcctcctccctcaacctcggtcaccgtcgcgcggccaaccccggagcatcgccgccttcttggtcgccgcggccaagaacgccaccgccgcgaccaagggcgccaccgcacgcctccgttgccttccccggcacgcccgccgtgacacgatgccgcctcggcatcgcgttcgtcgccctgcgccgctgctcgtccatgcgccgccatcggccttcccatcctcaactcgccgccgacgccgttacctcccgtcggtgagctccctacctctcttttcctctgtcccagcactcgcgtagctcgcgtcgcgcgtgctctgtttccgccaccgtgcgcaatcgagagccaccgttggcctccctctcggcgactcctctagccaccgccgttcttgagttccctctctacctccccaagccgttgtttcagccgccggcctcccctctcgccctcgcgtcgcgtcgcccgattcgccgctgccgcgctcggccacttccgctgtgcctcccctgccgtcggcctccctcctctccttgattcccggcgccgccaccttcctcgggccccccctcgacctccccaacccctccccctggccgccgaccttcctcctcgctcccgcgccgtgccgcccctcccgccgccgcaaggcgccgccgcgagccacagcccggcgaccatcgggtcccgcgtcaccgcgtgtgcgccgcaaccccataccgcgtccactaagcccgagcgcgtgagccgcatcccttcccatcgcgcatccacgtcggcatcccggcgagcttcgccgccgccgccggccgtcgtcacgcgtcgtctccccaatccgagccatggaatcggttctccttgacctcctctagccaccggtgttcgtcgctcgcttcggcttgccgctgttcgccggatttccgccgcgcgccgtgagccgtccgatgccattcccgcccccccctcttttctctccccatccgacgtggctgcccacgtggcgttgaccgggcccgcccctgcccagtcagtcggtcagccgtccccctccccctctctcccctggctcgtggacttggcccattggccagccttcctcctcggcctaacaaaacaaaggaagtttacttttactccctcttccgagtccggtgctcacacaccgaagagctaaaggtccgcaattgctccctccaattgctcctctctctctctctcaccttcttattggccccactcgtcaatgagtcaaagataatcttgagaatgtctttccaatattccacaaatatttctctcttctataaattcagtaaattattttatcttatttcatgggttaataaatctttttcccttgatcccataaatcaattctctattccaaaatttcatgaatcattttccttataaatcatttcctttggtcccgcatgtcagagatggtcaataatattcttgagaatattatttctataaatttcatgaatcaatctccccttgttctacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcgtcgatcgtggatatcttgaagattcgtgaagcttcgtgaagaccctgagcaaggcaagccacctttgaacatattgagcctatatttgaacttaattatattgcttacaaaatattatgcattgataggactacacttaatttgtttgccccatctgaaaggcagaccggtgggcctacccaactcgttgcatctgatccttccattgttaattgttatatcatgttcccttgtaactatctagttgcacctcgatattcgtgcactctgtgcgagtatcgacggtcgccttcaaacttaaaatctgagtaacttcttgggtaaaacttggtttacaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgtgaccacacgggtggaatgggatgcccctggctgagtaaattgctaatcgggggagccttgatgccgagagacatgtggattcgccagggtggtgtcggggaggacccatgggcttcctggcacagtatggtctgggacctaacctgttgttggtctgggacccctctcgtcggcatatggcaatcctgtgtctgctctcgaaatgccttgtcatgaaagcccttaggtcaccagacgtggtcgttctacacgggctaggtgattcgggttagtaatgtcgtgtgggtaaagtgtaccccctctgcagaggttaacaaactgttcgaacagccgtgcccacggtcatgggcggatgtgaggtgattccttagcgtagtttttgttttaccctgttttatgaaaaggtgttaaggtttgggaaacctaatgcttgggaagcatttagctaccctggggacagcgggaccgggtgtccctggaagtgattggtcgtttggggacctctattatcgggaagtttggaaaattggtttggtttgggaaaaactagatttgaagccaactctgggagttgtgcaaatcgtgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttcagtcagctccgaagatgaagttgaagtgaagtaaagattagggtttcgtcctagttccctgctgctgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgccagattcggggcgtgacactatacagctaaaaattgactctctccctatctaaaataccttatattttgagattgagaaagtatctaattaatgtgccagatatctatacagctaataatttattatctccctatcttaaatctcttatactttgagaccaagaaagtatctaattaatgtgctatatatatatatatataattgattatctctctatttaaatctcttatattttgagactgagaaaatatctaattatgcgctagatatctatacaactaataattgattatctccctatcttaaattccttatattttgagattgagaaagtatctaattaatgcgccagatatctatacaactaataattgattatctctccatcgtaaatcccttatattttgatattgagaaagtatctaattaatgtgccagatatctatacaactaataattggttatctccctatctctaacaataaatctccagctagttggttttgctttacatatgaatcagtttattattgaaggcatgacagaactccactgtccatagctaccaagtgatctgacaacagcaaagtgagagtggattctaagttcaagatgtaggaatatattatatatactctacttacttgggttaagtggcatgttcacgagtgtatgagtatgaggtacgtgtctattgtcgtatatacatatgcattttccgtgtaatcaaaactaaataaatataaaatactctagttagttttcaagcgaacactctatgactcactcgacaacacttatccaaccatacacaggtaccatatacagatatgtatcatccgtgtactaaaaaatagtaatatgctctactttttttaagcgaaatcttccactcactcactagatacttgtccaaccatacataggtgccatgcatacatatatatcttctcgtgtaataaaaaatattaaaatattatacttatttttaagcaaactctccttcaatagacacttgtccaaccatacataggtaccataaatacatacatatcttctcgtgtaataaaaattattaatacattatacttatttaagcaaacactcctttaataaacactagtccaaccatgcagtggtggagtagtatatttgtctttttttctggatgtacaaggtatcatcaaaatcacagctatcaagccacaccacttcattaactttctcattaagaattgatttcgccttaactatctgccaatattctccaggttggaagcctctgctgccaccaaccttctcccatgtataaatagctgggtgcatctcgtccatggcactcacctcaccacacacccacagccgccgccatggagcaggtctcgtgcttcgccgccgccgccgccgtcgtcgtcgtggttctcttgctcgcccgcatgctcctcgcgccgcgcggggagtgggacgggctgaacctgccgcccagcccgccgcggctgccgttcatcggcagcttccacctcctccgccgcagcccgctcgtccaccgcgcgctggccgacgtcgcgcggcagctcggctcgccgccgctcatgtacatgaggatcggcgagctcccggccatcgtcgtgtcgtccgccgacgcggcgcgcgaggtcatgaagacgcacgacatcaagttcgcgtcgcggccgtggccgccgaccatccggaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctgaccgagcggatcgaggtggtcatcgcggacacgacgatgcgccccatgatcggtgagaggttcgagaggcgtgaggacttcctcgaggtcctcccggagatcgtcaagatcgcctccgggttcagcctcgacgacctgttcccgtcgtcgtggctcgcctgcgccatcggcggctcgcagcgccgcggcgaggcgagccaccggacatcctacgagctggtggacagcgccttccgccagcggcagcagcaaagggaggccatggccgcgtcgccgcctgacatcgccaaggaggaggaggatgatttgatggatgagctcatcaggatacacaaggaaggtagcctcgaggtgcctcttactgctggcaacttgaaagccgtcatcctagtaagtatttttcttactcccctgaatgttcagatcagaatagagcttttctactactctggttgttcaggtaagatttttctgctactctgattttgtttttgaaggaaaaaaacagttcagacaaaagttcagaagagtatatatatatatatatatgttcttgcagatagtgttcaattaacttgatgtagcatatgtattttccttagttgtttatctggttaaagtttcacatgtgttgcattttggcattgtacaggatctctttggtgctggaagcgagacatcctcggatgcgctccaatgggcaatgtcagagctgatgagaaacccaagagtgatggagaaagcacaaaacgaggttcaaagcatcctcaaagggaagccatcggtgaccgaagccgacgtagccaacctaaagtatctgaaaatgattgtcaaggagactcataggctacacccggtgttgccgttgctcatcccaagggagtgccagcaaacttgccagatcatggggtatgatgtgccccaaggtagtgtcatatttataaactcgtgggcgataatgagggaccccaagcattgggatgatgccgagactttcaaaccggagcggtttgaggatggtgagatcgacctcaagggtacaaactatgagttcacaccatttggggctggacgtaggatctgccctggcttggcattagcccaggccagcatagagttcatgctcgccactctgctctaccacttcgactgggagctccctaacagggctgcaccggaggagctggacatgactgaggagatgggcatcaccatccgaaggaagaaggatctctacttgctcccaactctccgtgtgcctcttaccgcatagcaccttccgtccttgatgtgtgcaatcagtatgtgtgcttgtgatgcctctacatgaggtcgcacaagttgtacctcgctgctcgtttcggctttaataaaccgacagaaatctccttattctatgtttggctttcttaataaggttccatgtttcattgctgtgatttctggcactgcgatttacttacgggagaatcaacaaaaatagttcattgactccaacaggaggcagctaactatcgaagtgcaaccgatgctaaaaaccgatcgacagtgtgtacatgaacgtgagtcgcgacattgccggctttgtagccgtgaggccgccgcgcatatcctccggatagttgttaaattatagtacatgggagcaaatagctagatcctcaaacaactatctcctgggatagttgtatagctatagcaggagatttaaaaccttgcaaaagacaccaccgcatttatcaacgtgtaggtgatttttggggaccctaaatattgggacaaaggctgcccaaggagttcaagctagagcgaatcacagataacgcaattgattttaagcacacggcctttgaattcattccacaagttgtatgggcatgttttttttttttggcatgctggactatacgagcatgttgctattgttgataatatagaagtggaaaccacatattttccaaagaaaaattgtccaaatcgagcagaaaattttggaatataataactagagaattttcacgtataatttcacgaggtaaaggatgttgatgtgaaaacacgaggcctgggagatctgcttaactcaagtgcaggttcaaaagcttgcttttaggtgtatgagcgtgccagttgatttgatcctgcaatcaacaagaaataaagacaaagaaaccacggttaaattcataaacgatagccgatcggctagttgccgatgacatatcatttatctttgagccgatgtcatatgtgaatcgatcggcagtcatgaataagtaagaaagaactaaatctattcgatcggctatagatattaacaatatatagtctctatgtcgatatatacttaaatcaagtgattgggatatatcggtcgccatgccgagacagtataaatcacttagatcgaaatatatattaacaacaagactatatatgttcatagcatagccgatcagatagatctagcatgtatcggctaatactccgatactagtactctatattaagatatcaaagcaagtaaaatataccaaacaaaagcctaatatacataaatgcaacaatatcttaatcataaaggacagatttaacatgtcaatcaagcatataagataaatgtagttaaatcaggtaagatcggctgaaactccgatgctaccctaatcggcaaccaaaagcaggctagagattgagattctaatcacgacttataaggtcaaacccaactgatgcagctataagtatgaaaagaaggacaatatctagacaatcaaaccgttggatgtttcatagagtggtgaatatcctatataatctaagtcaacgtcggtatttaacctaatcggctgccttctaataacagacgttagccgattggaggttagataacgatattgccggagattatatgggatatatgataactcgacgaattatataaacaagattagagtatcataaagatggaagcactaatcccgagaacgcaagacgccataacaatagttgaagatcgaaaccgatgcagctcaacccgaaagtaagaactcatcgaaacaaaacgaaagtaaaagggtggcgatgcgccaagattgtattgaacgtgtgttagattgattacatagggttcggggtctatttatacccgagattacaaaatatgtccatatcgtacatgactcttatctctaacaaactctaagataccataagtctttgcggcagacttttgcccaaaacatatctctaaggaaattacatgaaatgtcataattaatagatacaattgccttttcaggactctatccatatgtggcaatcattatgaagcacattaactcaacccgacaatgcatgccgtgtcatattgtcggattcggctcaatcggctaaccctgtccaacttggactctgtcgatcctgatcgcaaccgactcggacttcagatacttactctgtttccggagtgatctccatctcgtactccgcttcgatcccatcttcatctccgttacttggattaccaaatttggtcgttaacaaaggtataattagatttgaattacaactcttatcttccatttttataagtacaagtatgcaattgtaatatctacatgaaaaaaaaaacataattgactttcatactcaactataatttgtataacaattagattcaatatatggctcttagcttctgtttttataaataaaattgtttttttacacaactatattgaacaatctacaccgctatattttgaatactataatttaatggccaagatctttctttttattcttcaattaagtgagaatttttagcctctagaagaaatgtgtcgcctccatcttttatctattttttactatagggatctatcggtagatataagcggataggtttatatttttaacaatatatggatatagatttgtaaggttatggataacatatacctaatagtaatcaactaagcttggcggggctcatcatataccaagtcctatatggaatcataccacgtatatagaaggagttccggataaggaagaacaagtagagttctacatggaaactgtaagaactactcggattgtatgcatattggtctcctagttctacttggacaatgggacatctatgggtataaatacaagacccattaggaggagagggagagggagagagacgaagacaacatctgtcagaatagacaccaatacacgccgccggacatcaacatcagaaataagcctagacatacccaatctggcgcctacggaggatgacaagagggatctggcgctatctctaatcttgccgggtacttattcaaggaggaagactaccctgtcgtcgacaacgtgttggtgttccatgctgccaagttgacgacaagtagataggttatctcaaatattgtacttgtgtaattctgatgaataagagcaacatcggctttggccaacaggagtagggttattacctgattctgatgaataaggggtccgaacctgtatatactccgtctcttttacctcaatctcgcatataccctggtaccaatgatcaccttactatataaatacagtagtcgtgatctaaaacattgacaagatccgatcattgtatccataaattgatatacacaggtaatagatagatagatagatagtggatagagaaccaatctctatacacagccaagataggtagatataaatagatagatttagttttgataatggatagagatattgcccctacgttcacaagtggatatacacataaaagatagatagataatggatagagaaccagtctctatacacagccaagataggtagatatagatagatagatttaattttgataatggatagagatattgcctctgcgttcacaagtagatatacacatagatagatagatagatagatagatagatagatagatagtgaacggagtacaatctctatacacctccaagataggtagatatagatagatagatttaat

SEQ ID NO: 26266 - DNA, 14689 bp, Oryza sativa
cctctgcgttcacaagtagatatacacatagatagatagatagatagatagatagatagatagatagtgaacggagtacaatctctatacaccgccaagataggtagatatagatagatagattaattttgataatgcatagagatattgcctctgcatttacaagtggatatacacataagagatagatagatatggatggatttaattttgataatggatagagatatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctccagtgtataaatagccgggtgcatctcctccatggcactcacctcaccacacaccactccaccatcactcacagccaccacccgccgccatggagcaggtctcgtgcttcgccgccgccgccgccgccgtcctcgttgttctctcgctcgctcgcatgctcctcgcgccgcgcagggagtgggacgggctgaacctgccgcccagcccgtcgcggctgccgttcatcggcagcttccacctcctccgccgcagcccgctcgtccaccgcgcgctggccgacgtcgtgcggcagctcggcgcgccgcagctcatgtacatggagatccgtgtgaggtacccggccatcgtcgtgtcgtgcgccgacgcggcgcgcgagatcatgaagacgcacgacatcaacttcgcgtcgcggccgtggccgccgactgtccagaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctcaccgagcggatcaaggtggccatcgcggacaccacgatgcgccccatgatcggtgagaggttcgagaggcgggaggacttcctcgaggtcctcccggagatcgtcaagctcgcctccgggttcagcctcgacgacctgttcccgtcgtcgtggctcgccggcgccatcggcggctcgcggcgaggcggtcaaccgggcgtcctacgagctggtggacagcgccttccgcagcggcagcagcaaaaggaggccatggccgcgccgccgcctgacatcgccaaggaggaggaggatgacttgatggatgagctcatcaggatacacaaggaaggtagcctcgaggtgcctcttactgccggcaacttgaaagctgtcatcctagtaagtaactttgctactgctcttaatgttcatagataagttttctactattatgattgttcagataagaattttctgctactctgaatttgttgaagaaaaacagttcagatcacaaattaaatttcagatgggtaatatatacacacacacttgcatattgtctttaacttgatgtagcatatctattttccttagttttttatcaggtcaaagtttcacatatgttgcattttgtcattttataggagctcttttgtgcgggaagtgagacatcctcgaatgcgatccaatgggcaatgtcagagctggtgaggaacccaaaagtgatggagaaagcacagaacgaggtgcgaagcatcctcaaagggaagcccacagtgactgaggccgacatggtagacctaacgtatgtgaagatgattgtcaaggagactcataggctgcatccggtattgccattgctcaccccaagggtgtgccagcaaacttgccagatcatggggtatgacgtgccccaaggcagtgtcatattcataaagtcgtgggcaataatgagggaccccaaacattgggatgacgccgagacattcaaaccagagcggtttgaggatagtgagatcgatctcaagggcacaaactatgagttcactccatatggggccggacgcaggatctgccctggcttggcattagcccaggtcagcatagagttcatcctcaccatgctgctctaccactttaactgggaactccctaacggggcagcaccggaggagttggacatgactgaggacatgggcctcaccatccgaaggaagaatgatctctacctgctcccaactcttcgtgtgcctcttaccgcatagcacctaccttcctcaatgtgcgcaatcagtatctatgcttgtgatgcctctacataagatcttacaaaatgtacctcgccactcgtggctgccttaataaactctccttgtttttcaatgtttgattttcttaataaggttatgtgtttctttgttgtgatttgtggcactacgatttatttatcgaagaatcaaaggaattaaatagttaaatgtctccaatggttggcagctaactattgtagtgtaagtgattccgaagagccgacaacgtatacacgaacgcgagtcgcgagattgccggctttgcaaccgctcgccgcgcataacgtgtcctcaggatcaacactgcgcaggataaaacctctattcttctaatatattaacgtgcaattcttgtgtgcgttaaaaaaaaacactacgcaggatagcatccgccgccgtacgtcgcccgtcagtcgttcatcctgtctagctcgtttcaggcagccgatcagttccatctgctgccgcatccgcgcatccgagtgccttgccgagttccgtcggccgtgtagcgtagcgctgtcgccgagcgtccgcgcgagtgctaactgttgcaagcctgaaactgcagctgctaaactgcactgaggcctgaatcctaacgatcaagaagaggtgagagcagcaggcaacagcaacaccaccaacgttgccatcgccaattgaggccttgtttagttcacccctaactactccaaacttccgactttccatcacatcacatcacaccacatcacatccaaaacttttctacacacataaacttctaacttttcctaaacttccaacttttttcaggaactaaacacagcctgaattgcaaatttgttttctatgttgccatctgcactgcacgtctgcaccttgctatgtttttcttttagagaagggtattttctacccggcatctacatccaaccggatatatacggccattgaaatagggaacttagccccgcaaacaacccaatctgaaattcactccataggagatttgaactcaggaccttgagtactactcagatcactgtaaccactaggctacatggttaataggtttgttcgtttctcttgttaattcttcacagagttcaaagcctcagaggatgaacttggagatggaaagttgaacgatactacgctagtatgttcaatccacatgttgtatgggctatttttttcttttttttggggggggaggcatgttggaatatacacacatgttgctactgttaacaatatagaagtgaaagctacataatttcaaagagaaaaatgcccagatcaagcagaaaaatttgaaatataataactagaggattctcgtgtataatttcacacaaaggtaggtaaaggtataattagatttgaaatacaactcttatcttctatttttataaatagaagtatgcaattataatatctacatgaaaataaaaacaaatttgaatttcttactcaattgtaatttgtatatagaggcattttataaatacaaatagattcgatatacgactcttagcttctatttttataaataaaattgtattttgtacacaactatattgaacaatctatacagaggtataatttgaacaatataatttaatggccaggatctttcttttattcttcgattaatatgagaatttttagcctccaaaagaaacgtgttgcctccattttttttctattttttaatataatagatatatcgatagatataaacaagtaggtttattttttaataatggatatagatccaacctccgtaacaaaaaatggatatacacagttaatagatagatagatagattgattgattgatttatttatttatcataatgcacagagaaccagtctctatatacagtcaagataggtagatatagccctcgcaaaaaaaaaagataggtatagatagatagatttaattttgataatggatagagatattgtctctgtgttcacaagtgaatatacactaaagttagatagatagatatggatggatttaattttgataatgggtagagatccgttctctatatttataagtggatatacacaaaaaaaaaaagatagataagagatggtctatgtggcacctccacctcaaaacgacatcaaataaaatgtattttatggggactttagcaaggcaactcaagcattactgctctctccttttgttcatttttttcttctttagatatatgaagtaagcaatttgtatgtttttctctctgtttgattaattgagatggagatatatatagcatccatttgtggcacattacatgggattgagaattagattttcgagcggtactatgtttacagttcaattcccccacatgaaaacgagatatttcaaattccccaaattatgagatgtaaatacatggcctcaaaagcagcaagaaaacacaaggataagtacagtgtccgggccgttgcaaaaatcttagcctcttatgatatctgccgttgccatctcaattcagtgggcaccgctcgcggcgccaccgcatgacgagacaacgcggtttccgtggcgtgtagcagcaggcagcagcagcagccagcctcgagctcatctgcaatggcgccccgcgccaagacggcgccgccgtgcgccgtgcatcgatcttgcagatgaaacggctctctttgtcatctcatctccatcgcctcgtatatatctgttccctagcctagctagctagctatcctgcattgcattgcactcgcgttcgcgtacttacgttgtcgtcgtcgatcatctgatcaccatgtacgacgccgtcgcctgcgtcgtcgccgtcgtcgtcgtcgtcgtcttcgccatgctttgggtgaagctggcgaggagtggtgatggtggtggtggtggtagtggtggcgtgaggctgccgcctgggccgtggcggctgccggtcatcgggagcctgcaccacgtggtgggcgaccggctcctccaccgctccatggcgcgcatcgcgcgccggctcggcgacgcgccgctcgtgtacctgcagctcggggaggtccccgtcgtggtggcctcgtcgcccggcgccgcgcgcgaggtcacgcggacgcacgacctcgcgttcgccgaccgggcgctcaacccgaccgcgcggcggctgcggcccggcggcgccggggtggcgctcgcgccgtacggcgcgctgtggcgtcagctccgcaagatctgcgtcgtcgagctcctcagcgcgcgccgcgtccggtcgttccgccgcgtccgggaggaggaggccggccgcctcgtgggcgcgctcgccgccgccgccgcgtcgcccggcgaggaggcggccgtcaacttcaccgagcggatcgcggaggccgtctcggacgcggcgctgcgcgccatgatcggggacaggttcgagcggcgcgacgagttcttgcaggagctcaccgagcagatgaagctcctcggcgggttcagcctcgacgacctgttcccgtcgtcgtggctggcgagcgccatcggcggcagggcgcggcgagcggaggcgaacagcaggaagctctacgagctcatggactgcgccatccggcagcaccagcagcagcgggcggaggccgccgtggtagacggcggcgccggcgtcgaggacgacaagaaccaagacctcatagacgtgctcctgaacatacagaaacaaggggagctcgagacgcctctcaccatggaacaaatcaaagctgttatccttgtaagtaaaattgacacctgtcgtattaaaagcaaagtaaaatatatctactctcttcatcccagagtaacaggttcagattaagtgtactataatatatcatatctcgtatgagattgatttattttaggacggagagagtatgtgctatcatggtggattatatttgctcaattagatggtacagctctcaaatctttgtagtatttttcattcgatcttttaactttttataggatctctttagtggaggtagcgagacatcggcgactacgcttcaatgggcgatgtcggagctaataaagaacccaatggttatgcaaaagacacaagccgagctacgtgacaaacttaggagaaagccaactgtgacagaggatgatttgtctggcttaaagtatgtaaagctcattattaaggagaccctaaggcttcaccctgtggtaccactgcttgtcgcaagagagtgtcgtgaatcatgtaaagtcatggggtatgatgttccaaaaggcaccactgtatttgttaacgcgtgggctatcggcagagacccaaagtactgggatgacgctgaggagtttagaccagaacggtttgaacacagtactgttgacttcaagggcatagacctcgagttcataccgtttggcgcaggacgaagaatatgtcctggtatggcattcgcagaagcaatcatggaacttctgcttgctgcgctgctctaccactttgactgggaactccctaatggaatggcagcgagcgagctggatatgacagaggagatgggcatcaccgtccggaggaagaatgaccttcacctccgcccccatcctccgtgtgttgtaaggtcaaacttccgtagttttgttgagagagagagagagaggcacttcgtgtagataaataaaatgggttacaatatgatttcatataataggggaaagttttaagactagaaacttcagtattaaatgagtcagaaaaaagttggtgcatcgacaagtttcattcttaagacattctagctctgtgatgacctcgatggaaccatactaccatagagatttgtgttttgaaactggaagctagctggattatgctgttcgagaaatgcatacaattttccacgataaatacattaaatctgagcagcaaaatctgttttacacactattacatacggttagagtaattttgctgtcatcgacagccatttaggctgtgttcttccccaactttcgcaactcaccttcctcgtgtttcacgtgcacgctttttaaaatgctaaacggtgtgctgcaaaaggtttatatacgaaagttgctttaaaaaatcatattaatctatctttttaaaagtaaatatttaattaattataagaaaatatggtactccgttttgcgtgcgtgggaggtgagtttccaacttcacatccgaacacagccttagtagtcttagtatctcaggtattagtatggaccaaaatttatttataacgaatataaagtatcttatggtaaaaaagataaaatcccccatatgattaaaattaatagctctataatggtatacgtaatactcgtcgacataggactgaaaccataaaacactgtagtatgtttgtatgcttccccatttatactttgattttaacaaagcaaccgaactagggtcaaaatttcggaaacccacccacccacaccccacccaaaaccccctctggaaattatttcggccgatttttttttggatatttcatggttttatgtatttggcaaatgttgttaaaatttcaaattatttcggatagaataactaaaaattgagaaacttcagtatccgatacaaataccgaaaatctctccgttttatattataagttgtttgactttttttctagttaaactttattaagtttgataagttaaaaaaaacagcaacacctaaaatatcaaattattttcattaattataacattgaatatattttaataatatgtttgttttgtgttgaaaatagtactatatttttctataaacttatcaaactttaacttagaagaagtcataatataaaatagagggagtaatttgaaccccgaaccaaagtagacaagtagtgcctcaccttgtttggagtagcatgtactacgatccctccgtcccaaaaaaacaactcaacctatgaggggatgtggctcttcctaggacaacgaatttggataaagcgtagcccaaattcattgtattaggagtggtcaaattctcttctaggttgagtttttttttaagacgtggacatggagccaaggttgtcagtatctcgattcgtatcctagtatcttacgatactacgatcctaccaagccgaaacgataccgatcccacctagtatcctatttttatactatcgcgatcctactattcattactatacgatcctacgaaatcttaggtggtattctgattctacgattcctacgatactacaaaatattatttaaaatagcatggtttgaaaataatgtaaataaatatgctcaaatttatataaaaatcagttcaatatatcaaaatcaacgtggtttctcttaataaatgtctctatttgtatgacatatatcattactatattttctttatatagaatggctatatataattaatgtaaatattaattaagcttaaaaaaagaaaatctcatagtatcccgatactacgttacgattctacgatacgatattactttgagcaaaacgttactctctccattctaaattgatctacatattttataggtacaccaagaccaagaaaaactaataactctctcatactatatttactttagcaacaaactcgatgcatacaccatccccaatattttctaagccaatagcaaatcaagatattgcatgtgggatataaatacttgtgtgaatacatgcatcaatgtccatttactccaatgcacaaataacgaatagacttaataaacgaatataaatatgtagatcatttagaaataacatcaaaagaatctatatataaatcaatttggaatggagagagtactacgtagtatccgatagtgacaaccttacatggagcaaagcatgggccacctcgagatgactagcaccgggaattgaagcagtgagcccgtacctacctatctactactactatatgccactccaaatactcgcagaattaaacggtagtctttgtcacttaattggcgccgaagcctcatatatactacgtatgtgttaaccttgcgaagctgcaatgttgcacttgcactgcactcgcctcgccgcgatctgatcgccatggatcacgtcctcgcctgcgtcggcatcctcgtcgccttcacgccgctgttcctccttgccgtgctcccgctcaagctgacgaacggcggcgacggggtgaagctgccgcctggcccgtggcggctgccggtgatcgggagcatgcaccacctgatgggcgagagcctcgtccaccgcgccatggccgacctcgcgcgccggctcgacgcgccgctcatgtacctcaagctcggggaggtccccgtcgtgttggcctcgtcgccgtgcgccgcccgcgagatcatgcgggcgcacgacgtcgcgttcgcgagccggccgctgagccccaccgtgcggcggatgcgccccccccccccccggcgacggcagctccgcaagatctgcgtcgtcgagctgctcagcgcgcgccgcgtccggacgttccgccgcgtcagggaggaggaggtggcccgcctcgtgggcgcgctcgtgtgtttggcccatgtggcccagaagtggttgtatagtggtggtttagtaccaccttgaaagtttaggtgggttaggatctgcttataagccttggtgctgcgccatgattggggccaggttcgagaggcgcgacgagttcttggagggggctcgccgagcaggtgaagtgttgttggcccaaccgggaaaaagcctgatgaaaattcaaattcaaattaagtacaaattaaaatccatgtgctaccatggtagattatacatgcttagttactctactactccctctgttttatattataagtcgtttgattttttttccagccaaactttgttatgtttgactaaatttatagaaaaatttaacaacatctaaaatactagattagtttcattaaatctaacattgaatatattttgataatatgtttattttgtgttaaaaatactattatatttttctataaacatcatcaaattaagtacaaattaaaatccatgtgctaccatggtagattatacatgcttagctactctactactccctctgttttatattataagtcgtttgattttttttctagccaaactttgttatgtttgactaaatttatagaaaaatttaacaacatctaaaatactagattagtttcattaaatctaacattgaatatattttgataatatgtttattttgtgttaaaaatactattatatttttctataaacttgatcaaagttaaagaagtttggctagaaaaaaaaagtccaacgatttacagtatggaactaagggagtagtagttagtagatggtacatctgatgttaatctcaatttttttcttgtttttttctcctaggatctctttagtggagggagtgagacatctgcaaccgtgatccaatgggccatgtcggagctcatgaagaatccaagggttatgcgaaaggtacaggctgagttgcgtgacaaactagcagggaagccaagggtgacagaggatgatttgtccgacctaaagtacttaaagctcgttattaaggagaccttaaggcttcaccctgcagcgcccttgcttgtcccgagacaatgccgtgagccgtgcaagatcatgggatatgatattccaaaaggtaccaccgtatttgttaatgcgtggctattggcagggatcctaattattgggatgatgctgaggtgtttaggctagagcggttcgcaaatagtaccatagacttcaaaggcatggacatggagttcataccattcggggcgggaaggaggatgtgctctggtctagcctttgcggaagctattatagatctactgttttctaccctgctcttccacttcgactgggagctcccttgcggaatgacagcaagtgagctggacatgatagaggagatggcccttactgttcggaggaagaacgaccttcacctccgccccatcctccgtgtgccgcaaactcaaacttcttctgcacttctattttgtgagagagctcaaacttcttctgtatttctgttttgaaagagagttcaaacttctgtttgttttgagagagtacttttgtttattttgttttgagagagagagagagcgcgcgcgctcaaacttcgtttgcacttttgttttgagagggggaatgcgcactttatttcggtaaataaaatgaatcacgacgtggtttcatcagaaaagaaataaggctataaacttcagtgtgaaattctacaagtcaaaaaaaaagttggtgcatctgcaagatccatttctgggacatgcgctctgactcactaaggcgatacagattattggaacaatagatttatgttctgaaacagggatgttagatttatgttttaaaaataggaagctagattatgcacttcgagaaatgcttacagttttttgcacgataaatacactaaatctttgtactcctgttgtaacaccttgactaccattaataaaatagttataaggtagagcccctctacctttttcagtcaaaaaataaataaatacactaaagctgagcagcaaattctgtacaatttttccaggttaacatatggataacatgatgagaatcaacagctctccgatgggaaactacagagaagagaaaaacagatataattcagcaaatctacatgtcgaaagctgaccaaaatcaagggcaacctggtatccgtccagaaagtaaaatccttcactatttctcacctctccaaaatcagcaacaattttacaggctttggatatcttcattaactccggtctgaaggagttttggagaatatgaattacaggcagctgcctaggttgtcagcaaatccgccactggctgactagagaaggggttttggatcacaaatttatcattttttttctaggatttcagcagatgcaatatatcatgtaaacagtaagaggcatatcaacatcgatgtctccctttcgcacttggagcagagcaatccaacagcaaacagggcgatgagacccaaagcaaaagaaatgaaaacgctaacaatttcagctgaatcttcacagcaactatctaaatgttgcaaaactgcaatatgatatacatttctgggttctgaagctatgcttggtgagcaacatctattccagcctcggtaatgagctgttctgtcaacgaaaagagcccggcaatttccttttcagcatcaagaatcatatccatttccttgtttggtttggtcttggaaacaattctagtactgtttacacttggcgatgcaaccagattgatgccagaatcagttttgccacttctcaggaatcccttagccatatctgcaagtttcttcaatgtagtagtagcagcaagtgcctccacctccgcagcttcagtttgaagattttggagccccatatgaacggaaaaatcagaaggtctcttgatgtcactaggatctttcaggaacccttccaacttgtctacctcctccttcacatcccaccttctcattaccgccttcagctcttgatctttcgcgtcaagtgcttcatgggcagctcttaaatccatgtccttctgatgcaaggattcttttaacatctctatgtcagcctccagttgattatgcttgtgcaaattggacttgagggctgtacctgtgctcgaaatctcatcatccagcaatgcataaatgtccatctcttcgccttctactgaactagcaagattgccagtgagttcagctatcttttgcaccacagattcagcttgtgagcaactgaatttcatgctatccaatttattctgtagtgtctgtatgtgttgttctttatcctgtaattcggttctaacctgaacaagttgatcttccttgctatctagcagctgctttagttcaacaacttcactgttcacttcagcaagtctgcgttgtgtttcagaaagctctgaatccttctcctgaacagctatttggatagattccacctttgatttcatatcttggacttcatttcgggcttctaacagctcagattcttttatttcaacaagctttaatgaattgctgtgctcattttccttctgaacgagcgccttttgaagcaactcaacttctttggttttctcttctaagctctctctttcttttgttaacactgcttccagagactcaaccttctccttttcctgaagtaacagtgattcaagttcatgacagcgagactgtgcagcattgagctcctttgccttgccttgaatctccaaccgagcagcttccaagttctggttgaaagatgaaagcaatagcctttgaccagagagttcttgaacttgtttctgcatctgcactgcttgatcttctatctgttttcgagaggaggagaaagcctcttttgaagcgattagttcagaccgtacagcatccagcagagacctcacacgtttgaagtcactgactgtatccttgataccatccatatccttgcatgctagttgcgccacttcctttaactctttctgtgctgctaaccatcccatattctgcctctcaagttcttgctcggcgatttttagtttctgttcattggcctttctcaattcattcgatctggaaaaatcaatttcttttcttttaatttcactccggagctccttaattgttgcttcttgctgctcagcagcctgattagcttcaagaagcagctgttccttggacttgatctctgaacgcatcaaggttacttcttcattcttcttcaacatatcttgcttaagcttttccacttcagttaccttctgagaaagcaaatcttgtgagctggcaattttcttgtcttgctcatcaacaagaagcttcaggttatcgatctgcctcacttgtaaaaccagatctctacttgccttacccagtgatctctccatttcctgttgccttgcatatgctctattgatcccacgctctctctgatcaagatccttcttcgcccggttcaggcgtacctgatcaa

SEQ ID NO: 26267 - DNA, 2124 bp, Oryza sativa
caacttctgcctgaacagctcctgtcgggattgcagaaaacagtgtgcatcagtagactgctagaaaaaagttgcaacaggacacctcctagtgaacctatctgcaaaaatggggattttatttgtacatgaaaattctcccggtgaaccaaaggactgaaatgatatagtatgccaaagttaactctgaactaaaaattcagaactatatttattcacacatagtttcaatcttcagcaaagcgacatagcgcagcggatgaattttgatcccaaatctatcgccacacacaaactacaatcgctaatagttctcgttaggttctccgttatcaagattagtttaaagatgtaccggaattgaccaccgtcaaaccaatttcagccaaaaaactcctaattaaaaaactaccactaccaggcagcacaacttgaactagaaaaccaaaaaaaatccgatcctccgtccccttcaaaccgctagtagacgagctcggaatcggaaaccgaacgagaacacacaccaccaacaacgaacaacgagcaacgagagaggagatacgaggagatgggaagggatgctcacatgtgtgacggggcggcacgacggggagccgcagcggagaaccgccgccgccgtcgccggcggcgaggaggaaggggagaggggtggcatggcggcctagcacgtgggtgggggggagggagcggatcacggccgcccgcgcgagatcggacggctcacggcgcgcggagacgagagaggagaggagatgatgatgtggaggccgaaccggacgcgtgtggactgcagtgcagtgcagtggagtggggtggggtgtagtagatgattgatgactcgagtaagcgtgacacgtgacgctcgtgtcgcttgctctttttttttctttttcttttctttttgttttgtttgttttgatgggtttgtgttgcttgctgttctgggttctggtgccgtttcgtttttattcgggggtacgtgaggacaggaaatgctgggctgtactacgtgatgagagaaatttgaattcgaagatgtttaaagaaaccgaaaatttggaaggattttagtgggattgtcaccgttggatgggtgatgaagaaccctggccgttggatcaaaaccgcccgcggtccaccgtaggagttctaggtgggccttgtccttcatctgggcccaaaaacgggagcgcacctactcatctaggctgtgctcttttcagtgagttcctaactcacccccttgtttttagcatgcataaattctttgcaaaaagaaaagaaaatcttatgaaagttgcaaaaaggtgacatatttttgttctgctatttctgtcaaaggaagtaacaagtccagtctcttcaggagtagcaggtaaatagagatatctgagacataatttgctctctgaatgacaagttttgcatggatttgtttctgttcttcattttttttctgtttctggtgttcttagtttttcttcgcaccacatacagattctccgattctcatggtgtgcactgcaccatcctacactaaccctagcaagaatgaaatatgtatatcttgagaatcctttgtaaaagtgtaaaaccttattgtccctcgagaatctctatatcatcctgctatattaaaatattgtcccttagtcaccttcattctttcttttaaaaaatgtcagaaaaatggagttctacgtggtgaaaagatccttcctttcttggaatggctctggctcttcagtaccaacatgcatggtaactgcacatattttgcacataagagtatctctaacagcctctccaaatcgaactcctaaaacacccatatagccaactctccatctgatttagctagtcaaattaactgtatactccaacagcctctctattctaccctctctattttgactatgacaccgggacccatatgtgagccactcccttattctttctccccttccttcccctcttcctcttttcttttctagcgttgacaagaagcaggcggcggcagcaagcggggaggggacggcggtgaatgcagcgtccgcgggaggcggcgctgcgtggggaccggcgggctgcgcggcgggaggc

SEQ ID NO: 26268 - DNA, 12294 bp, Oryza sativa
atgggctctgtggggcccaccattggccagccaaataaagtgaccaaatttggctagtggagggagggttttggccagccgatagcttagccatccagttgaagaggctgttggagcacgtttttttggctagaattgctaaaatttggtttgaagagtgggatggagaggctgttggagaagctctaagtaaccgatgaaatactgagaatcacaacactgggaacaacatgttaactttggatcagcaccagatatgcagaattttacaagccatggtacaaccataccgaaaacagattgtaacaattaaccatacacacagataagtatatctgtgagatgacaagggaagcacccaaacctgccggtaaacaaggcataaacacgcatgcagaggtaaacacacaatgctccacggaaggaaaccaataactcctgctgatgaatgacagataacttataattctatgcatcaaactacctagctgaaggtactgtctcacttgaatcaactgcctcgtctattgtatctgcttttgagttcttctcttctgtgatgcagtctgaactatcaggatgagacgaatgagatgagtcctggaaggagctggtcagatcaggcttgaacatctcatcattctccaagttggaaagcttctcagcagattctcccttgagcagctcaacgacttcagacattatcggcctctgttcctgtttgttctgactgcatgcaagcccaacaagcaccattcgcttcagttcagcctcgacgaagacatccttgagctttggatcagcaatttccttgaactttttgtcacgggcaagtggaagtgcccactccgtgatagttagcttcgtagtggggtttagcttctcaactggcctctttccactggcaagctctagcagcagtactccaaagctgaagacatcacagctttcagaggccttcccaagcatggcgtattccggtgcaagataaccgagtgtacccttcacctttgtagtgacatgggttgcaccatctggaatgagctttgcaaaaccaaaatcggcaacccgtgcttggaaattcttgtccaacagaacattgcttgacttgatatcccgatgaatgatatgtggtgtcgcttggtgatgaagatatctgcatggtagagagagatttcagatgtaagattacttctgcatgtactgaaagttgtcatactgttacagcataatgaatatttcataaggatgtaaaacatgcttacgcaatcccttctgcagaatcaatagcgatcttcattcttcgttcccaaccaagatggcattcagctgcatgctgtccatgaaggtgggagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcagattgatgctattttcaaccataccattttttggtaaagctgccaaaaaaatgtctatgtttagtttgttgtcaaatttggtaaatacataagaaatcctgccaaaattttagcaatattgtcatcttaaattttggcaacattgccatcttgctaaaattttggctacaatctgaataggcccgtatttttttttcaacccaaaatgaaacacaactcaccgggatgtagcagtttgggggttatatcaccatgcaacaaactaacaagtaccaatgtagaacagtttcatcatcttcataataaatgtgcaactgtctgatggaataagtcttacgctgttggtcttcttgtgctaattggtctttgtgttctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgccatgtccgcaggacagtctcagcgcttggtcgcctcgagcgcgcggctccggcaggaggccgagttcaccgcggcagaggaacgcgagcgagtggtggtagagaccgctgcgacggcagcgagggcgtcaaggctggcggcagcaaaattggcaacggtaagggcggaagtggaagcggcggcggcggcggcacgacagtagcaccaacagctctatctccgcctacggcagctccgatgatgagctgacgagggaggcagctcgtgagcgggcggagcagtgggcagctgcgcaaccccacgcgcgcaatggcggcagcttagattggcggggatgcatgtggcggcggcggcccagacgggcgtggacgcggcggcccggttgggtcgacggagatcgcagccgttgcaagtggcatggctctccctcaccggaccggtaccatggtcaccacaggatttaggccgtcatcagggaagtcggccctggcggtgtgtggcctaaaccctaccctcaccaagaccaactacgtcgagtgggccgtggtgatgaggataaggctccaggtgcgacacatgtgggagccagttcggcacggcgacgtcaactacgacgaggatcaacgggcgcccagaagcggactgccaaggaggcctgggacgccatcgctgcggcacgcatcggaagcgaccgcgctcgcaagtccacattgcaggcacttcgcaaggagtgggagaacctggccttcaagccaggtgaggatgttgatgactttgccctccgtctcaacactctgctgtagaagttggtgtcgtatggcgacgacacctacgatgaggagagagccgtcaagaagctcttccgctgcatcccagagaagtacaagcagattgctcgctcgatcgagtctctgttggacctctccacgatgtcgatcgaggaggcgataggtcgcctcaaggtcgtcgacagcgacgagccacagcctctctcgaggcttatcaccattggcaggaagcttcatctcactcgagagcagtgggaggcctgccagggtgacgggaagaagagggagtcctcttcctcgacaggccgcaagcgcggcaagggacacgtcctgcgaggacgcacccagggtggcgcccgcggaggcgcctaagccggcgcgagatgacgcctgccgcaactatggcaagtttggccattgggccaaagactgccgacagccacgacacggccaggccaacgtcgcacaggtggaggaggaggaagagtcggctctgctcctggcacacgcaagcatcgagctatctccagcggcaccggccgcagcggctttcctccaacttgatgagccgaaggtacgcgccttcctcggagatggctccagcaacgacaagactgatgagtggtacctcgataccggcgccacccatcacatgactgaccgacgggagttcttcaccgagcttgactccagcgtctgaggttccgtcaagtttgggggtcggctccatcaccttcaccgccaaatccctgtgctcaccggagtctactacatccccgctttgaggaactctatcatcagcgtgggacagctggatgagaaagattcatgcttgttggtcgagcacgaagtcatgaggatttgggattgccgtcgttgccttcttgccaaggtaacctaaggcaccaatcgactctacgtcttcaacgtgcaagtggcacaaccggcctgcctccacttcgaggccctgaagcggctcagtgccaaggagatggtgcgaggcctgccgtgccttgaccacgtgaagcagctctgcgacgtctgcgtgttaacaaagcagaggcggctcccctttccccagcagataagcttccgagccaaggagcggctcgagctcgtgcacggggacttgtgtggcccagtgacaccggccacaccaggaggacgacgttacttcatgctgctcgtcgacgacctctcccgcttcatgtgggtaatggttctcggcagcaagggagaggttgcggacgccattaggcgcgcgcaggctgctgcggaggcggactgcggcggcgaattcacggcggctgaattcgcatcgtactgcgctgatgagtgcattcagcaccactacttcgcgccgtacagcccgcagcagtacggcgtcgtcgagcggcacaaccagacggttgtagggatggctcgagcactcctcaagcagagggggatgccggccgttttctggggagaggcggtggtgacggctgtctacatcctcaaccgctcgactaccaaggcccgtacgaggcttggcatgggcgcaagccggcggtctcccacctgcagtttttcggctgcctcacgttcaccaaggagatcggccacatcggcaagctcgacgacaggagcaccccaggggtgttcatcggctaagcagagggctcgaaggcctaccgtattctcgacccagagacacagcgtatgcacacggcgtgcgacgtagtgttcgacgaaagacgagggtgggcataggacaaggcggtggacgacggctcgactccaacgtacgacttcactgttgagtacgtccacttcgagggagctgggggagtaggtagctcttattcactgagtgtgcctacctagcccccgagcctccaccgactccagcagcgacacgctctcgagctacgacttcggctgcaatgagttcttcgctgacaccatcacaaccggcgaccccacgcactccagcaccaacagccacccctccgggcacatccactccgacgccaggttgtgtcaagcacagcccggtggagttcgctactccgctctctcacgacgaggagcgcatcgacgcataccacgacagtgagccgctgcggtaccgtacgacgggagcctcagtctttcgcagaggccgagagacacgcagcatggcgtgccgtgatgtagtcggagatggacgcggttgaggaaaaccgcacctgggagcttgttaacctccctcgtggtcaccgcgcgatcacccttaagtgggtgttcaagctgaagagggatgaagccggagccatcgtcaagcacaaggctcgcttggtggcacgcggtttcgtgcagcaggaggggatgccttcgcccccgtggtgcgatccccggcaaggagggcaaggtgctcctccttgcgctggctgctcaggaaagctggtgcgttcatcacatgaacgtcaagtcagcgtttctgaacgacgacttgaaggaggaggtctacgtacaccagccgccaggatttgcgatccccgacaaggagggcaaggtgctactcctgcacatggctctctatggcttgtggcaggcaccgagggcgtggaataccaagttggattccacgctcaaggggatgggcttcgagcaaagcccgcacgaggtagccatcaaccggctgggcaatggaggaaatgtcctgctggtgggtgtctacgtcgacaacttggtaattaccggcaccaaggatgcggaggtggcggcgttcaaggaagagatgaaggccaccttccagatgagtgacctagggcctctcttcttctacctagggatcgaggtgcaccaggacgactccgggatcacgtttcgatagaccgcctacgccaagcgcatcgttgagctggctgggctcaccgattgcaacccagctcttactccgatggaggagagactgaagctgagccgcgacagcaggacagaggaggtggactctatgcagtatgggtgtcttgtggggagccttcgctaggctccccacacacggccgaacttggcattctccatcggctacgttagtcggttcatgcagcgaccgacgatggagcactagcaggctgtgaagaggatcatccgctacgttgcggggactctcgaccacggtctctactacccgaggtgtcctagaaaggcacacttcgtcgggtatagcaacagcgaccatgccggtgacatcgacagcgaccacgccggcgacatcgacaccagcaagagcacaagcgagattctcctcttcctcggcaagtgcctcgttaactggcattcggtcaagcagcaggtggtgaccctgtccagctacgaagcgagtacatagcggcctccagcgcttcgacccgctctggcttgcgcgactgcttggtgatctcttcggcagagacactggagcggtggagcttagggtggacagcaagttcgctctggccctagcaaagaaccccatttttcacgaacggagcaagcacatccgggtgaggtaccacttcatccgaggctgtttggaggaaggaagcatcaaggcgagctacatcaacaccacaccaaggactagcttgcggacctgctcaccaagccccttaggaggatcaagttccttgagctttgttctaggatcgggatggcccaactttcccacaagacgacgcacaagacttaggaggagaatgatgaaataagtcttgcgttgttggtcttcttgtgctgattggttttgtgttctttttgcttttcagcttttaggacaggactagcatctttcagtttgggatgcctgttaggacagcatctcctttcactttttagattagcaagccagctgtaaatatgtatcccaaccccccggatggtatggcatttgtgagaaataaacagaaaattgtcccaactctcttagcgccatcctctcgataagagtaaggattctgttactaacactatcattataatagtatttagtatatttttctttcatgtgtttaatcacgtaaacaagattaatccataaaaaagactatagctatcaagtattttacacgttacaggacaaaatcttgcctcatctttcacccaaatatcactatcagcatgctacttattttttctggctcctagtagactaggtgggacaaatacactgaagagaagcacaatagtcatctgtctttgtgaagacaatgtgattttcaatagcctcatattccggctgtatgctttcttttgtgttcataccttccaattatgattttttctagcttgtaatcatgcaatccttgacaagactattggtataagcgaaaaaaattgataactgaagctaagaataagtcagttgtctactcagaccaaatccccattagacacggccttaaaccgcacgcaggtccagtttggatggccatcatgttcaaagaatatctgaaggtagcttttaaaaaacggcaaccattttatactgctaattaataccactagacttttttttttcaagacgacctacacaagacaaaaaagtttctattgatatagcaggaaaaaattacaaggttaccactagaccatgaacaacgctagaagtggatgtcagttaaacaacaatcatcaacatcactgggtccctccaatgctttgccatttttctaatcaattagaaaaaaaaaagaagacaacaaactaaagtttgtgcagtgtggactgcatgattctcagatttcttcctgttctttttttctttttcaagattgaaagaggaacacctcacctgtgatccatcccagagctggccccagtagacgctgccaaacccaccctcaccaagcttgttgtcatagttgaaattgttcgtcgctgactgtagctccttcagcgagaagatccgccatgtcgtctccttcttcttcttcctccggccaggtagaaccctgagtatagaacaagcaaacagatcaacaaacgagcttcatttcctcttcaaactctcaagtacggactcttcttcccaaaaaaaagaattggcacatttttaacggattaattagatataagtttccactatgtcattctatttcagcttgctgaccaacaactgcaatccgagagcgaacagaaaaattccccaatacaagcagagaaaattccacgcatcatttggttcatccatccaatgaaaacaggtgaatgttgcggtgttgtatgctcgcatgattaatcagcaaatcacacacaaaaccacaaaacttgatcagcaactcaccatttccccaaacaaaaaccattttctgcttcaagacacttctcagctcccagcagaaaaaattctccccagaaaaaaaaagttcttcttagctaatcaatcgagtaatctgttttgagcaaacccatcgaatccaccaacagaactaatcacaaacaaaattgcaaatgtttaccgacgattccacccaacaagtcaaaaccacccccaccctcgtaagtcataacccacccaaatgagcaaatctcccctctccccccccccccccccccaaaaaaaaaaaaaaacacaccaaacaggcaaacagcacacacgaatcaatcctcaaatcgccagatatgcactcacccgtccacccccttgcagcaggaagcccaccccatcgccgccgacaccgccgcagccccccaaatcagcacgacacccctccctctccggagacctcccgccgcgcgaggcagccccgcttcctcccctcaccgccgccggcgaccgcgagacagctggttgaggagagagagagaggagaagacgaggagacccgcggcttcctcctctcgtggtggtggtggtggtggtggtgtcggctcgtcttctccacctcgcactactcgcgtcgtctcgtcaccgcgcggcgcacgcaaaggcaagctcgggggcgcggtcagctcacccacgtggggaccgaccgggcggggtgcgggtcggacacgtggcgggcggcgagtgggccgttttgaacccggtgaggtaacggtcgggtttggggtgtgggcggtaacgtcacgcggcgggtgaggggtcggggtcggggtggggtactggagtggctgacgtgcgggggccaccaccgggggcgatgatgacctggcagcttgaaggggtggggccctcggctgttggtgggatggctacgtttgaccaaaggaagattcctgtggcctgtgggtgagacttttgctgaggtttgtagtacttcctctgtcccaggaaacgcgtcgttctggcgatcgtcccatcgtcccagtaaacatgtcgttctgctgcttctgcattactctctccgtctcgaaaaaaaaaaaaaggcaaactttagatttctgtgtccaactttgactatctatcttatatgaattttttttataattcatattttcattgttgttagataataaaacatgattaatattttatgcgtgacttgtctttttaattttttttctaattttttcaaataagacgaacggtcaaacgttggacacggaaaccagagtttgtcttttttagacggagggagtacgaagtaggagtgtgcaagttaatgtggtttttcttgtggttttttaatgcgttttgtagtacagggaatagattttactaaattactaaactaatgcactaatgagactattaaagagctataggggtgtttatatcagggtgtaaagatttgacgtgtcacattgggtattatataggttgtttcatagagtgttcggcactaataaaaaaactaattatagaatccgtcagtacataatttattaagcctaattaatccgtcattaccaaatgtttactgtagcaccacattgtcaaatcatagagcaattagactcaaaagattcgtcttgcaaattagtcacaatatgtgcaattagttaaatttttagcttatatttaatactttatataggtattcaaacgttcgatgtgacggagtgaaaaattttagggtgggatctaaacagggccgtagtttttgaccaattcatttgagtactttgaatatttcaggcgttctactgttagtactcctgttgtcttggtttgtctcatttagtacgtgaatttttagtgcgccacaacttgatgaccacgaccgatttggtatcactatcacacactcgatgattatatgttggtgtttataccacgaccgatttggtattacttgctccgttttaaaataagaacattttgtcctcttttttccttaaaaaattaacttttaacaatcatggtatcgaagtttataaaaatagagaataattgcattcgaactaaataaagtaggagacaattacaatggaatttaataaagttggtataatttattctttttgcttttgtattgctaagcgtgggatatgggtgaaaaatgaacttattttgaggggatggaggccggcggggtaaaatatataggacactttggctttgcaaatttagaccgacgtgttgttttcaacaagtcaaacaagccaatgctagtaaaaggacagtggcatatccagctatggcgtatgcagaatgtgcgttgatatttaggacctattcagatttgaggaattttgtgggccaaaattttagaagaattgaaccgtttgctgtaaaattcatacgtttcgaaggagcatttataatttgatctcaaacaagggcgcaaaagttagagagactgctcaatgaaggcattttactttgtgttatcatactgtataaaaaccatccatgcgtaccaagcaaaaattttcacaatttgaccctttgcaaaaactattttacaaataaaccgtcaccaaaacttatttcaaaaataacccttggcgttgaactaagacatctcagtgctaaatagcgtggcgctgaatatgcgttggcaagccgacttagtcacccatccgcggtggcacggtattcaacgccagttgacatggcgctgaggtgtctaagttcagcgccaggtgatttagcgctgaccaaaagagtcaaatttgaaataagttttgacagcagttcatatgtaaaaaaagtttttgcaaagggtcaaattgtgaaaatttcaacgtaccaagggactaattattgcctactattttattatgggatttgcccatatatacatacccagagaagggaagacaaagatgcaataccaaacaataagataagaatggaaagagacaaatgcccctcacaaaatccacaagtgaatgccatcacagctggtagccccagaaggccagaacaggactcctgttggtctcattgaggttagctagccagccactatggagtggagtagtgtattatggagcatagtgacccatcactttaataagcaccggtgattggcacgcttcaatcatggctttgtatctttgtgcttgcaaaagtctcaagcaatcccaaagcaaagcagatggtaagatgttctgcaggaattttgtaatgtcatcatccaatggccatggctttggccccaattgacctgttctcacctctgcctgccctcatcacactaatttttttaaaagatgatcatcaaactaatttaatccactaccatcaattatagttgaaaaagaaagccaaattggaccattgctttaacccgaaaaagaaaactgaaccggtgcttcgctcgatctggtccaattcaaacactgtttatgtaatcgaaaattcgaaccgctctaaactatttgagttgggcaacttcattgtgaatcatgaattaaagtagagattttggaccggttggcatggaaaagagttgggctccacgtatatgaatgaaccaaagaaaagcccaacgaccagaacaccacaattttaaacctaaatcacttaaaatggcgcaagttcatggttgaaaaaaaaacatataaatgtcataccttatggcctaacttttttttttcaaaacacaattaaaatgcaagcttttacaacacaccctacgtccctacacatatgagcacctccgaaaaactaggacagtatatattgagattgacgaagtcatcacgggtgtttcgctgtcaacgttcaagt

SEQ ID NO: 26269 - DNA, 877 bp, Oryza sativa
cgaagaacatcctcaaaaccagataaaaaggagcctctggaggtagaagataaagacatcaaacagaaggcagagaatgaagaagatgaggagagcgaggagacccatactatgcctggcatgctccctaccaatgttatcgaaatgcttgcagcacgtgagaagtatgtgtacttcccttgcaccgtattcagtttttttttgttttttttttttcaattttgcggacttaattggttactgtcgtccttttctccttcaggcaaaccttctcatctgactccgaggaagagataacaaatcagaaggttcagaaaaggaagaagcggttgaaatcttccgggtacttttttcatgtcttgcagtctcatatgaattatgtggaaatgttacttatgctagttcttttgccaatgtttgtcaggcctgaaacaattctgttgaaagacgttcgctcgacacagcatgtgaagaatgcccttgctttcctggagcaaaggaaaaaccaggtgccaagatccaatgcagttttaaagaacgcgaacaaagctttgcgcctcctttcatcgaagggcaattttttgagttgaatatggtaattgcgagagcaaaggattttctcaatttgctgttaggtatgtgcttcggaagacatttatgtttcagagggatggtcttttttgtgcttttatttgagatgaattggctttcacatcccaggcgcacaacgggcatatcgatgagcatgaaactgtacaatacgaatgtttgcaaatgtaatatgtatggtgcgtcagtatttgacaattctttgggcatgagtaatttcttatatggaatattattgttcattacttctttgctaaagaaaatggga

SEQ ID NO: 26270 - DNA, 673 bp, Oryza sativa
aaatgtaggtgcattattttaatctggtatagatttacatgagaaatagctaacatcatcatgttgaaatgtacaagtaacaattctacacggctatgtaccaaagtgaacctgaaaggtctccgtataattctcagtctatcaaaaagtacgtcaggtatgtctgctacaacagtagcaggtttttatctcgttattgatatctacgaccagcttccatgaaatctaatgcttggccttggcccgtgtttcccatttccaatccattagggcttctaaaggacccgttcggcagagagttagggcgatccacggacgtgggttgcgcgttgttctccagctgatcagggttgagaatgtgccgggcgtatgcgtgaggccataatcctgtcatcgaaaatttgaacaatgtaaagccgtcagaaacattaggagagacagatatctgaagctcgagaatatacaaaattacagtacaacttcagatatttcgtacagaacatggtattatcaatcacgcgatgcccaggaaattggccataaaaatttcaggtcagcgtattacagtacgaaagatatgtcaaaatacagtatcaaattgtactactcaaaatgaccctttgggggtgattttcatctctgcaataatcatgaagaaaagtagtctgaacta

SEQ ID NO: 26271 - DNA, 1404 bp, Oryza sativa
attcctgcagcccactagtactataataatggtgttgctaaactattacagacagaaaggtacttaggagatcgatcacataaaagacaactacaataatagtggtgcaagtatttaggagatcgatcacctagaagacaactataataattgtgctgctaagctattacagacttatcagaagccaaacatacgagtgaagcttgagcatccacaaaaatcaacatgcagttccaatctgctgctccaacttttacttgtagaaacttatggatctgaatctctagctgcattagagtcctccaaatcagtcctcactggcttcagtgtcttgaggctcttttttctcttgaacctagcaaagaatgtatacactgatatataagaaaaagtgtgctcatggatcacgaatttcaaagtaatataaaaaaaatacaagttgctataggagtgagaaatatacctgaacatagccttctcgtactttgttaatcatatccggaagcaaattggttgcaaaataatcaaaccccaaactatgaatagcttcaaaagaggccttcttgtcaaaacttatcatttcttcgattctgcgtttccatacatcggacaaatcgtcctgccaaaggttcttcaacatagttttgtcctcgcgagacaaacgtgagtagttggtctcagacaaattcaactttatcatgtctgaggatgacaatccaacccaacaaatagatggcacggaaatattgaaattgtcatatgctgaattgcaagaccctctagcatacgtagcaagaatacttataccttcaggatctggatcacaaagtccaaagacaggtagtccagtgcgttgtttcaagaatctgaggaaatcccttgtttggagggttggcatgccacatcctgtcagaattatacagttgttattggtgtgatagtccatctctagtagataattcaacattgtatgcttttccacaacaagaatatactctatgttgcgtgaacctatttcaacacaaacatctttgatctggtcaagcctgtgtggtatctgcactccaatagaacaactaatcgatttgccatttgtcaattccaggaaaatgtttccaactacaattcctttttcagctgctattatacccaaagagccccttctgatatttgtcaaagcgcagatgtcattgatcgcttgatctgatttactttgatccccaaacagatccttgtttgtgtataagacagttctcttcgagatgttcaatccagccccaagtgtccgttctattagatcaatggtatagccagtcctagatgcaacttcccgctgattcgcattgcaaaaggaacggcttatggtcttgcctgcttttgctagagaaaccttgacttcctcat

SEQ ID NO: 26272 - DNA, 4753 bp, Oryza sativa
tatcacttatcatgggcctacatgaaaattacttcgttactgattttgattgctaccctgagctatgcctgagaaaaagtgctgcctgagagtttcgtgatattttgatgtttgttgcctgatgaggcatatctgagttggttctgtttggttgaagacctgaaactaaatgtgcctgaggaagattaatagtcacaaaacaatgtgtagggtaaaaaatgtgtttaattctctcattagtccaagacagtcgatagctcgctcattcggttgaagtatccccaaaattccaaacacaaatatcttctgccagttgcttcatgcaacagcatgtggccggccagattggaagggctttcggcttctttgcgcaatgtggcagcgacggcaagatctggcagaacagcggcgcaatgttggcgggatctgacaaggcagcagcccagcggatcacaaggcactgcgctggagatgaagcaaggctaggatttggtttgccaaggatccaaacgtgcccgattcaaaatcacccaaatggaccacagggcacgcgcacatcaaaaccgtagagaagagagcaagagccaagagggagagaggaaaccgcaggatgaacaaaggaagggaggagattcacctttgctgcgcggtcgggaagaggccgcagcgtcaacaaagtcgccgtcgcttttcgccggaggaacggatctgagcgagaggcaagaaattcccctcctctctctctctctctctctctacagtacttgtttcattaactgattttactttctttttttttcttttactgtttcagtaaagtagctttcatcgtccgagactccgagttcaaatggcattcccttcgtcgcataataatcatttttagccttcttcctttttcctaaaataagctggctttaagttttttttttaataatgaaatataacatccggtctgtgcttaaaagagctacaaccaattattacaaactaccactctagaaactaagaaactagtgtaattcaaataaattgaaaacaacaaactaataaaaggaataacccttatatgaaaaggagtacatatttattgaagtttgagaatctccattcataattggcaaaaagttgcataaccgtcgtctcgagcttacaacatgtaacttttagaagttcttcatcttcatcatacctttgtaattgtacccaacaccggagccaatatgttgccttgaaaattacctgcatatatgaaatagataatgatttgtcaaaaatcatatcattcctactcaaccacagagcccaacatattgcagaagctccaaccaacagaagtttactctttttcctgtccacccctaaaagccacctataaaaaatatgagatatgctaataggaaggtataaaccaaaagagaattgaactgctatccatataaactttgcacaaagataataatagactcatttttcatacataaacaacaccttaaactaccattccaattacgtctagccaaattatttttagttaataccatccctttaagcaagtaccacatgaagatcttaatcttaagcggcatcttaagcttccaaattatcttatttctctcgatacagccattattaatcaaagctaaatacattgacccaaccgagaaccatccattctgattataattccatataaaacaatcagaagatggtccactgggtatgaataatataagcccacacattatgccaagatacaagattctgactaactaatgccctcctaagagaaacattaagcggaacggaaccaataactctagcaattgaagagttcttccttctgacaatagtatataaggaaggatacttatctttaaaagctaagttccctaacctatctttccaaaatcttgttttttccccattattcacaatccaataacccatatttaagaaagtactcttgactttcatgagatctgacaaaaatgagaatcaccttgtttcctatcaacttgggttatagactgattataaagatattttctcttcaataagtcctgccaaaccgcttgctcatttattaactttgtcgatgtttaatagtcacgactaggatattttgatggtatggggatcgttggtactagggtatatgcgagattgaggtaaaagagatggagacagggatttttatataggttcgggtcccttatctgacaggtaatagccctacaacaattgggataacctatcctaccgtcgtcgacttggcggcataaacaccaactcgcagtcgatgagggggtagtcttcctcctcgaatatgatctcgtcgacatcagagatggtgctagatccctcttgccggcctctgtaggtactggattgggtttatctaggctaatctgcgatgtcgatatctggcagggtgtgttggcttgcatcttgtggcttctatgttgtgtcttgtggtttgtcccctctcctcctggggggcttgtatttatacccataggtgcccctttgtccaagtaaaactagggagaccaatatggacacaatccgagtagtccttatcgtttccatgtagaactatatttgtccttccttatccagaactccctctatgtatgaggtttgtttccatataataagacatggtatgtggtgggccctgccgagtttagtcgattactattgggtatgtggtatctataaccctgacagtagcccccaacttcaatacaaatgaacgagttgatgttctcaatcgaagactttggaataactattgtcgtgctcgcttgaccgttctcggtgtgatcagaaataacgctagattcctcttatcagtctttgtaggcactatattgggtttgtctaggttaatctccgatgtcaaccgagaaggtacggagcatgcgactaagtctcctgtcttgccgtaatcgagaatttggattgaagtcaagaaattccatctcgacgggtacaccatcgcttcattccatattacttgtcaagctccatcaaccgttctcgagtaatcgagaaggtgcaaagtttgcgacaaagccttgaaaatctgacttgactgttttgatgtctgactttcctgaaatcaattctcagaacagaatattaaatagaaatagcccctgagcgaacgctcaaagggcaatatgtatggaaaaattgaaaataaattgaatatatgtgcggcaataaaaaaatacgctcgctagagtttccctcagcaaacggagtttggtacccttcctagcccccaactgttttttatggaaaaactattttccacaaagacagcttgaatcttataacaaaccaagctaaagttgacaaatcctagcctccggccgtgaagttggaaaagtcaatttccgattacacggcttggttaatacgcatccattgagcattcttacatgaccaggttttacatggttgttcggctcttataatccaacaagaccttatctgctctgggcgtccccagccgaaattcccttaggtttctcggaggtttgttagaacatcgtaaagggacagtaggactgacttcaagacgaaggtgatataagaaaggaggatcaccagacaaatattgcacatataaacacttacagaagttgacgtatatgaagtgatgagatgacttccacaccgggtaaagacctggtgtatagttgctggtcgaagaccagtcgtagtcgtaccttgaccattagaagtcgtggtgcgaggaccgctatgttgctggtcgaagaccagtcgtagtcatacctcgaccattataagtcgtggtacgaggagcgctactttgctggtggaaaaccagccgtagtcataccccgaccattagaagtcgtgatacgaggatcactacattgttaatcgaagactagtcgtagtcgtacctcaaccacttgaagggaatccagagtaatggattgacgacgttctcgtgacctgcaagaactgtctcctaatgacaacaaagacaaggaataattatcgtagttggaggtttggctcctcgacctactaactcgttctcaggccctctagaagtctgggatctcgagtttcgtcgtcgtcatgtgatgtcgttaaccttgtccattgtcgtcctgatgtcgttagtcttggacgtcgtcctggtgacaacggcgatctagtcggtcttggttgtcactatcacgacaatgttgattgtcgtgttagatgtcgagagattgcagtaaccgactggtcaagtactagtagtaggcgtatctcgatcacgcgaagatgaatttttagatgatgagagatcactacgatctactggtcaaggaccaggtgtaggcgtatctcgatcagctggagatgaatttttaggtggtgagagatcgctacgatctactggtcgaggaccagatataggcgtatctcgatcacctggagatgaatttttaggtggtgagagatcgctacgatctactggtcgaggaccaggtgtaggcgtatctcgatcacctgaagatgaatttttaggtggtgagagatcgctacgatctactggttgaggaccaggtgtaggcgtatatcacctggaggggcgctagagtttctgattacatgtgtatctcatgtggccagcatgactcacatacccaacttgtagcatatccggatgtctgttcgcaaccatgtcgggtgatcaagccgacaacgttcatgagga

SEQ ID NO: 26273 - DNA, 4113 bp, Oryza sativa
ccaccgtccgcatgtccgccgccgcccgtctctccgccgccgctcgcctcgcccgcctcgtccgcctctctaccgccgctcgcctcgcctaccttttccgcctatccaccgcctcccgcctctccgccaccgctcacctcgtccgcctcgtccgcctgtccgccgccagccgcctgcctctccgcctcgttcgccaccgcccgcctgttcgcaccgtccgcccaccgtcgcccgcaccgtcgcccgcaccgccgtgcgcgcccaccgccgtcgcccgcaccgccgtgcgcgccgtccgccgctgtcatgccgactgccgagagagagagagtggaatagagagagagaagagagagaggaagatgggaagaagtgtatgacatgtgggtcgcacaatttttttaagatagaatgctgactagactgccacgcgtatgtcacgtagaccaaaacagctctgggttgggtcgaggggtgtaatttgtccggtattgaaagttgagggtgagcgatgtctggttttgtggtttaggggggtaatttggacgaccgtgatagttcgcggggagggggggtggagggagtaattcgtaccttttccttccctctatggtttgccatcttttaatttgaacgagctgcatgctccaatttcaacccttagaggtttttttttctcataatgcaggtcgcagatggctactagaaattctaatcagtttgaagtcttctatgttattactggctaagtataggagtagtatttactactgttgaatttcatagcaatctgcaagtgttgcagagaggtatatgtcctccagacaagtttactccgtctaattagttattgcaaattaagatgtgcaggaaatcacacattcacacttgatagattggtagctatttctattatgcaaagccgcataaacatcagtagagatagattgagctttgatggtcaaattgcacattctttaaaacaaatgttttctaatccacgagtgcttttctaagacttatcacacaactctctcgctaagtcactctaagtcattatcttagagtggcttcaagcttgattgtagaagctttgttagctccctccttgccgtttcttcatccatctcggggtgcctcttttgaaaacgttctaaatacgtctccactgaatttttgacatcgcgttctcgcttttgagattctgaaataaaggaagaagataagaaagaaaccagataaaactcgaagtgaccatgaaagcaacctaccggtcagcttttcctttctgttcttattgtcctccgaaccttcgccttccatcttctcttcctttttcaccgagactatttatttcctataaacgctatcgacgagaacgagctaggaatgttcttaatattttctctcttataactcttattactagtattacttatcaactcgattactgccatgtggcatccaaaaccaaccacaaccagaaaatatccatgaagtttcttctagcaagaggttaaatatttgctttgaatttttttcttcatcttattttaagatataggaaatatcttctatgaagaatatcttctcatagtacaagggcccattcgttccagcgttttgattttgattttcagcggcacacaaaacaagacaagctattagcgcataattaataaaaaaataattattttaaacttgaaaaatggagttatctgattttttttaaggcacgactacaaaataggtttttgcatacgggcgacaagcattttcgcatgcggttgggccagccgcatggacaaaaagatctgcgaaaatcacggtctttgcatgcggccagcgcaaccgcatgcgaaagagaaaaaatagcgaaaaaaattccaaaaagaaaaaaagaaaaaaaaaactagcgccgtcgcagcccaagctcgtctaaagtagtgagagaactaatctttctcatcaccacaatgagccacatcacttaaaatattacagccgttggatcaaactaacatacaaaactagccttctgatctttgagcagcggttcaaatatggttaagaaaattcatgattcttcaggaggcctcgaactgaacactccggaaaatccaatagccgaacaagcaagcgagaagagctgagagagatcatgatcatcaattgttatttaaccttttatgtggacttctatttacttcagtaaattgttctgcctgctgatatgctttgtgtgagcctcttgtcactcagtaaaagaaagaaaccagataaaactcgaagatgatccaagaaaacggtaaaacgctatgcttatgatcgttttcttggatcaatataaacattgcaatggagacgattattttggcatccttattgtaagaaagaaagttccttattgcaatggagactgcacatatgttccttgaaatatgtttcagacttctgttgcttaacagcttgcgatatgttcttttactatggtgtaaacttctattcattagatttaaagaggtagataatgattgcactgagctctgactctggataagcagtatgttaaagcataatcaccttgaatatagcactgtataatgctgaaaagcaatagatacattttgactaccattctttagttctccagaatagttttttatcttgtggaacactgacaaacaacatgttgaatttgctgtcagtattgatcctaacaattcataatcaagcagtattttgagataattcccaccatgtatagtagctgttatatgggctttcctttccctcttttacacatgtgacagcccacatatacacacttttgaaacaggtattaagagtcgtgcaacgcacgacttatgtggctagtcatgatgaaactagtaaataatatgaattgacgatgaacaaatttctcagatgttacagataagatctctgctattccccaatgtgcatctctaaaaataacaccttttactgagtaacaagaggctcacacaaagcattcagcaggcagaacaatttactgaagtgaaactgatctactaggttccatggccaaatctacaagttcaacatctgtgaagtcaactagaatctgaaggtgaaaccgtaaagtcactagaatctgtaactgaaacatatctactttctccgtttcacaatgtaaaaagtcattctagcattttccacattcatattgatgttaatgaacctagatatatatatatataacatcaatatgaatgtgggaaatgctacagtgacttacattgtaaaacggagggagtactaagtttcatggccaacaaacaaatctacaaagttcagaataaattgacaaaccagtaaatacaaatactgcaagagcaagttcagggtttagcatcatgcagaaactgtaagttgtgacaattccctggagtactaagttgagcatcatgcagtgtgcggagagttcagcgtcaacatgcactaagttcagaaaccagtaagattcagaaactgaaagtacatgttcatctccggcgacttgtgcctccagaccggcctgaatgcctgatcatcttgttcatcacctccagccacctcttctcctccatctcccttctcctcgtcttcgttacctctacctaggaaaaaaaaaagacttgagtatgaaacgagatgcagggcaatcggttatattaatacctccccccgattgaagctcccacagcgatttggagtcgcgtgttcgatcgccgcgctatccacgtcgcccctgaatgcccaagtagccagtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcgcacggcacggcccggcacggcccgtcaggccgaaagcgccggcggcgcgtgacagggcgggcggcggtccaacgggaaggcgacacgtggcagtggcactaacggctatttg

SEQ ID NO: 26274 - DNA, 5571 bp, Oryza sativa
ctttgttctcaagtgtgcattttttttgattttgacaaaatttgctcaaattttgtcaaaaatcaaaattagtttcgtagttcaacagtttgatcgcagaggtttgaacagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcaacctttattttgtgtgtatgctcaatcttttctactccatcagcgttgtgcatgtcatataattaatttgattgttaagactggcatgaagagggtaggtgaccacatcaatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgtccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttccatttttaattttttttccttatacatttcctttccttttttttaaaaaaaaaaacactgtgcttcacgggccgccgtgccccgaacggcccgtgggccgcgggcgttccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctggtagccagatttcgcgagcgagcgccgggctgtgggatctggtcatttttcaaaaaaaacctctattttacccataatttgttatagatccctagacgtacattcctcagccatgtattcttacgctccggccctcttaaatatgaaatatcttatgctaagaagagaaaattcagaaaacaggagtgcgctctgaaaagcgtaaagtgaggggtctttttgcgaaaccgaacatccctccaggctccacctcccccaaaacctagctgccactcgactgctgttcccctcttgctctctcccttgccctcacggcggcggcggccggccatcgctcgcttttctccgccgtcgacgaccagtccccttcctcctccatcgcccctctcctgcggatcggaaatgatttctcctcgtcccgatttgacctctggttcaaccgatatgaagcaagcggcggccgcgcccgcgaagagcaccggttcgtgcgaggatgctggccaagagaggtgatgattttctttttctctttttggtgcgtgtgtgttggtgggatgggcttgggactgagctattaggtcttgatgctttgttgcagatcaaggaggagatagctggcggtcactgcggcggagtgaatctgcctggaacttgttcgttcttgatgtcattctcaagagcactgcatctaggcagtggattttgcttggatccgcttgtgctttgactccggtctgatggtatttggttaaaaaatgtcaggtctactttcttccctttcccttacctcaaatgattctcttatggtttgtggctggaatggagcaatcgatttggtaaaaaatgtcactcagtgcaagctacaagacttggccttgtgctgctggagcagaggttggctgcctaccactgctgtgttgtgtgctgcgacatttaatcaccaaacaagtactaataatctactgatttatcttatgttaaatgacaggaactcctattatctatcctactgttttttgggttgcacaattggaactgtcaaagatgggaggatgtgttggttgatgttctaatgctatctgatcattttcttctccaatgagaaaaaaaaatgaagctggcattgcaactcctgcaatataaatctgggcaaccgttcagccttcatatatcataatgtgttcccagatttcgaatgatatgttacacatgaactgattaggatggctaggagaaatttggttctttctccagatgacgcagtaacgatgtaatgacctgataagcatgtacttatacaacagccaagtagaaaattgcatttcattgttcataacaactgatttggtaaacattttgtggacctaacttatgtctcatttttgccttgctgcatctaacctgctccatagaatcatttcgccgatgtcctgacttgtgcgctctgcttactttgatgtctcaggaacattatgctgacaaagtgacaattagtctggactgtagtcttggcctgaaacatatttccctgcaggcttagaatgcatattacaacccataacgtatatttgcaactgttgatactttgatttggtttacttttagaacataacctggaatttttttctgttcccaaattttggtaagttaacatgtttttggagtattttcttattttgaaattttggtccaactagctcctaccatttctaactttcatctcttattaattaacattatgattacgttggaaaaacatacctgtttaacaggtagttgccaggtcaacaatgatgcctttgttttaaagattctagattagaactgaagctacatcaagttacaaactaggcctcttgcagtatatggtcaagaataagatccactttcatgacatcaaattcgtatttcaacaattcaatgagggaagtatttcatcgatgcgaccaatcagacttatttctatgcttttgacttcaaattcaacctgctactcaagattcattggattgacatgagcatcaaaattagtgtaattagcaaagcattgctgagaatcaattcattttatatattttgcaccaaaatttgtatcctgttattgcttactattataatgaagcagttgtcctaagtgacattgagaatcagtgttatttgtaataacaactagatcatgttcatggtgcttgctgttacaataatgtgatgatcaatttttattaactacaggtttgattttaagccgccgacattgtgtctatgcacaacttgctgttacagtgatgtgataagtaatttcattcactactggagaattttgtaatatttttttatacatttttgttttgatacacgattcgtctaaatgaattgatacatttgggttttaatatcgatagggcgcatcttgtgcgccaaaatgtctagtaaaccaaattccaaatgaagaatacctcatgtacaagggcccattcgttccagcgttttgcttttgattttcaacggcacacaaaacaagacaagttattagcgcataattaataaaaaataattattttaaacttgaaaaatggagttatctgatttgttttaagacacgactacaaaataggtttttgcatacgggcgacaagcacaaaaaggtctgcgaaaatcgccgtctttgcatgcggccatcacaaccgcatgcaaaagagaaaaaatcacgaaaaaaaattccaaaaagaaaaaaagaaaaaaaaactagcgctgctgccgccgccactactcctgtcatcgacatcgccgtcgccagctgctggtacaaccgcaccacccagatccaccgctgccacggctgccgcggcagatccaccgcccaccgttgtcgtcgccctttagtcgccgcctccgtcggtggatccgggtgggggagggccgccgccgtcgcccacgtccacccccaccttggccctcgcccaccgccgccgctggagtccgcgttgccggaggtcgtcattgtcgccaaggtcgttgttgtcagcggggctgcag

SEQ ID NO: 26275 - DNA, 11828 bp, Oryza sativa
  unsure (1)..(11828): unsure at all n locations
gcacgtcgcccatcgctttaggtcgagctcccctctgccatcgagcccactaccgctcccgcccgctgtcgcccaccacgccgccgctgccgcccgccgcgccatgcctagagatggcaatggggacccgatcactgattccccgcggtgaattcacacattaagggatggcatggctgatatctaccatccatggggaatctaaaggtctaaaacccatcaccatcggggatggcggaggtggggacggtgcaccactccctgtccccgtccaccgcagtgacccgatttcacagtagctagggacatgttttagactttatagtcattttggcgcaacaaattgaagcccaataaccacatgtatatatatatatatatatactagaaaaaatgtccgtgcgttgtaacgggtaaagacgtttttttactgatatattaagagctgagtaataaattgaaatattgggatcgctatatacattataattgaaaaagttaatgaaaatttttcctgggtttagggtcaatagccttccttccattttagccttaggccagtctcccgaagatagatccgtggcagtacggttgctagtcccgtggccgtacggttgccggagcaaatctccccatcaaatctggtcgaatctttctcgatcacctaaaattggttgagggtttttaatccactcgatcttctcttcccgctttttccaaaatcagagtgtaaaactctttgtttccccatcaaatccggaaatccggccaaatctttttcgatcacccaaaattggttgaggttttttgatccacgatctcctcttttcatttttttttctaaaatcatagtgtaaaacttgggataaaaatgatcgaggaagattgccgtcatcatcagcaattgttaaaggagattaaatccgacaaattaaaaccgaatcggaagggaaaataatggaaaaaatgatgagggaggaatcgcaattgttaaaggagattaaatccgacaaattaaaaccgaatcgaaagggaaaataatggagaaaatgatgagggaggaatgaggaatcgatttttgcaatcaaattggaggagaaaacgcacaatcgatatggtggcggcacggcgcccaggttcaactcgggaggcgtgcggcgaatgatcggattaaaaaaacagatgagaaaaaacagaatcgcacgggagaaaaaaccggtgacaaaaaaattgacaaaagaaaaaaaataaaagcgcccgggaggcgcgatcggattaaaaaaagggacaaaaaaaccaagagcgtaagtgcgtgcgaaaaaaactctttcgcatgcaaaaaaaaaaagtcggaaaaaatacccgtggcgagactttttacggaagtcggactctagatttttttttctatttttactgacgagtgacgacagaaggttttttttaatcgcttttgagtcggacacatttttttctttttttacctctttgagtcggactgttttttctttttaatagacaacgtaaattttagtagagaacaacaaaattaaaaaaatcgactcaaacacggatgacgtaccaaagtacagacaaaaacatcttcaatttttataatagtagagattccaaccctagtcaaccatctccctctcccctccaaagctccacgacgcctacatagccgtcgctgccgctcaagatgcgcgcgcgccaccgccactccagaagcgcacgccgccgcatcctctcgcacgtgcgaggtcccgacgagcacgccgcctccagccatcctcgtgccgtcgactgcatccagtcctcgtcgcgccgccggccgcctccagccctcgtcgcggcgccatcgcctccagcctcgtcgtgccgcccgccgcctctagtcgtcatcgcttcgccggccacctccaaccatccgccgtccaccgtctgtcgtcccttctctgattctctctacgggggtaaccacggggattaattcaccgcgtggtgacgggggtgggtgaaatgtagccccgtggtgattcgcggggacggggacggtgaaattttaacaccacggggatggggacgcggatgtgaccctcgatggtgaattccccgttgccatctctagccatgccgttctaggtgagtgagtgagagagagagaaagagaaagcaagtgtgtgagaggggataatattattaggggtatttgcaaatttgccaccggttttttcaattttacaaagatgccactcgaatgacagttatagtggcatttttgcaattttctagtagcagtcttgcaataacaatttaaagcagtggtaaattttataattgccccatattaataagtgagagagagagaggactgagaggagatgaggagaagataaggttggggtgaaattttgaacgggtggagagggaagggggaggccaatcaaacttcaaggccgatccttaaaagatccgtatgtaaaaatcgattttcgcatgcagctctcttaagaggtccgagcattcttacatgcggaccacttaagcttcacatgcaaaaatcgatttttttcatacaactctttaaacttcaaatcgatatttatggcactaaatctactcgtatggtcatgtacagcaacgaacatgtgcaggcatttgggtccaggcatacatataagtatcacacaattacatggcacattatattaaactacatgctcccattgattttgacgagccacaaattgtttggtgttcatctctcctacttttcaaaaaaaaacacctttttttaatgattttataggtatatacacatttagaaagaaatgacataaatataccattgtttaccaccggagggcaacggtgcaatacggcaagtcctcgggacctcacaaactcgcgcaattaattaattaattagcgtcattagcaattgattaattattatttctttaatttaattaattgatgattcgtcccttgtgtacagtatgtatgctgctcctttatatacgtcgtttgccctgtttgtttgtcatttgtggagattgactaggagacaaatttgctttttatggatcttccgtctcaaggaaaaacagattagaagttcatatagcctgaatgcaaacggtgatcatgctttggagcaccaaattaattaatactagggccagaataaaaaaaatgcaatctacataaaatggtctttgattaaggattaatttggtactaatcaagcaggtcagagaatatgtatttgtcctcaaaacatagtgaattttataacaaagtcattcatactctgcggtagaaagggtaaagagcaactgcacatcctagacaacaaacagttatccaatccaaacgaagacgcttcaacaacgaaacacccatccctcctggcagtgaaggcggtggaggagaatcatcaatagaagctgcctcgatgcgccgcaggaacgatagcgtccggcttctgttttcaggagctgcaattatgaagtcaatgaactccataatctctgctctagtgtatctctcatctcttggtacaattccctgtattaaatcaaagaaaataaatcatattagccaataaccaaattaaatcttcagttaactatcagtttattgcccactgacctcagaggaatgaagatgagatgcaattgatttagcaaattcaatgtcggacatattattcttacgatattgtccaaacaaatgatctagcagcagtgaataacgctctgacatataccccaaataatttaaaaaactcatagctcttaggaactctctgtcaatctgaaataatgagacatcaattaatatatataatagttgtgtgattgaggagctcgtgtatagaaatagttatgtgattgaaacaaactaacatataccaaacaaatattattagatgaaacccaaaacacattagatcaaaagacaacctattgcttataatttcttcgttttaatttgcagctatacattatattcacacatacctatgaacaatttgtatggtgagcatatttcacacttgcaacgtaatttagacaatgagcgcttcagctagtttctttgccgtactggtatacatctaatggctaattaattagagtcgttagtcgctaattagaggaaagggatggagctggcttgcgcaccaagccccacccacctgtggatccgccactgaaatatttagatatttagatatttgctagacctcaagtcacaccaatcaaaatgaaactatcgtagaaaagagaattacctctcgtggcgagattttgaatccatattcttttatctgcttagacattgccttgcttagtggaagataaggctcatgagttaaactttgctcttgaggtaacaacttatgtaggacatagttcagtccccatgtcaattcaccgacaacagttggattacagtaacaatagatattctgaaaaattataagaatatgatatattaggtaaacaatgattattccacaaaaaacaaaagaatcctactccctccatcccaaaacatcatcacatccacccataagtatctgattataaagttgatgcttactaactcctaaagctaaacatgtatgccacatcatcacccattagcaatcattatttaaagtatttaaatcatatgtaagtatgccacattatgacctactagcaattattataaatatcatgcaaacatgacatatcatttacaattttattgtattttcagaactcaatatgaagcaatgtcaattcattatctaccatttttataatatataatatgcattcatccacatatcccatatcccgcagcaaagcacaagggtatcaactagttatagaaatgggactagctatatagcactcgacaattttttccaatcaaatcacccggatttttgtaaccaccaaacatgcaacaagcagcgtactgttcagactaaaatagatgaattatatatctacaaactacttgacgctaccaagcaacgtccaggttcagattaacaggcaccctacgtggacagccaaaaactcgaaaccatgacactactaaaagaacgctgaactagtaacttatcaacatatctatagaagttacattgtaattatatcgaatcgaatcctactgccccgatgttggtgggtaagctacctttaattttttggagcattattagcacgaatctcaacaccagttggaggtggaaaaatcaagtgatttcaaaggagaattttgtcgacaaagatttagcaaaatcgatagaaataaactcacaagtttcttctcgataacatctttaagctctacatcttgaacaattaagtagttgtgagtgcaaaagcttaggataaattctttcagttcgtcaccaggaccaacaataatatccctagcaacagatttgttatggatctgaatagaacccagggtaacaataacctgcaaataggatggcaagaaacacatcaaaatatggcctaaaaactaagagatcgagaacagaaataaacacattagcattgaaaaaagtaaaatgtacatttgtaatgtcatcctgataagcaaatcgtgcccatatgtcctgcaaaaaaaaaaattgattatgagaaataaggttacatcaaattagggtggtggaggacaagttaaggttacatcaaattagggtggtggaggacaagtttagtaccttagggcgtgcaatcagttcctgtgaaacttcaaacatcgcgaaaccagaaggaatttcaaacagcatcagcttaaatccagaagtctgcataatatttgcatgttgcctgcaagtgcaaaaccaaagttacagcatttattttttttgtttgtgattttgtataccccacatttatctctaagtgattcaagtcatctcagaaaaaggaaaaagatttttttacttacccttttccaacaagaggtggcacactaacatcagaaactacaggacacgtatggtctaaagatatcctctctgcctctacagtctgtcaaagaaggttgtaatttagtacataagtacataacatttgtaacaaaacaaacaaaagggagaaaaccaacctcagttttatatttgccttggacaaagattaacggagtgggactcctattggtagagtgcacttgaaaaattgcagagacaaaaaagttaatcttcatatcactaaacaacaaccatttattgctctaaacagttaagttaatgaacatagcaattaaataagaagctgagtgctaaacttggtggtttacacggtaggaaatattcaacgatttcaaacttcacttacctttttcataaatagtcactgggagatccttcagggaaaggttcattgcaggattgaatagaagataaaaggttgttccactagcatccatcaactggataaaaatagtacaagggaagaaatgtcatgcaaggagtaaaatcaaaatgtatagcacagatcacacagacatacatttgataaatatttccaatacattctcaagctaaaaccaaatttcaaccattccatccatccacacaaacaagctagagctttacataaagtttaagaacagtgcacatcccagcatagcatatctaattgtctattattgctggctgttacaccagccataatcattccgtgtacaagtttaaaaccaaatattactcagattctataagagctcaagcaaatgctaaaactatatcccaatgtcctgtaacctcatcaacatttttgagttttcattcgtacagcagtcagtgaacattttatccccaatgttaaactttgaatgcaaccttaggggaaaaaaattgtttgcatttcttcataatatgaccaacgtctcacataccaacagcaacatttcttcataatatgaccaaacactaagccaaatgacagtctgacagattaagcagttgaacaaatatagttgaattaaatgaatggctgtaaatactcacagcctggttggtttccatatcggtgttcgtcacatgagtgtcaatggagtaccacccaagaatggccaagccagggaacgccttcttgtctgcataaccaaacaatgtacatcacaacacaaacaattaagcaccggcaaagtcctagctagggtttaacaacttacaggtctcgagcttcttcttcaacaagtcgcggtcgagggttccggggtcggtgtcgagcaagatgtcggaggtgtcgacgacctccaccgtccgaccgcgctgcaccccgatcacgcacccatacatcctcggtggtcgagcaaccgcacagggaagaagagcatcctccggcgccgtcccggagctgtaccagcctcgcgttgcctggtaccggtaatcgtgcagacggtactcgcggatgcggtcgaataatttcaagacggcgagggagtggaacctgaaggtcagcacgtcaccggcgccgaggtcgtcctcatgcggccgcttcaccggagggaaagctgcggatggatacgcggtgaggaatccctgaggcgggggcggcgggcgcagcggcatcgccggatcgggggcggcggcgatggggaatttggggtacccttgagttttagggctagttttggtttggcttgacacttcaaatagtacgttgtggatgttaccaaagctaatacaactccaatacatagttgaaccggtggtgggttcggttccccgagttactcggactcgggccggacgttcccggtccaccattctatgtattatttattaactgttcattatatttcacaacaaccagattagcatgctggtgggtgagttgccattacatccagccgactagggatcgatctctcacactgcattttattaaacccaaaccccccccccccccactttgctttttttttaaaaaaaaaaacatacccgctttttattttattgctagtaactaaaaaaacatacccgtctcccccctccgcattttaatcttattattatttcactatgagaattcgcttgaatgtatatttttttacaaaatcatgtcaagttagcatgcaaaaaaaacaacgagtgaaggctattttaatcttattattagttcactatgagaattcacttgaatatatatttttctagaaaatcatgtcaagttatcatgcaagtcttttttacagagatttcttatacgactcatctgtatttccaaaattctttatgtattttgcaagttataacgtgttctaggcatatagtccgctatgtgtacatggctttggagatttaggtccataacttgctccatcctgctagtgatgtttaaaatgattattttagttgactaatctaatcttagttcataattttagagtttatattattttacgacacattttataattagggatgttctatgttagttacttaacataccaacctagaaattgttatatgagttaagtatgctaagtttttgggaactaaggctggaaatatgacctctctggtctaacaagttctgttttggtttattcatagctagagtacattttaaatacctctacacattttttttgcttaaccattactaggtgattaacttctaggttatctatttaaatattagagctataacctgtacaaaaggtgctatattttattttactatgttgaagcttactatttgctggttctatagaaatttggttcactccatttggactaaagatgaattttctacacattttacaaattaacgtatgctctaatgttgtttattccttatataaatatttagaagcttttattatacagcaagtatatatttttattttataacttgtaaataaatattttggtgattctacagaacttgagtttactcaaaaaggatctaagatgaattttatataaacttctaaagttcagcttatctaaaactagtcattttagaggtaatagttttagaggcatttgatataaagtgtgtatatgttttattttactttgtttttagagaatatgttggtgtatctgtagaaactaagtttgcttcaatttgagttgaaattaattttctatgcattttataagtttgtgcatgctttatgtctgatttaacttagataaattttagaggtgaaatttgtaccgtgagtgcaagtttttatttcatagctttaaagttcatattctggtgagttcactgaaatttgaatcatctcaaaataatctatatttgattttatatggattttacaagttctaggtatctctcttgtatattctcagattttatctccaggcggtccactgtcagtctcttaccatctttcaaagaagtccctagactttaggcctgttcactttgatgccatttttaaccttaccaaattttggtaaagttgtcaaaaaaatggctacatttagtttgctgccaaattttagtaactatataagaaattctgtcaaaattttgacaagttaccaaaattttagctgcacagttgccaaaatgctaaaatttagtaaggtttttttttggcaacaaagtgaacaggcccttcatgtgaagttcacttaggtccatggatccacatgtcattggtttgtatgttttcatatttaaccctatgattgttcaaattttcaaaacaaagtccctgccttcctctccagtcgggcagagacagggcaggccatggccgagctcgatctcaagcttgccagcgacaaacggtggctcgtttgagggtgcgaccaaaagacaaaatgaaggtcatattattgcgattccatccctctacttttctcggttagtggacatcggagtaacgccggcggcgagtccgggcggaaaacgttttcgggtggtggtgcatgtcgtgctatagacttgatctacccaaagaaatgcatgcatgtatgttttataggctgcaggatgctcaccgagattctagaaaaggttggcgaagcttggtcatccgtaatagctcgcgaacaggtccggcggcggcaaactccttcgggttgacggcgacagctcaaaagactccaagatctagcgtgcatgtgtgtccatgaggttagtgaggtcccagggatagtgtatacgcgaagaatcggacaatggctcaccggaggaggcggaatcgacaatggcgacggcgaccggaggtgaagaagacggtggccgatctccgtacttgctgcgccattgcctgggattattgaggggttttgaagaggacttcaaggagaagacgttggcgtgatggctcggctcggcttggtctacagcggtcggaacgacgacgatgtcggctgcggcggtgcgcagagctccgggggccacggcggcgtttccgtcgctgcaatggatgaaatgagatggtgtcaaagggtaaagtggtaggcatgaagtgaggaatatggaacgagaaagagttggtgatgacgatggctcgacgatgaatgcgagctcctccttcttggcggtcgacgacgagcaagaggtggagagggagagctgaagctctctccctggcttcctcggtgtggaaatgaagtggagacgagggcgacgcgtctgggagaggttgaaggcgagcttggcgacgccacatcgagtccacgcgtcgagcagatcgttctctcggtttccctctctctcccggctgttatctcgtctgctggtcgggtagagcggtggaggaggaagtggacagtgtgtgggcaagccagggatactgccaggtgggcccagggcgaagggaacaaggttggagtgagagaggtgggtagaaaggttggtgaacttggttttggacgaattttcaggattatttatcttctccatctttgttaattcatagattaatttgtggtgcatatcaattcatgtggattttactggaggtaggtgtatgtacctagtttccattttctttggttgcacttaaaaattatggatagattacttacagaaattatgagaagatgagctctttgaaaaatagtttgaatttttaggagaactaaacagagaagataaattatagaaaatttatatttactcatcataaatgtcctagtatttgaataaactatttcctctatatacttctatgcagtttaatgcatattttagttagctattgttttagcctattaagaactatagttaatctagtttttgactggtttgtctgatttatttgaggtatcaaatgtagttattaaattataccaaaattacagtgagttgaatgtagtgagaatagcctacaagaattttcccgtgattttatcttgcacaaattattttagataattagtaagacttatctcttatatgtgtttccctttcctaaatgcatgtaaatatttataaaaattatatttggactcttcttaacctgaaatgatgttgatatgttacttacacatgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 26276 - DNA, 616 bp, Oryza sativa
ctaccgcccccgggacagtggagacccccctaagcccccactaaatttttttccatagatccataggatgtggggactggaggttcgatttatgctgatgtagtttattcagcccccactactattttttttctagatccgccactgcgtagttgcattgtttcagctgttttgattggcgcgtacgtgcgaatgcggccggtctccaggtatacgtagcatgcaagcggtggtggatctagaattaatttttcttgagagcctggtcaaagcctaagcgaatgggctagataaatattatctttatcaagaatagataatgggtgttggagagctgtgtgtagctttggccttatgctcatgacagcaaaaacgttggtgtgaaagaaacagattaagcagcggtattaagtggtaattcactgactagctaatatggcgatggcggagcccaggcacctgccctagctccgccactgaatgcatgtgttgtcctctggtggtccatcagtccatgtgggtccatccaagctacaactactttgtaaagtgaaaatataaaatgcaaatcacgtatataatggaaacttgaaaactaccgttggatcgagaaatg

SEQ ID NO: 26277 - DNA, 1309 bp, Oryza sativa
aacgagaaccaggaaagccgcacaaggatcgacaacaacatcaaaccatggaagctcatgcgtgctaaaaaccatggtagactatcctgtcctccaaaaaataaagcctgaaaagacaaatatatactgttaggtgggacgcaaatattcaaccattaatcaacatgctgcaggaacaagagtggtacaagggaaatcctacttaccagattgggagaaatgccacgggcaacagctgatccgccgatggtgtattccagtatcaatgcccaaccaatcagccatgcaactctaaaaaaaatataacattggacaatgttaagaacgcccaatcaatggagcaagagagggctattcatgaacaatgtttactctattgtgtaggtaaattacccttcgccaacgcagatgtacgaataatggtaggcacttcctgcagaagggcagcgactagcaagctctgcataacagaaagctgagagtgcagctgccactccagctatcagaaatgaaagtgtcaatgccggcccagcatgctcccgagcaactgttcccacaagaacatatactccagctccaattgttgaaccaacacctgatagatcatgaaaggtttcatgaacaataaattcatagaagctgtataaaatgtggaaagacataattagacttgtggtaattcgttttcaactactttacttcaaatttagcagacatcaagcatgttatttgcttcaataaggtagtaaagtaatatttaggcatctacccacggcccacctacccagcacttacccaacaagattaaggtagaagcaaagcaataattctccaaaacattgcaagaatccatatcgagataaaaccatcattcccataattaaggagatttaccaagtactacctctgtcccaaaatggaagctatttctagctatgaacctggacaggtacattttcggatcgtaacagatcatgccgggcatctgaattccgtgtttgaatcaaaactgtctgtctgaaacgcagactaccagaaaactctatctaaaaagttcataatccacaagttgagccgtttaataaggactaatatatgtgacacccggccaatcaaagactcacaaactttacaaaccaaatcaaaacaatacaactttatataacttgtaatactcagcaaacatgacaaccaattaacgaaaatccaaacagactctaccgagaatcctgcaccaaaaaaaacaaaaaacaaacgccacaataattcatgcatagagatcacacctttcccaagcaataatccctca

SEQ ID NO: 26278 - DNA, 9030 bp, Oryza sativa
ccgttcctttgagtttagcttcagtggtgttttccaaagcttatagttaccatatcagcctacattaaacataatcatatcccaagtcccacccccactatgtttaaatttcaagtagggaacaatgcaatgttctacagtgccactaaattaagtgaactgatacattcaaataaattagttcccgactgcaacaaacaaactcagcctaagtgtgttctcaagccaacaaaaagcaagaaccataatgtaaaattctaagaataataaatacaatagttaaatccataaaagaaaagaaacatcaagcttgatagcaaccacggacacactacccagaaactgtatcaaaacaaagaaaaatacagcttcatacatactacagtaatacaatatcataatacataattcaaccaagtagcaccgaaaagtgatctcattacaagtgctcgcgtgaaattcatgtcacatacaacagaaacaaaataaaatgttaaggtacatttcaaaaccaggtgccatgcaataaaaatatgtttgagaaagcgcaccccttttgccaagtgccaccctataaaaatattttgagaaagaacatcccagtggagagcttaggttaccctggctgtgctatggggacatcagagtggagaaggccctaaacttgtgcacaaaatagatagtgtcctctaatataatgaaaattgagattgtgtcctctagtattcttaacggaaattcaagctttggttttcataacaagctcaatactgtagccccagaagtggagagaatgtatagatcattgggcacccatttttttagacaatcccatatccaagaggtagttgattcaataaacattcaaatactgtcaaaccttagatgaaatccttctttaaaacgttattacaaagttaaaaagacttttaaaatgcagcaaaaagcaactacaatgaaccataatgcaggaggtctgatatatcatacccttttgaagttggcaccataattcaccagtaaaaacaattcctggaatcagttcatctggaaacacaaatatttaggtcctttcctgaattcattaaaatttcacattttctgaatatgaatttagagaacagaaaatatgaaaattttgaagtggtattgaagcgactggtccagagtttcagacacaggtatgtcaggtttcgctagtcagtgggtacggttgtcaggatcaggctataaatttgattccaatccttgatatatatccaagtatgcaaatcaacaattatccatttctgcttgtaatgattaagaaatgatgctaataggggaagaagtgcatgattacatgagaatttggtgatccacataattaaatattccagcagcatgataatatgatccagcaatgctatgatttgcaaggccagaaaagaaagggatgccttattattttaaaccaccgctgacaaaaattgcatcacttttgaccagacaaagtgcataatttcttggttttaatcaagctgagcagaaataaaatagaagcaagcatcaccttcgaacgcatacaccattaccacaattatactcatttaccataaaacataagccaaaagtggatggccaatgtacctcaacagctgcctggcaaaaaaaacctgatcagctctgttatactaatcataaaacctcattttctacctcctagggctagattgatctcctagtttgcaatgattaaataagaaataccataagtttttagtcatgtacttttattagattcaaatttcacgaatgaactaccacagcagaaagtgaagcgtatacctctctatcacgctttcttctaagttcgattgcacttaaattagtaacattggcaggtgtacctgaagaaaattgcataaaacatttgcattgaagtggcatcctacctccgttaggaaaaaaacaattctttgtgtatagcagtgatgtgaacctgtgacgattgtagaaggaatagacacattagaaggtgtttcatttcgaacttcagatgtagcaattgtcggtgacatattttcatcactgtactcggttcctgaaacaaggcttaaatattgatgtcaaattcatgacaggaagcaaaaaaaaaaaaaaaaaggagagcattgtggtacctgttagagatgcaaagttatccttcttgctctgcttgtattcacgttttttttttgaagattggcctctttttcatcagtgcatagtgaaccgcacctctctctggcacaatttgttgtaggagaacctaaatccagaagacattattatcagactggaacatggtaccgaagctaaaaatatggcactgttattgcagcactcagaggcagtaatggagggttggtactactggtaatgatcaccgtgggtccaataaaaatagcaaagttacatactccaccaaagctgataatataggtatagcaactcaaaatattaaacgcaagcagcagtgagcttgccgattaagattaagatcaaaacttgctgaacaaacgtgagctgcgtgattaagattaagattattattctagtgttatagactcgattaatcgacaggctcccatgagttagtggccaacacattccaggatcctagctctgcctggctgcctgcagaagcacacacgaaacaacctaaaacaactctgaaactgaaactctgaactctgaaaaatggctggaaaagcgacaaatgttaagaagaaaagattcctgcaaaatggcgagatctctttactctaattggctatctagatgcatgcatataagctacggcaatattttgtgaatctaaaaaaatatgcagctagaaaggaagcatagcttgttttgttgtaaacaaacatgatgcctaatagagtatatatcgagaaatttgtggaaacaaacatggtacctatgttggttcgtggactgggttgtacgactgcggaagcatcattctcctggtcaggggtttcattttgttgaggatgggcagactttccatgtgttgtcgtgtaatttgatggcgccggcctcattagggcgcccagccttgcaacggcggtcacgggtgttaatggcctaggcgcatgtcagtgaggaattatgttgacatacataaatcaaacacaatatatcatttgaatgacagtgtgtgtataaaaaggcaattaatagaaggtgtacagcaagacatgatgctgtaaataacagaaattaacagtgaaaatattatgtgcatatatgcaatcaaagaagggaattagaaaggttaaaacatgaactgatgaaccaaagtgggtgctaatttgtacactgctcattgccaaaacctaacatttgattcagataacttgattacgcccatgaccttgcaatccgaaaaagaaaaaaaaatcatgtctagctgtatatacatggaaatcaaggagtaatcctgtactgatccagaagagaatttcagtttgcactatatgtagacaacattcattcaatcggttgtgcataatacattcaatctgttatgcattatacattctgaagtacattctcagatggaaaaggaatagagtctcgtacctgcacagcctccgccggcggcgtctccggcccctcagcctagacagcagaacagctccatgcccgtcgccggaaagaggaggagtaggcggggcggcagaaggcgggggaggaggcgcgacggcggaaggaggaggaggaggcgcggcggcagaaggcggagaaggcagaggcggaaggaggagaaggcgcgggcggtctggcgacggtttttttttttcgatttggcgacggtttcctttgagaagcgctaattggatggttaggcgctaattgcaattgcggtgttaattgcacttaacaactcgtactttttatattagtctagaataagcgttaattgcaattgcggtgttaattgcacttaacaactcgtattttttatattagtctagattatttcgacttgactaggacaaaaccaagccttttcactttggtctctgtatcttttcactttggacctggtatctttacatgttatttcaatttggactccattcttcttcctccagttccctttctcctctctcccctacgtatagctcgagaggcaccctatactcgagcagcgcatgtggaggaaaagcactgtatcagggctgtgtttagatctaaagtttggatccaaacttcagtcattttccatcacatcaacatgtcatacacacacaacttttcagtcacatcatctccaatttcaaccaaaatctaaactttgcgctgaactaaacatagcctaggtttaaccctgaaacctcctttacactgcatgtctacacccttttctgaattctgatggagacggcgttgctgcaacggaacagtttgattgatgaagacaaatggcaggataattcagagtcattccctcttcctgcatggagtgccggactcatctccttccacttttctcctcattactgatcaagcaactcaatttgaacatgtaaagtcttccagagactagttcatgggtggatgtttccggagtgttcagttcgaggcctcctaaagaatcatgaattttcttaaccatgtttgaaccgctgctcaaagatcagtaggctagttttgtatgtcagtttgatccaacggctgtaatattttgagtgatgtggctcattgtggtgatgagaaagattagttatttcactactttagatgtgacactggttttgagtaatttggaggtatggacataatactattcttataatttttttgagaagatctataaaatgccatcgacaagcaccctaatctcagaaatgacatcgacaaagccaacttcccagaaatgccattgcacaagcctctttcttccaaaaatgccatcaccgtcaactccacaccgttagaaccgttatttttttaataatgaccattttgccctcggtgcaaaatatacccagttcactgtcaaagaaaaaaattataaccctaaccctatcgctactgatcccaatccccccgatccagcattctaccgatcccaatccccgatggcgtctcgcggcggcagtccccggcggtgcccgtggcaccgctatgctagcggtccacgggggcggtgcggcgaggaagaccagggcggcgacgtggtagggcgccacgaggaggtccacggtgatggcggcgtggcagggtgcggcgaggaggagcagggcggcgacgcggcaggacatggcgaggaggagcagggcggcggcgtggcaaggcgacgcgaggaggtccacggcagcgcggcggtcacaggatgtggcgcgggggccgtaggcgccggcgagggggaggagaggcccacagcttaagtcgctgaggtcgccgtggaggaggaggctgcagtcctagcaagtggcgcaactctcagatttgaactttttccctttttgtttgatttcttttgaagactttgccggcgaggaggggaaatcccgatccggcgaggaggccaagggcggcggcgcggcgaggaggtccagggagcggcgaggaggcccgcggcgccggcgcggtagggagcggcgaggaggcctcgtggcggcggcgttgcagggcacgttgacgcggttcatggaggtgcggcgtgggggccgtaggtgccggtgagcagagccccacaggcgccaacgaggagggtaaatttgttttgcttcttttgatgaatttgaaatatgcaagagatgaattttgtgtgtggatagtagattgattcagttgtccttctgttgctgtgtgtatggccctatttttgctcagcaaaacaatcctgattattgatagcaaaatttctttctgaaagaattgcgatggcaaaatgtgtgaaattagtttgtgaatttaattctgaaataatttgattgataacaaaataatgatgtacgtgaatttagttgtggacagaaatataaatttaaatgaaagatgaatcctttcttgcaaagttaacgcatccacgtcatcaacaaaacttcgatattttcgtgagccaataagaaccatcagattccccaaatggataaattaagaagataaacatccttgatgaaacttataccaaaactagatccttccatacccttagaatcgattctttttatactgtatttacccctcctctcctctcctttgcgcgctgcgccacaccaccgcctccactccaagtcatcgtcatcccagctgccgcgtcttcctcctatccccccaccgcctccgaagtcggctcctcgtccccgccgtggccaaatcgaggccgccgctccatccaggccgcaccgcgttcctcgtcagattcaagcaccccgcactgagctcgatcgggggcaagccaccgcaagctcaggaatcgctgggatccaaaccataccgacgatgaagatgggtggcggcgaggctgaggtaccacacgcatcctctttcgctgggctgagcagctcaacaattttcctctgggagcaacagagtgggatgatgcgacgccgccatcttccacttcttcctccctatccctgcacttttgcctgctcccacgcatcaggtatgggagtggagaaggcggcagcggcagggagacacccctggaatcgtggatgccaataaaaaaaaagtgcttctttccagtttagattgaaatgagcaaatagcaaaaagagataagaggtcataagcacatgacttcattgcaaggttagtgctgcctccttcaatgtgttacagtaaaaagttgctcaagtgactcacggtgactgaacaatttggaatgaacatgcaactgtccaagtaagatgttgacctatagggatatggtgactcactgtgactgaacaatttggaatgaatatgcaactgtcaattgagatgttgacctatagggatgaattggaaagaagtacagcaagatgactgaatttactgcaaaactatgactgaattatacaagtttataaattaaggttgagtccatgggggcttagataggaagcatctctttctgtttccagcaaacaaagttcctatttaagccttaatgttttgtttgcatatatgcagatccagcaaatgcttcagttaatacttggtttggtggaattcaattttgcatatatttgctgaaaggagttttagttctttattatcgattccccagttttttttcctatgaaagtaactcattttcaattagtacacgacaggagaactatatgcagaactatatgcacatgtggctttgtatgatttctggaaaccttcaacaaagaaagacactgaaacaagatgtacttagggcagtaaaacagtatgctgcggttggatatgctaataccagctttagggcccctttgatttggaggaaaaacataggaatttttagaggatttcaatcctaatggaaaatttcctatgaagccctttgaaacaaataattgaatcctatccaatcatttgaaattcctatggaatggacaattctatagagattttggaggaaatttagcaagagcttcaacctcttgctaactttcctttgagtctatctctctcacccaattcctgtgtttttcctgtggttcaatcaaacggtcattcctgtgtttttcctgcgtttcgcaatcctctgttttacacttacattcctatcaaaatcctacgtttttcctattcctacgttttctcaatcctgcgaatcaaagtgccctagtaatcttgaaaacactttcctggacaagcacgtcagctcatgaaagttctaatatgagcctagcttgccaacatattttttttctaattccagattgagttgcatttagatagaggagtatttggcctgtaaatactatttccacaattcccttctaatcatggctgttgccttcctttactaattacaagtccaaaacacagaatttaatctgtttggcaccaaaatacttttccattgcctattattccaattcctcttatgatatgaatttaaagtcagctctgtatgcgaacaaattttcagtcgttttcacttatatccatttggaagccggagagtataattttcagttccattttcggtaacttggaagccagagagtacaattttgggcaagctagattcagtgttataatcaaagggctacggtttgttgtacaaaaaaggtaataatattacaatatgagatagggaaaatgtgatataggtgaattactcatggtcgcacaaacgggcgacttaattggctagtatgcatgaatgcaaaataatattgtgtgagcaaacaatacagaatgatgatgtgtgagcaaatagatgtctaggggtaagattgtcttttcatacaacttaatgaagaggagttaacagcacttatggtgtgattgcatttctgagagaaagaggcttgtacaatggtatttttgggaagttgtctttgtcgatgtcatttctgagattaggttgcttgtcaatggcatttcatagattttctcaatttttttctctactctattaatatgaacttcgcgttgtctggtgcgagtcgttcaaaaaatatgccacgtagaataagggtttgtttgggggaagtttcttgctgttgcagcttctcccataattagaaactcccccaaacagtttaccttttagtctagattctgagaagctatatttatttgtagaatccaaaaagtgaattagagattagaagctgtgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggcccagagggccgaggcgccccgaccccttgtgggtttttgctccgcgtgtatgggttagga

SEQ ID NO: 26279 - DNA, 4350 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttatctcccagagatggcacgttagtcctagtcagatatatgccaggcttcatcctaaccattacaggcaagatgttgtgtgaagaagggcgaacatgtagattgctaagctgacatgtggtggacaagaatgaccgacgtgactggtctgacaccggtcatgtcgtcagcagacagccacgattccacgtcgcatctgctcccggcgaaagtggaggtagttgtgggccgtctcatcagaaggtgactcggacggcaactatacaaatctccgtccatttatgaaaaggtggggtaagtccccacaaaaaagagagaaagggtgcatgtgttatccccttaagatataaaaggaggaccttgcccactgagaggggggactggacttttccagatggggaacccagaacaagggagaggctggctcatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctcaccctgagtccccggccgaaccggcaaagggaggcttgcgcggtctcccggtgaggagccccatgctccgtcatctggcgcgccaggtaggggactctgcgagggattttctgagctctcgcactctttcgtgtgcgccaagcttttccagttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccatcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccgggaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacattggcgcgcccaggtgaagaagcggacctgcacgcagtacagcgaagggatgatgagtcacttcgctcgtacattcagcggttctgtcaagtccgcaacaacataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgcaaggaggaggcctggacttggaacccctccggttccggtgtggcagcttcggccgcccccgggtccgccgctcagtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacgctccctgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccctggccgggctccgttcggctggccacgggcgacggcacagagctgcctaacccgtggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgccgttgtttccttttgaaggatcttgacttgaaataggtcactcgtgttcaatcctgccctcgggggctcgggtcggctaaaatcgccaaacggggcccagaaccgagccgtgccccggggcgtggtgaactccggggggggggggaatcggcaaaaacccacaatcgggtcacccataaccctcggtcaccacgctcccggcctggccagtctcgacatgtggatctccccaggcactagccttgacccgcgccgtttgaagctgggacctgggcacgagcccttgttcaagccaagacacagaaggatcgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactctgacgcgcccgggtagccggcctcgccgtcgctgtcgtccgcaccgtcgtcaccgcactcctcgtcggagttgaaggcaaacgtgagccgaggggccgctcataattgtcggtcggttttcccttgctgatgcgcgcgatttgcgaccgccgggattctgcccgaagagagagagagcagggaggagaggcccccgagccgaacggcggcccaaggcccccgacggccggagctggccctccgcccgcttgtccgacggtgccaggcgcccccgacccccaggatggccccgaggccactgcgggaaggccgcgcctgtcgccctctgaccccgaggtcgtcggcacaaaagccgagtgcgccccgcgtggcctctcggatggagagcgccctggagatgtggcccctaacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgagaccagctcgagcccatcgcagctgcctcacaccgccctctgggtgatgtagttcgacgtcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgtccacgtggcctggcaccctcggggggcgtcgggcccgagggtgatgtgttcgccctcctcgccccgagggccgaggcgccccgaccccttgtgggtttttgctccgcgtgtatgggttagg

SEQ ID NO: 26280 - DNA, 19739 bp, Oryza sativa
ccccattgtgaatccgcccctgcaactacgcaagcaattaagggggtgtttgagtgagagggaatctcactaaaatataaaaagtccctcatattttggtgagagctctcacccaaacacccctgcttcccgtaccaaaagagtttatccactttttttttaaaaaaaagagtaaaattaaggatagtaaggaaaaactagctagaatacccctattaaatgagatttggttgtaagtgagtgggtagttgagggctaaattaaaataggtataaatttaaactgaagttgatggatatgataagtactactacctccgtaccaaaatggatatccaacgtttgaccgtttgtctattttaaaaaaaaatatgaaaaaaaataaaataatagtcatacataaagaaatattatttatgttttatcatctaataataaaatatgcttgtcggtgatacaggtccggggtatgcgaagtatgggggagtcacctccccatccagctacgcggccctacagcctggccttccccccacacctcgaacgacgcggaggcagccaggggacctcggggtgccacgtcacgcctctcgggccctcgcgctgcctcgtcccgaggccctcgcccaaccgccacgtggcgagaggagcgagtggggcggagactcaggccgaatcgccatcaatgcacggcgccccaaccgtccctcaccgcatttaatgcggtaagggcggacgtgcggcgctgcccgattgacccacgtcaatcgggcgtgaccagactgtgaccggcctgtcgccggtcacgtccgatcggacgggcggcagtgcccccacgctccaccctgtacccggcggagtgggggcaggtatgccccgtcccatcgaagcatcatctagagccccctccacgcgagatggaccgccacaagtctccattcatttaagagggaatgacaagggtgtcccccgtgtcaggcggggggcggcgctgggccccactcgaggacggacggctgcttagctttcgggcgaaggcacgaattgtggtccggtctaagcggagtgggtccccttcccgtgaaggagtaggtagaggtggtgcatgtggtatccccttgaactataaaagaagaaccttgcccaccgaggaaaaggacggctctcagttagcctaaacctcaggggaagaagagcgagagtgctccctagtgtttaggaacctttgtgacactcaaccataaatcccatgcacaggagtagggtattacgctacatagcggcccgaacctgtataatcttggcacctgtgcacgatctcgaagaactcgaggcggatacacgatctcgatcaatgtaccctttcccccggccgaactcacaaaaggggatctctcgatcacctgctagagaggaccactcctcgacaatgctaatcatattttttttaaataagataaacggttaaacattagatatgaacaatacaaaactgtatttattttgggatgggaggagtagtgtatcaaaatccttcataattagtaaggacaaaattttcttatattctgagacaaataaaataaagagtaaatttcacaaaactacacgttttgtgatccaagttgcagaaaaccacacaaacttttgacactggcgcttaagtacatattttttggtagtgtagtttcagaaaaccatggtatcaatgaatggattcaactgtgagatgacgtggttgtttcacctagaataagaacgtggcatcctattaatttcgtgcgatggctgataataatgtcacatccttatcctaagtggaacaaccacgtcatatcacgggtgaatccattcattgataatgtggttttgtgaaactacattacgaaaatatatgttcttaagcgcccagtgttaaagtgtgtgtggttttctacaacttggatgacagaacgtgtacgtgcatcctgcatccttgagcgcagctggaccggccttcccttgtagtagcagtagtagtacactggagtagtactcttgactggtcccgttggggaactatcgctagattcgtggtaaaaaagaagctcaaccccacatccccttgggtctaggtcacgcgattcctcttctcctctctcccccatccgctccgccgccattttagggatccctcggcgcgtggcctccggtgcggtgatgccgccgcatgaggacgccctcgatgccggcgccgttgacgtgctcaccttcaggctccaccccctcgctgtcttgaaattatcccaccgcatccgcgagttcgtccatctccacgatgaccaataccagcaagcgaggatgtctgggtgcgttattggggttcggcgtggtgggacggtggatatctccgataccttcgacatcttgcacgaccccgaccccggaaccttcgaccgcgccttactggagaaggatcaggagatctgtaacgtaccccaagtcctctccccgtcatttttaggtaaggtttgattatccatctatccatcgatggattttaatttgtttcttgcggttgtttttgtgcagacaagaaggccttccctgacttgtccgttctcgggtggtactccattgggaccaatgtgcacgccaccgacacgggaatccaccatggggactacaccgacatgcaaatccaccagaccgtcagtatttataaccatttaaatcaactctatttgttcgagtgcttttagtgcttggcatggtactagttgggatgttcagtgtggacaacaattaatgattggaatgtctgctggaaatccctgttgcgagaacaccctttgttagacacgtgcttatatctacacccgtagagaaagcagctattctgttgtctagcatgaccatgcatagctttagcacagctttgtatgcatgaaggtgaagatgagttttcatgcattttttttctaccttatgaatatgtagtctgatatagaaagtcattgtgtaaaagttcttgatatgattgttttgattgctgaacacaattcatattggaagtcctttaaggcatgcatcacccaaagctaactggctacatgctgaaagtttcttttcatcctgctggaaatcacctaatggaaagtttcaccgttgaatgtctcctagtagaaagttttaccgttggaagtctcctaatagaatgtttcactgttgaaagtctcctaacagaaaatttccttctccatataaagtacatttttaactttgttggaaatctgcttctactcttttcagaaccctaagcaaaagcaaaataaattattttccatgcaagccaagcagtgaatctgtgtattaaaaaaatcccagtggctactggtttgaatgcaaaccaaaaaaggtgtatcatggacttagcttgcaacaagaggaaaatgataagagttcctcgctcatgcaaacactcacatccacgtgccatatttttattcatgtaattattttcgcatgtttatacttacaacataagttgataaagtagcttttagtgcttgcggaaggttggggactccctcattatagtattgatggtcgttaacctcttgccataacctaatcattgtaaacacattttgcttctaataaggttgtattcaaagtttaacatttgaggatacaatgttcactcctgagaatgaaaactgaaatttttgatgaggtaacatgacattgggatatagttttagcattattttaagttcttggagagtctgagtttaactagtatgcgaaatgattacagctgatgaaatagtcaagaatagtagttatgctgggatgtacactgttcttaaactttatgtagagctctagcttgtttttatggatggatggaatggtggaaaattgattttggctgagaatatatgattgagagaatacttgtcaaaatggatgtttgtttgatctaattttactccctgcataacctttcccttgtactattttatgcagttgatggatgctaatggaacagccttttatcttctattaaatcctgcaatcaacttttcccataaggatattcctgtgactatttatgaaagaggtaagaatcattgaatgtattgcaatctccctgcaaaaaagaatgtattgatttctcttgatccttggttacaacctgaatctgttatgttacttgaggggtttatatgtgctgcattgactgtcaaggtttgattttgcgtatgtatcaaattcgcgtgacttttgtgattctttccttgtgtgtaaactaccaagtctagcactcaatatctcattgaattgcatgttgattaactttattgtttagagcagcaaatgatagttatttagcgagctgaagattaactttcttttgcttctacaatttcaagtgttgtgcaattccgatgggagtcccccggtcagctttgtccaaggaaactatacagttgaggtttgtattctccccatgtgtttgtttagttataaatactagttaaaaacgctacaagcatgttttattgaagattgtaggagcagagaggatatctttagaccatgctgattttctctatccaagtccatgcgtagtcttcgatgttcttgcaccacctcttggagaaaagtaagtacaaattttctttccttcctatgagatatgacttcactttacaattaaatgtgggatataaaacttcacaaacaaaacaagtttaatactgtaaggctgtttggtaggttaagcagtgttttgaacaaaatctgttgctggcaactactttgtgttggctacagcctctttaagctatgtaattacagattttttttcctttttgtcacatatgccttgattctaatatatataatcgcaaaacaggctaaattattaaattactttggtcttatacctgcagaaaaaatgcatttaggacgatgttgtttgaaaccccttcgggatttgcaatgttccgtgtttcggatgttttatttagatatccggaggtatatatagcttttcattcaccctaatgtgatgcataattcattttcttctattacatttaggccctacatcttatctgattttcctttccttttgtaggacatatggtcgagttttactgatccacatactgcacaccaggtatatttaactcctaaatttcctttcatgctttttgtttgtttatgtctatttatcgctttattgttttttgcacctttattgtctatgcacatcatacgcattactgttcttttttttcatctttactgtaaaagtacatccaaagccaactaattattttagtttattatttttttgcatcttaactgtacatgtaaatcctaagcctttaaatgtgttttatacaattctatttgtatttgtacccttggttttattaagatcataagcctttaaatgtgttccgtaccattctatttgtaggtcgttcgtaccattggttttattgaggttggtgacaaatctgttgtatgggataatgatattggtcctggcgaggatatagagcactttatcctaaaatttccaattaaatcattggttgttccagatgcacagcttaaatttattattgagaaaaaccttgtaagtttacatctaccctaatgtattttaatgttgatatttatttaatttgttgtattagtgtggaattattaatgtttccctgttatatatttctttttccagaacattagctgttggtttaatgggcgtattgttcctgagttgatttggggactaaattatgccctggatgaatttgtgcctcgagagaagggcaacctatcaaatgaacgccattttccactgagcaagcaactgcatgagcagttaaaagcatatggatttagtatctcaccacaattggtatgttttctcctttgctaaaattgttattattgtctgctgaccttatccttttattgtttaatcccttaaaatattttctactgtactgtctgttgtgttaccttacccttttgtttaatcccttgctattatattgcttactattgttgtgttgccttattattttatccttctcattttagattaacagagagtttataaccagttttggtacttaaattatatggaacgtacttcaaattgcatttccggagatttacaccagaaatttgatcgtttcttttgtggacttgagatgtctgagggagagtttgtaagaggagttgcacaccgtctccattccatggaggtcagtaaatttgctaaaagcaaatagtactaataattaagtggtggctagtggctactgataaacaatttagagtaaatttcacaaaactacagatactatgaccaaactatcacaaaactacagatttaaggagttgtatcacaaaactatacatttagcaccaaatttatcacaaaactacatatttaagatgaagtgtcatgaaactacatgtttagtaactaaattataataaaactacaggtttagaaccaatttaatcacaaagtaataatgtttatagctccaccataacaatagtgctagggatttaaactctaaaagttatagttttgtgataagttcaatattaaatatgcatttttgtgatacttaacctaaaatctgtagttttgtgataaatttgatgctaaatgtgtagttttgtgatacaactccttaaatctgtagttttgtgataatttggtcaaaatacctgtagttttgtgaaatttactcaacaatttattttctttgttttatgtaggaagtggcatctacaccaggcagacgagaggcattgagcaatgctgaatttcttttggcggttcctaagaagaagtgtaacacgatatctcgtcttaagcgtatggaggcagaggataggggtacagggcttgggcatccttgggtttgcgctgctgctgttgcggtgggcttcggggttatggcaggattgtgcattgcgatgaagcgagcaaattagaactgggtaataggaccaatgagactaaattaggatccgtatgtacggtgacaaacaacttttgtgatctaaagtgaccagtaaacaaccgccagttcatcctatcacgtggcacagtaatttcttaaataaatctcaaagtatccgtgtgaagaaaaataataattctagaaaaaagattagcctattataccattgaaaagacaagaaggtcggacgcgtgggcgttacggagatcgatggtgttttgatttgttcggccagcaagggaccagtaaacaagtattcttagggtgtgttaatcatcggttcagagaaaattgacattgtgccatcctcaaaagtgggtttcgcccaaatgccatgctgggagtgggcttcgttaaaatgccactttcaacacatgattacatgctaaaatactatcttggaccaaattaccctcctctcatcttcttcctccctccatcatcagctctcgccggcggccaccatccgccttcgcgcgagctctcctccatggagaaccacaggccacaggcccctgcggggacccctcccatggctcccctccccgtgtcccctcccatcgcccccatcccagccccgccctccgcgagcccccgcacccgtcccggccgccgccgtcgtcgcctccacctctgatgaccaccgcgccgtgccttcgccatggccatgcccaccaacgactccgccgtgcgggcgcgcctccgccgcttggaagaacgggagtggctgggacgacgggttggcacgaaagatggagaccgccaacgtcggcgtcggcggcgcggatggcgtggagcgtgaccacggggtcgtcagttggggacggtcgaggcggggaggaaggggagcggaggtggaggcggatgaggtgggcgcggcagaggcgagccggcgaggcatcccttgtcagaggtggaagaaggtagtaacaggggtatttttatccgttcgggcattatagcgtgtagtcttcgattgaaagtggcattttaacgaagcccactcccagcgtggcatttgagcgaaacccacttttgaggatggcacaatgtcaattttctccttttcaaactgctaaacagtgtgttttttgcaaaaaagtttctatacgaaagttgcttaaaaaaatcatattgatccatttttttttaaaaaaaagctaatacttaattaatcacacgctaatggactgctctgttttccgtgtacagggcatgtgttcctaacctctatacatgaacacagccttaggccatcaccaatacgtactcggagcgtgtccctgctcacggccgtcgccgctccgtcgctttgccgtccccagtagagggacgcggctctacgagcgcctcggctgagggagcgagcaaggaggcgtgctgggcggggcgtggctaggggagtagcccaagacaccactccgtcctcctgtttttccctttctaccctcgacggccgccggaggaagagagaagcggagacaagagagagagagaaaagaggccgaccgtgggacaacagcgtcgcgccgccaccgtcctccctagccttctccgccggcaccgtgcccgccgccaccgcgccagccaccgccggcgccgccaccatctcctccccgatctggccgcggggggaccagatccgcacacgccggtgccggatctgccccctctagccggcgacgggcggcggcggtggcgagaaagaggcgggcggcggtgagaaataggcgagcggcagcaggagagtgaggcaagcagcggcggcgagagaaagagagagagagagagataggagaaagcggcggcggcggttggggagggcgaggagggaggtggcggcggcggcgctcgcgggagagaacgacgctcgtgggagagagacaacgcgacgaagaaaatgagaaggggagagaagccgactcggtgggtaggggtagaaaaagaatacatatgtgtgggtttggacacccattgtgggctgagtatctctatgggttacttgagattttgaaaagcccactaggtgtcccctccattgtaaggggagttctccaaatagtaccctcaggtagtgagggtactcatatagtatctctgattattgatgcccttactccctccattccaaaatatgaccattcctcttttcaacatttggcaattcgtcttatttaaaaatgttatgtaattatcatttattttattgtgacttgatttattatcaaatgttctttaaacatgatataaatattttttatatttacacaaaaatttggaataagatgaatggtcaaacgttggtcaaatagtcaacgacgtcatacattaaaatcagtacttcccatacataaaaacgaatatagtactagatgtgatatattttagtatattcagattcgtagtactagaatatgtcacatttaatactagattccattttttttgacagagggagtatggcttaacaagaaagtcattaatgtatgattaattgacttttgattatttcgaacttaaaaaatagatttatctgatatatagaaagtttttgcacataatacaccgtttagtagtttaaaaacgtgctgacgaaaaccgaagtaacatatgtatctcaacgagacaataacagggttgtgtccgatttaaatcatgatttccacacaaaagcaatttagcaaacaaattgcatcccactgtgtttccaaattttacagcttatcattttctaaaaaaaaccaattaaatacagtgaatttgaccctaaacagtaaaacaataacttcatgcatgtacaggattagggctgtcaaaaaagctcgaagctcacaagctgctcgagctcgactcgtcccaggctcgattcgaactcggctcgagctccaaacgagccgagcccgagcctgtctcccaaagctcgcgagctttgtcgagccgagctcgagcttctaacgagcctagtaatatatgattttttattgctatttaataaattggtagatcaaaatatgttatttgcatgtcttgtattggcatcatatatttattttatactttttcctcttctactaatatgattaaccataaattaattatttttttaaaaattatcctttgaagtatacattgttttaattaaaaatcgagctcggtagtcgagctcgagcttgatcgagctccgaccgagccttgtttgaaagcttgaacattttatagactcggctcgagcttgtatcgagctcgagcctaggcaggcgagctcgctcgagctcggctcgttgatagccctatacaggatatgtatgtatgatcaaatagccttcactgttgcaacatatgggcatatttttctagttagtattaatgaatggtctatgaaatcagttcatctcttgtggcacaaagggttttgttttggttgggtctcttgtctgctcatggtgtttggaagatgaagaaattattttttaaaaaaataatttttaattttaaaataaacccttctaaatttatttttaaatctaaatcttctgggtatgtcacaaaggctagcgtaccacacaccactttaactaccgtgggagtgttgtcgccactccaattacactggagcggttagacataactgtagcacaagctaaccactggtagcgagatacggagtaactttttttctccacgccatataggggtggcatggctaaaaaagctcagatttagaaataggtattgagatgatctgtttttaaaatttactaaaaacgtaaaacgataatcaagatacggtaggtcagggtgctgctcctgtttgtctgtcctttttgcggactggagagacgagggaggttgggacttgaaaacattgcatcccattcccatttccctcacaggtgttggtgtaattagtccataattaattttcttggacaattgcaggtgatgaagaaacttgtactacctccgtcctctatttatatcaatctatttatatcaaccgtccgttttatttaaaaatattttattactagtatttttattgttatcggataataaaatatgactaatttttttcataatttttttaaataagacggatggtcaaacattggatacagaaatctacaactgcgcttaaaataagacggaagtagtattacctccgtcccaaaataagtgcagccatgagtttctgcacccaactttaatcgtccgtcttatttgaaatttttttataattagcatttttgttgttataagatgataaaatatgaatagtactttacttgtgacttatgtttttatttttttttcaaataagacgaatgatcaaagttggacgcggaaaatcatggctgcacttattttgggacggaggggtactaatgaagttgattgtggtcagaagtaatgatggtgatcaaccttctggataaacagattatcaatgccagagcccaaagtacagaaagcatctgcatgcaaaatggtctttgtttaacagttaaggattagcttgatcctaattaaccaagccattccttgcagtcaaagaagatactagtggagtactcctccagtagtactacaaaacaacaactcactctctcaccaaagattcttctttttcttgattcaaaataaaaaaatccagctctgttttgtctcatctctcgtcttcttcttcctcttcttcttccctttgcattgctgtctcctgcactgcagcagcagcaaagctgccaccaccaaccacctctcctcctcctctcagctctctctctctctctctctctctctcgccgtcgcctgtgagccatgaccgccgccgccgtcaacgcctcgcgcgtcatgcgccgccgcgccgccggcgaggacctgggcgacggcgacttctgggccggtggcgccccgcgcctctacgacttctcccagcaggagcagaagccgttcttgccggcgccgccgtcgcccgcgcccgtcccggcgtcgccgccgtcccccgcggcggagtcggtggcgccgtgcctcctcacgctgcagtgcagcggcgtcgggtggggggtcaggaagcgggtcaggtacgtcgggaggcaccaccacctcgcgcgccaccacgctcccgaacgcgccgtggacgccgcgcgggacgacgacgaggcgagctccgccaaggccaagaacgagagcccgaaggaggaggcggcggcggcagaagaagacgacgacgtcgaacacaaggtggcggtgcgcaccacgtcggaggagaagaagaagaagaggaggaggaagcgcggccgtggccgtgtccgtggccatggcgtcgccaagcgtcccaagaaggaggatgaggaggggacgaagctctcggctcccaaggccgagcagctcgaggaggaggaggagggcgccgcggtggcggcgccgagcggcatgatcgaccggtggaaggcgacccggtacgccaccgcggaggcgtcgctgctcgccatcatgcgcgcccacggcgcgcgcgccgggaagcccgtcccgcgcgcggcgctgcgggaggaggcgcgcgcccacatcggcgacacgggcctcctcgaccacctcctcaggcacatcgccgacaaggtggcgcccggcggcgccgagcggttccggcggcggcacaacgccggcggcgggctggagtactggctggagcccgccgagctcgccgccgtgcggcggaaggccggcgtggccgacccgtactgggtgcctcctcccggatggaagccaggggaccccgtgtcgccggagggctacttgctggaggtgaggaagcaggtggagcagctcgccgttgagctcgccggcgtcagaaggtctcctcttttgatctctttttcccttctcttctattgctgcttctgattcttgcattgctctagctggtagtgaattctgcattgctgattcatatgctactttgcttaatttttgtggtaaaattggcttgtgttgctataaattttgcatgaaaggcacatggatcacctcacttccaatgtgagtcaagtgggcaaggaaatcaaatctgaggctgagaagtcctacaatacatgtcaggtgatcatactacacactctgatgtgcattttgttttctcgattcacactaaatggttttatatgcagtacgctcattaaactagtcatttgtgtgcacatgtctagccctggtttgtgtgttttgagttactctgaagccaaattttgatctttgtgttgtgatgggaaactgcataacaaggtttttgatttttgaaaagaaacttctacctagaaagtttttgcacaaaacataatgtttaacagtttgaaaagtgtgctaacggaaaataagaaagttgtggtttggagtggaaggttagaactcagccaagcttacaagtcttacgatggacattgtcgaggagtgatcctctctagcgggagatcgtgagatccccccttttgtgagttcggccgggggaaagggctcgcctctagagatcgcgtatccgccctgagtgttgctaatcgcgtgtgggcgagaggattatacaggttcgggccgctatggagcgtaataccctactcctgtgtgtgggattaaggttgagagttacaagggttcctaaactccggagagcgttcctgcttctcttctcctagagctcaggtctgctgagagtcgtcccctttctcggtgggtaaggtcctccttttatagctcaaggggataccacatgcaccgtctctacctactattctgtagggtggggacccaccctaccttgaccggatctcgatccgtgccttcgcccggaagctaagccgcagctcgtccttgagcgggacccagcgccgtcccccgcctgacacgggggacagccctgtcattccctcataaataggtgaagacttgtggtgaccatctttcttgtggagggagctccgaatcatgctccgataggacgggtcatacctacctccactccgccggggacagaggcgacgtgggggcacagccgcccgtccagtcagacgtgaccggcgacaggccggtcacagaccggtcattcctgactgacgtgcgtcagttgggcggcaccgcacgtctgcccctaccgcatttaatgcggcgaggggcagttggggcgctgcgcgcattgatagcgatacagcctgggtcccctcccgctcgctccccccgccacgtggcagttgggcaggggcgtcggggcaaagcggcgcgagggcccgaggggcatgacgtggcacctcgaggccccctggccgcttctgcgattcgcgaggtgcgggggtagggccaggctgtagggccacgcggcaggatgggaaggtaaattcccctcactccgcatacccctaggcccatatctccgacagacatactctctccgccccataaaactaatatagtattggatgtaacacatcctagtactacgaatctagatatatctatgtccagatttattgtactagaatgtggcacatttagtcctaacgggatggatggagtatctagttaaatagttttaaagaaacatgtaagatatttgttggaagtgtcacaaagtaagtagcaaaagagtaattactctgtgagtagtatgtgggtgcatttcaatacaacaacttatagtcacttggagctagcaaaccccttacacctccatatagttccgcaaaaataaatgaactaatgtaccacatcgctagacgtcgccaactagtcgtgtagaacccgcctccacggatatttgaaagatttttttttggtaaattattttctttagaaaaaaccaacaatgtgtcagaataaactattttgccacgctaaccgtattgacgtggtaagataaaattatcgtactagctactactagcatgacaatgtaatgtggggtggcatggctaaaacgtttcagatttaagaacaagtattgagatggtttattttcagatggttcatctattttgcctccctaaatttcttttatcactagattgtgtcgtcgtgacgtgtcggctagcctaccgtactgaggcagggacataggcacggcccaatggtcaggcggggctggcacgggctggacaccagttaggtcgaaaccctgtgccatgggccaggctatcggtgtttaagttcacgctgaagtttagaagtttggttgaaattggtacgatgtgtttgaaaagttgtgtatgaaaggtttgatgtgatggaaatttaaaattttggaaaaaaaaactttggaactaaacagggcccaagtcatttggtcatcatagaaagtattgagatgatttattttttaaatttagaaaataataaaaatttaagatgcagtaggtcaaggtgctgctcctgtttgtctgtcgtttgtgcagactggagaccagagggaggttgggagacagatttgcttttcatgaaatcttcctcgtcaagtaaacattgcatatcccattctcacacaggtgttggcgtactccaattagaccatcattaatattcttggactattgcaggtgctgaaggaaacttgtaaaatgatgtggtcagaagactgctttattggcattacctgtgtcacagagcccctgatggtgatcaacctctggataaacatatcatcaatccctgatggtgatcaaccactggagtagtagaaagcatctgcatgcaaatggtctttgtttaacagttcaaggattagcttgagatcatagtattaaccaagctattaattccttgcagtcaaagaagatagtggagtactcctcctacaaaacaacaactctctcacacacacaaaagattcttcttttcctgattcttcaaaatcaaaatccttcttttttgcagctctcttttgtctcatctctgctcctcttcttcttcttcttccctttgcattgctgtctcctgcactgcagcagcaaagctgccatcaccaacccacctctcctcctcctctcagctctctctgtttctctctctcgccgccgtcgcctgtgagccatgaccgccgccgccgtcaacgcctcgcgcgtcatgcgccgccgcgccgcaggcgaggacctgggcgacggcggcgatggcgacggcgacttctgggccggtggcgccccccgcctctacgacttctcccagcaggagcagaagccgttcttgcccgcgcccgcgcccgcgccgccgtcgcccgcgcccgtcccggcgtcgccgccgtcccccgcggcggagtcggtggcgccgtgcctcctcacgctgcagtgcagcggcgtcgggtggggtgtcaggaagcgggtccggtacgtcgggaggcaccaccacctcgcgcgccaccacgctcccgagcgcgccgtggacgccgcgcgggacgacgacgaggcgagctccgccaaggccaagaacgagagcccgaaggaggaggcagcggcggcagaagaagacgacgacaacgtcgaacacaaggtggcggtgcccaccacgtcggaggagaagaagaggaggaggaggaggaagcgtggccgtggccgtgtcggtggccatggcgtcgccaagcgtcccaagaaggaggaggaggaggaggagacgaagctctcggctcccaaggccgagcagctcgaggaggaggagggcgccccggtggcggcgccgagcggcatgatcgaccggtggaaggcgacccggtacgccaccgcggaggcgtcgctgctcgccatcatgcgcgcccgcggcgcgcgcgccgggaagcccgtcccgcgcggggcgctgcgggaggaggcgcgcgcccacattggcgacacgggcctcctcgaccacctcctcaggcacatcgccgacaaggtggcgcccggcggcgccgagcggttccggcggcggcacaacgccggcggcgggctggagtactggctcgagcccgccgagctcgccgccgtgcggcggaacgccggcgtggccgacccgtactgggtgcctcctcccggatggaagccaggggaccccgtctcgccggagggctacttgctggaggtgaggaagcaggtggagaagctcgccgtggagctcgccggcgtcagaaggtctcctcttttgatctctttttcccttctcttctattgctgcttctgattcttgcattgctgattcattcatatgctactttgtttaatttttgtggtaaaattgactcgtgttgctatgaatttcgcatgaaaggcacatggatcacctctcttccaatgtgagtcaagtgggcaaggaaatcaaatctgaggctgagaaatcctacaatacatgccaggtgatcatactacacactttgatgtgcattttgttttctcgattcacactaaatggttttatatgcagtacgctcattaaactagtcatttgtgtgcacatgtctagccctggtttgtgtgttttgagttactctgaagccaaattttgatctttgtgttgtgatgggaaactgcataacaaggttttgctatgcaatggcccatttgtgggtctgtcacctatgtcaatgcacacttgcagttcagcaatcttttagagtttacttgtcacattgttacatctttcagtttaggtagagaatctagttctatttcaagttataatcttctgatacactggagaaaaggaaattactttcactgtttatcttcagtttaaatttgcactctggaagaacactagcacagtgatagtattgctcttcatgcatttgtctttccatgactagtttgcatcttcttttgtttttttttactaactgcatcttcttttgttacacgagtattttagtagggtggtaataaatgaatgtgatgatcttatttgcaggagaagtatgcctgtatggagaaagccaatggcaatctggaaaagcagcttctgtccttggaggtacaccgaaactaatcacaactatttatcagctttcagtttcagtagctctttgctctatttcaacatactaaactacagctgtcatgcttatcaagttgaatctgatttggtccaagttttttctaatcatattcaatctctacattaacttgatcatgttgaaacaatgttgtggtttattttcaggagaagtatgagaatgcaacacacgcaaatggcgagctgaaggaggagttgttgtttctcaaggtatttgaaacaatcttctcaacctgtactaaccatgtttacttacatctcaaatcatcaacataatcgatgatatattgataatgtgatcacttatgcatgtaaagcatatggcttgaatatatgcaaacagtattaatgggatttgtcttgcaaaacactttcatgaattatatagtttcattgttttgattcatgtcctgatacaaaattattgtcaaagtcctgtaatgtaatatgaagcattgatttgggaccttcaaaagcaaaatacaacctatattttgggacatagaaagcattttgtatctgcatttacaatgaagctttcatacaagattatgtgtctgttttgcaaagcattcatacaaagtcatagtcacagtcatgtgttgtaatatgaagcatttatttgagacattcagaactaaaatacaacctacatttttttgcaaggaaatacaacctacattttgggactgaatgtatttatgtatctgcatttacaatgaagctttgatagatactgagtctgttttgcaggagaagtttgtgagtgtggtcgagaacaacaccagactggagcaccagctgactgctttatccacttctttcctgtctctaaaggtacaataattactactattttatctctgtaaattcaccaggccatgaatggttcagtagtttccatggtttaccctggacaatttttcttgattacctattagcagtggtattaaaccagtgatgattaactcatgaaaatatcatcatttacataggaggaactgctctggctggaaaaagaagaagctgatctgtatgtcaaggaaccatgggaagacgacgatgaaaagcaagaacacgatgccgggaaagaggcgaaggacgacgatgtcgccggcgtcagtgcagccaacgaccagccggacgtcgacggcgatggcaccaccaccaccaccaccaccagcagcaatggtggcagcgggaagagaacatcgaggaagtgcagcgtgcgcatctccaagccgcagggcgcgttccagtggccgacgccgagcctgccgttctcgccggagctcgccgcgccgccgtcgccgccgctgaccccgacggcgcccgtcgtcgccggcgccgccaacttcgccaccatggacgagctctacgagtacatgatggccggcggcctccccacgccaccgtccaccaccagcaacgccgggaagctcccctcgctgcccgccgccacggcctgcgccacgacgccgccggtgaagacggcggacgccgccggcgacgtgggcaccgagctggcactggccactcccgcctactgacacccccatcgctggcgatctctctctcatcgatcggcagctcaagttttggctcaccattataccaaccagtcactgatcttagcaagaagatgaagatagcaagaagaagaagaagaagaagaagaaga

SEQ ID NO: 26281 - DNA, 2978 bp, Oryza sativa
tctttcgttaggttaattcaggcttgatgatcttaggtcgattttgcagctttgcgtctgcgttttttggatttctgggagacattcatttccagcgatctctctaatcctaatttcacagctaaacactctcgcagtatgaaactttgtctgatgtttgtgatgaaatgcattgaccgcttctgtgattcgtgattgggctatttgtaatgttcagatggtgaactgtgcatgttgtggttcaaattttcagttcctcgcaaatttcatctggaatttctcttcgaattcgtctgtttcatgtgaaaaagtgatggaatcatggaatgaaaaaggttgttttgccctttttgcaaattttttttttaaaaaaaaggttgttgataactgggcagtctgggctaccacatatgccccaaattaacatgctgtgttcgccggggaggatgtgattgattaagtattagttaatttttttttcaaaagtgatcaatatgattttttttaaacaactttcgtatagaaactttttgtaaaaaacgcaacgcaccgtttagcagtttgaaaagtgtgcacgcggaaaacgagagggggacatgagggatgtaaaatgacttattcattttcacaatgtttcttattgggctagaacgttcggcccaaaagaatactggaggcctatagcgttctctgtaggcggcccacttttgaccggggcccacctgccggaaaccacgaaactgcccgcctcgaaattcgaacgaagccgaaaaaaattgaaaaaagaaaaagatcccccaccgattcattccgaaaccctctccaccgtctccggcgagccctccaccgccgccgccgccgccgcgagatggaggcgaagatctcgtcgctgtgcaccgccctctcgtccgtgctcaaccacgccgacgactcctcccgcgcgctctccgacgcgctctcccgccgccccatccatctcggttggtaccaccaccacctctcgtcccggcgtttctctcgacgccgttagggtttggggatcctatgctcacgcggtgggggtatcggatactgcgcctgcctgtgatgcagagtcggcggcgagggggttcctgcaggggctggaacggcggtcggaggcggcgggcgccgacctgtcgcggctcgagtcgatggcgttcggcaccgtctccttcgaggagctcctcggccactgcggcgaggcgctcgccatgttctcccgccacgccgacgccatcgagtcccgcctcgtcgccttcggctacgtgccacccggtagcaccaactcactccccccatgggagattctgaacccgatcgtgtcaatttttttaagctcttggttgagaattgcaagtttgctgtgcttcttgtagacgaggaggcgagcgaggatgtggaggaagattgggatgtcgagaagcttcccggggtcgctgggaatgggtgctttggtggaacgagttcagtgctgaggtccagtagagagatggtggatgatgacgatgcattgtatccttatgtttggtttgattgtttttcttcctttttctgttcaggatagtctctgatttggttgctttcgcttctgcgtatgcttgatctgatggaatggttagatacaggacgtcgaaatgtatagggacttgttcattcagcttatattctgtggctagttttagtaggttcgtgcacctgcaattctaattctgaatttggaggtttggtcatttagcccctgtttattcatgtagcaggtgtacaacaccattattagctatgagcctatgactctatgagtatttgttgatttgttcctcctgttctattaaatcttccttctttttttcatttttccatacattatttgagacacgcagtacatcataaattagattggtcagggagccaggggctcactgttcgcgattatatgaaaaatatagtaccgtattaccaacaattctgatgtctgaggggcttttatttattcttggcaaaagggtgcaataactataattctagtagtttatatagtgtaagctgtctttgtccgcaatctgctgttcttcaccacaaccgttcagcattaaaaatttgtgcttgcatatatttgttcggtggttttatatgacgaaaatgagaagcgttgagttctttcttgaccgccagtaagatttgagaactccatgtcactaaagaatcttggcttctcagatgcttgtctagctaccttgtcctctcaaggtatgtcacactagaacaatatcgtcgttacaactgtttgcatggtacacctctttgttggcatcgataatttgcttaaattttgcagacagtggtttatctggaagcacagagatactttacaggaaacctgaaaggtatctaaaggaattgtagattatttttgtattgctactagcctacaattgcttttcctcagtgttcttttgtacctatcaggttcattacttctttgtttctaaaaatgacttgtgatgcttctcagtgttgctgatgttgaaaacaaagtaaatgatgccgaatccatgattcccccgaaagaaacaaatggtcaaggtgggcagcagcgatgtcttcctgactaaagagatggtttttgatcattctgatttttttcactgttgaatttgttaaggtaatgatgcacaaggagccataaaggcatccaaggaggagtatgagaaattacctccgtacatgaagactcttgcaacatgggaggtctgtttttcctcaattaagtgggaattctcatattattttttgcatattagctattggtgatggtaaaagatcatggtacagattacttaaaatgaaaatactaaaaggagaatattctgcaatgtcaagagtttcctgttttgtcttagtgagactacctcagagaaatttaccatattgcttacctttctgctaccttattgcat

SEQ ID NO: 26282 - DNA, 3587 bp, Oryza sativa
atatacgcaagagcgactcctagctaggcaagggggtcccgaccgctgggacctggaatgactgtgtgaagtttgttttccattttttaagaaaagaacatgccctacaatgtaatatgttgaaaactcggattgctggaaggatacttcaattcagagctgggaagtgtttttttagcttcgccctgctcctgtgagaacgtttttgggaccctggtttgtgttattgtgttattgtgagaactcatgatgtatattattttggtttgtccattttttgtgtcattgtttgtgttttttttgttgtgtgccaagttctcaatcttgatgtatgcacatcttcaatatcatatcaatatatcatgcatgccaagcaaaagaatgggaatgtgttgactttattcatgttgcaggatctgaccaaggtcttcagcatttcccactcaagaagacctcgagtgcaaaaggtacatggaaatatgaattttcccagcagaagctgggatatactctagtgaatttacacatattacagaccttatcttcattatatatctatttaatattcacattcattcaactaggtgcttatacgaaatatgaccttacactataatttatacaatttaaaaatcaatatatgaattgaattcttcaaacccatatgcctggcatgcaatacagaacgcagcagcaggagtccctttcagccaggtttgttcaaagtgtggtaaaattgattttggagcatttcatcactcaaggctttggtactctgctccttacctaggccacaaatcctgatgaagatgatgaaccgtatatctcttccgcttgcgccaccggaacatacaccacgtcggtcaatgagctgtgggtccggccatagaaaatgtacacgaatactcccattaccagccataccccaactctcatccatgtccctccactggaggcaaggtaacaagattcagaattgagtacaagcttgaagcatatgacagttctgaagataagtacatgtgagcaatggaccatgacttaccccaagtttactaacaagtatgtgttcacgaggatgcacatcaccggcaacaacggaacgaaggggcagatgaatcctgcagcaggagcagcaccaagatgtcgtgatattaggtaatttcgtcaatagaatctagtgtagacaaggtgcagagatgtgttgttatgtaagtacctccagagtgaccaaatgagtgcctcccgtcatcttggtcgatatagcagaggacaccgagaccggctaggaggagtaggccaccaaaaacacagaagaagcatcgcaaaaggctgacatggcatggaagtgatgcatatatcagagtgatgagtatcttggttgcacatggtagggggatgaaatgtgtacaatttgtacttacaatggcaagaatgtgaaagaagctgaagttgtgaggaccacaacccctacacatacagatgatatgctgcaaacagctgctttccgacgctttgactcctccacacctgaaggatttacagaaaacctgattactaaactcaagaaatgtacatctacttaggaatgtcaaatagactaagaaatgtacatacttgtgtcttgcttcttctcgataagggtgtcatttattgattctaccacagatgacaactgttcatgattcgcatctacaggaggacccctaaccttttcctcatcatattcttggctcaaacggaatgacgcttccagagaagatggcaggggtacctcatctggaggagcatatctgaggatcaagatggacacagcaactatagtgaatgcaaggagtgtgcccacactgacctgcaaccaaaattaactctttttgctcaggctaaaatttctggtattgtttagatacataaaattgcagagtatgctaaaatattctctgaagggaggtctggtcatcaatcacatgtaccaaagtacatcaaaattctcaaacgaaaactactttgcagtagtttctagatcctcaccattcctgccagttgtgacacatccatgaagaaggccagacaagctgcacatatgccagtaacaattgtgctcttgacaggaacttgtgtccgctggttgacatcagagaagaaggatggcaaaagcccatcgcgtgccatggccatcaatattcttggctgtgagataagtagcaaaccataaattctctaaattcaaatatctgtctcagcctaagattatggttatactatgtacatgttggatgagagaatacacatatcaatttccgatcctctaatcatgacatgttatctgtagaaagatacttatgagagcagacaatgttatcaagattccagatttaacgactaacagtcatgtagcactaagaaacaacgaaatctgtggggctgttgaacattggttcaacttaactgatgagcacacagttatactacatcacaaaattaatacttgctcatataaaaaaaattctactgtgatgaaatttactaaacagaaaacatcagcctatatcagttacatatggggaaatggttgcatttatagggggtattgactatgatcatttatgaattgcaaatttgcaatcatataagttccatcacatattaatggagattgttgtatacctgtggcagaatcgatcccatcaaggttgagcaaagagcaagaacagcaccagttgtaacaaggtacctaaacaagatagccccttaactgcctcagttggaagcacagtagatcaattatagtagaaaaaaaagagacaaaaaaagtccatacatggcccagtgcatcccatgtcttgcaaaggctgatgatataggggtatctgggtccatagcgaaatatggtaccagaccaacgataacaactgaaaccaacatgtataaggaacagcaaactgacaatgctgttcctattcccagtggcagatctcgttggggatttttcacctgttgttaggatgaaagaattcccatttatcaatactggcactgatctagcaaacagatggatattaattggggaaatatgatcagtccatacctcctcggcagtgctagcaactgaatcaaagcctatgtaggcaaagaaaacagttgctgacccagcaagcattccgttcgccccataagggaaaaacctgaggcaaaaaaaaaaaaaggttaagtgcaccactcaccagctagagaaaatccaaagcaccaagaacgtttcgcattacccgccagccaccttatagccgacccatcctgtttggaagccaatgtaactgccggctataataacaaatagcatcacgaagcaatttaggactgtcacaactccttgtacaaatgagctctgcgacaaaaattaaagagagtaaatatcacatgtggtacttcttgaaaaagagagaaatatacttctgaattagagaagcaagtgagacctttttatccccttgcatagcaaggcggtgacaacgagaaccaggaaagccgcacagagatcgacaacaacatcaaaccatggaagctcatgggtgctaaaaaccatggta

SEQ ID NO: 26283 - DNA, 2355 bp, Oryza sativa
ttgggaggaagaggagaggaaggagtagaagcctcctctctctcctctttatttcatttcaaggcagcatttttattttaaaaaatgtaatatagtacttattagtagtgaaattaataatttgtgcccaattagttgttttgatacttactacatctgtcctaaaataattataattctagattgtttagtaatatatattaaggtttgagaggatgtgtatttgtgtgtaaaataagaagaaattcgaataaaaaatgatcaatgaaatcatcagtattctaaaattctataaatataattattatgggacatagacagtattttgacacatttttaataagaagaatagtagtagtagtaggtgaaattaaatactgttttggctagacagtctgacccaattaagttctttgttatcaaaggacttaattatgccaatcgattttgctttcctcactggaacagtgcaccgaaacaaccggctaactctgactgacaggtgggtccaactcaaagttgagcttggagaccccacatctcagtgacattgtgtctgagaagaatctaccaggaatttggcgggcttaacgcaggaccaaaacgtgtgctaagaatagtagttgagcttaagaaattcataatccatgtgcaacctttggggctacttataagctagacttaattaccaacacgcaataatgttgcctcgccattagtttgcaaattttgttgactcggcaaatgttggtttggctatgattattaatttttgttggtgttgttgtgatgaacaggacatatgatgtagagattgaaaagcaaaaggctattatttctagagccagaggtcgctgtcccccaaaattaagtttgatttcattttctctttacgtgtccaaatgggctaattagcaatcccttgttggcatcatctaggttttttatataaagttccaatctacctgttcccaaatacggcaagacaagacaatttctcttttatttagatttcggaacacggctaataatttaatactgtatcttgctggattttatgaatatataatatagtacttatcttgatgtatgcatcaccacgagagaaatgcatggaagaaatgcgatgctcttgagatctacatcatataattgagatgtcactgtcttacaattggcctactagcatgaagctacaggtttttctttgacaataacagctgcaagatgctgactcagcaaatataggctggttacttttttaataatggaacttattgtggactttacttaaaaaattacaaccagttgttagaaaggttccaggacaaatgactgtttgagttataaaattatagcttgaaaagaaaagtgaaaactaccttgacaccaatgtaagaagagatatgttcgtctatgattgatcggagtatgtataaccgttgtttctcctaataggttataaaaatattgtttattttagaacttataagagtattgcatgtattaattacatgtcttcctcaaactaacaaagcagattttttgaaatcaattattgatctttttatcgattgaattttgctcccatcaccgctggcgacagactcagtaaatatagggtggttgtaattagtaatgtaaattataaataaatattatatatattcgggagagtatgtcgccgaccaattccacgtgtccaagctgtttcgttcttatccaataggcttgcgttttgctagcttgtggtctaaattaatcaggcagttggtgattagccaaagctcgggctaatatgaactttgacaatatgaataactaattaagtggccaggatgccaacacgtacgccaacttgatcttaacgcgtcatgcgagtatatatatgcagctctctatatacacagtaaaatcacatgcaagcatgtcttgccactaaggacactttactgcctttagtacttaattaattattaattaaacttttatttactcaacacttgctagctaatcattgggggtttaattggcagggcaatactactgccactgggtggttatttttcatctactgcttgtctgcacttgttctatccaagtacagagatcacagaacagaagatcatattagattaaaaacagaagatcagagctctgcaaaactaattatctggtctaagaacctgtaagattcttctattgtaaactactagtcattggttacttctgaaaaggtttgtctgcatgagaagcaacattttatactagtactactatataggagtatcatactatgttcttcaggatgagagccttgcaaaattggcctcaattatctccattccagaagca

SEQ ID NO: 26284 - DNA, 5580 bp, Oryza sativa
acatatgtgaaagaatttgttccacgacctccattttaccgaaataacatgtaacggagagatttttgaaagttacatacaagttacactatagttacagtgtaattacatgcaagttacagtgtaattacactacgattgtactgtaattacatctgtcaaattttgggggaaaaatttatcgacaaatatatagcaaaatcgattgttatatggtttagttaagatgaaatttactgtgagagttcgcttggatatatatatttttagaaaatcatgagctgcagttaggagtctgatcgtctcaagaaagcatgctagttttttaaaacaaatttattatatgatttcttctgtattaccaaatgtgaacgctcttaaaaaacaactcaaatacggatatgtatttctaaaaacaaatgaacttaaaaaccgactcatacatggatgacgtaccaaaataccgacaaaaacatttttaatttttataatagtagaaatatatcctataaaataatactccctcattcctaaattaatcatcatgtaatagaatctaaaatttctcatcattatataactgcatagacataaatttcatcggaatacaattaatgcagtacaggagaatgcgtgcatgctagaaaatttctcatcatcatataactgcatgaacatgaatttcatcggaatacgaatgcgtgaatgctagagtgtaattggtatgaggttttaatcgatgcatgcattgtgagagaatatgtacatgatatcttaattgatgtgatttaaatttttcttggtcttgatacatgatcaatttggaaatgagggagtagttgccttcttagaaaagttatacggtttatcagtcgtatcccaaccatatactttacaattctgaaaaattaaaagaagagagagaatgtctaaatttactcccttacattttaaccccaatagatcgattcttacttttcaatacaaaaagggcatccaacataactgaaatattggagtctacgcatacatgtactgaagtactgaacgaactactgaccaaagattaagaaaagggcatcactgagactgaaagacagcatcaggcatgcaagaactgaaagctcaactctgcatgattgattcgcatttgcatctatggctatctgctgtctactacatggttagacgtcgacggattcacagctgggctggccgtccatgtcggaatatcactctttcagatcaggacaagccggcggtcattcgtcatcggagatcggcgggccgccgtaccggatctggcgcatcctcagcatccgcggaatggtctccgttagccatgagaggcgatggccttcttcgtcgactccggtgagctgatcggccgcgccatttttcactgtcgacacaaaagcaaattcagcttcggtaagtctcgagtgcagtaacatatgcaggtaatagatgtgaaaatgatgagggtaagtggatttaggaaattttggtgcaattatggaccaatggtcaacaggtcaaggaacctatcatgcaggtaagctcaaaaccgtgtgctcgcaacaccaatcaagaggacatgttgcaagtggagtacggcaatatcatatattcatatacacaaaaagctatctgttggttgttaatttaacaaacaaaacctctttccttattcagtgggcgtctcctatgccaaactactgatttgataggctaacaattaggcatacattgcacacttgcaagtaatcaatgcctaaaccgtacatttagcctcttagatcatgttaaagcagcaacaagtcaaaataactattactcaaatttccaaactataaaaatagtatgtaccaatgttctgcaaaataaatactgcagaatttgctacttacccgaatgacgtgagtagggaatagcgcggtaatatgtgcagtctcggccatcttccgtggaataaggggggccaagaatgtcgagaattgcacacggcgcaatagctcgaaaccggtgcatgttccctcctgttgtaggatacaggactgatgtatcacatggtgctgtaaaaacgccattcaccactctctttgccaacctcactgcaacaatgaactctaccaatatcagtatggcggaggatgcatgatggtgaagacagacgaccgttaaaaagtgtcgaattgttcaaaagcttacattgatcacccgacgatgaactacaacttaaggcaggctcaggatcaacccaatcatacgaccttatgtgcagcgatccgataagtagtttactgaacaccgtcattccagggtgatcatgcagtgggatgatcgcatttcgtggtaagaagaagataatcatctggcacggtaagaagaatgttagaaaatttgttttagacatgagccattttgataccagaaaaacatatcgtggtaaatcttgaattcagttagtttcgtgcactgcctgctacttaccgtaaagttgtcgcattcatataatgtagtgtttttaatgagcgggattccttcgtcatcatctctagccgtgaagaattcttggtctgccctaaggccaacatcttcgggtttcattttatctgcaaatagcatcacaagcgattcaaattcagttaattcagctcatcaaacagacacaaactacccacatatactgtataggcatgggccataatatttattttgttaggacaaaaggctatccgttgctaccaggtgataattaacatgtgctaaaggaagaaagttcagaacatttcatctgaacaatttctgcaggcaaatccatacccaaccaaaaaaaaaaactgtacacatcatcaactacaattcaacaaaacatgtcgaaaccagtaatcttactactagattgttgcatgcacgaacaaataaaaaaaatccagctaaatctgcatgataaactggaacatgaactgcatgaaagaaagagagaggggactcaccgagcatggagcagagcaggtcgacctcgccgggggccgggacggtgccggtgcccctgaagacggcgcggcaagcccggaacagccgctgcagcggcgacgcctccgcctgcacccgcctgctccccccggccccagccgacggcgccaccgccacccgcctcctcttcaccggcggcgccgcctccaccccgccactcctctcctcctccaccacgccgccgccatcgcggccacctccccccctcgatcccctccccaccttcatcaaagatccaaccaagaacaacagcaacaagaagcaagaagcagcaagaatcaagaatcaagaagcaatgcgtggaggaggagaggtgcaagaagcagcgagggagggagagatatactggcgctagaaacagggaggggagaaactaggggcagcatcaaatccatggacagcgacgtgaataccgccgctgggttgggttgggttggggatgcaaaccctccgcgacgggagagagaaaccggattttatttatttcttcttttttttttttggcgcgagagagagagagaaacgtggcggtggttttggcgcgcccgccatttgtggaaggcggaaagcaaaaccgccgtcttcctacccaaatccggtattccacggaacacagattttcttctctattctccgtatcaaatctggggagcatttcatcctgcttagtactactgtagtactctcttcgtcccattatataattgattttaggcgaatatatgttcagatttatcgtaataagatgtgtcatatctatccaaaattttttatattatgagacggagggagtatcaaattaagttgaaactgaaggttgagtaggcgcactaaaatgagagatttattagtgtatgagtaattaagttttaattattacaaacttgacgaatatatatatttgatttttgaaagtaatttctgtatagaaagttttcgcatggaacgtaataaacaataaacagtactccacccttcctaaatataaggattttactccttccgtcccattttaaatgggaccatgagtttccttgtccaactttgatcctcctcttatttaaaatttttttaataattagtatttttattgttatgagatgataaaatataaatagtactttacttgtgacttatgttttaagtttttttaaaaagattttaaataagacggacagacggttaaaaaagttggacgctgaaaaccaacgctgcatttaaactgtgatggagggagtagtatagtaatgagaaaagaatggggctgcccaatttgctaatccaaatccaaatatctaatcaagctatagtaataagctggacacggatgactcttcagcaatggaagagtcgccatcgccgacgaccagtggggtgagactagtgagagatactgacagaccaggtggatctcatctggagttgcagttcaattgcattgcttaattttcttgcaaaagttagtaaagtgaatcttgcagctgatgaaattgcaaattgcaacgcatctcatgataatgtcccgtttctgtttttttttccctaaattagatcagttggttatgtgccttttttgcttggaagagtaaatgtgatctcagtaaagttcttgcatgtggcatataaggaattcttttaccagttctttggttcatgggctttctttagctttgttgccactttcataaacagaagatgaaagtggacactgaattatctcatatatgggcactgtctgacggcaccatcgtttcatttatgtttatccttatacttatccctacgacttactagaaaaaaaacataacttatggataaaactttatatactgtaaaataaactacaatagaaaaaccacaaaatcaaatttaaaacttatttttcaaatttagatttttgacttatgagtataagtataagcgaaacaatggacagtgaattatcaacgtgtttgttctaacaaatgcaaaaccaactccaaaacctgtcactgatataagcttttgtgataaatttggaggtaattccaatgataagtttaattgttgtagtaggagtaccatttactaccacctcactcctaaaatacttatcgctttgagtttttgtttataatatttgatcgttcgtcttatccgaaaaattatgaaattattatttattttgtttgtgatttgctttattatcaaaagtaatttaagtatgactttatatttacattaattttttaaataagaagaatgataaaggttgcaaagaaaaaaaaaatcaaaactacaactaatttgagacggaagagtaacagacaattaaagtaccaattaattactgtacgagtttggttagcaggaggacacagacaggacagtgaggacaaagtggcagtagtactgctcgtgagtgaaccaccacagatcgacaggtggcactgccacgtgtccctgctcctcaaaggtgggcccacaaaaccacctaggaacgtacgaatggatggatcatcaatcaatggataaacggatgaatgaatgcagtcccactag

SEQ ID NO: 26285 - DNA, 1761 bp, Oryza sativa
ttttgaaccttttggaaacaacactaacaccagcagaaaagacctgaccaaataacggtgtcatactagccagaccgacgtaacagtgttgttttaccacgaggcgtagccaaaagattcagatcaagttttgaatgagtttatttttaaaattaaaaattcaaaaaaaaaataaaaaaaaactccagcctcacacatttcacacgctgctgttctgtcctcagcttcaggtccaaacgaagagaaggaagagagattttttccagggcaaggcaccgacagcaacctgtcaaagcaaacaagattccagcaccaacaaagcatcagctgtaccacaaaacaatgggcatcaggagcagtatttctccaaaccacacaacgtgccatatacaaacacggcgtttcactcacgctataattcttgcacccatcacatgcaaatgctaatgacactacgacagtaggaatgaatgacccggctccaacagttggatgatagtaagatagtaaagtaaagtagagaaaagaaaaccaccctctcaaccattgtgggagagttgaccatgtccctatattttacaatgattgacacagttttgaccgagttatgtattctatattatattataattatgctattaagatcttttcgggtttgtattatgttcaaactctttaagtttaaccaaatttatagaaaataaaataacatttgcaataccaaattagtttcattaaatccactattaaatatatttcatagtatatttgttttgttggaaatactattatattattcaacaaacttgcttgacttgagaaaaaaatataacaccttataacagagggagtacatagtaagatagctggttttaatatatagatcaaaataccctcattaatatctcaatcacaggaaacatggtaggcaaacctggttagacaagtaagatgaggaaagtttagggaaaatgtattgacatttgtgaaatgacaatgtatttattagtgattagaaactgagggagtaattgtgtaccagcctgttgcaagctagctacctccagtcatgttcatcaacagaggcagctactgcctaagctgtccaagaactgacgaaaccatgtgcaaggagccggtcacgcagatcagcccagtgtcgccatcttcttgggtctgaagcagccgagaggcaaccctgatcaggtcggacgaaaatggcgtgcaacatccaatcagcatgggtttgtcaccgctcaaggaccgggatgtcgtgggacggctggcgatgatcggagcttcaacgccggtgatcgtccctatgtccgagtagcagctgatgccctggctttgtgcagcagccatccatatctccttcagtgatgaagctggcatagaccgggagcgtcctccagcaatgctcgcctctgtcagcaatacaacatctggtcttgggcctgtaacaaaaaaaaaacgtgccttataagcaaacaaaaagatttgattgcaattctcgccccaaatgaagggaaatggttttttgtatggcgaagaatgacatggattgatgggatgatagtatccctaaggtcttcatgagacggcattcatgaatttgtgcttaaaatcaaataataagccaattgatccgatgcgtgtggatttgaaatgtttagagtgggaaaaatcttgcctgacagaagctgtcagcaaaggccaagtgttctttgtcattggccattccaacaaccagagccaaag

SEQ ID NO: 26286 - DNA, 1334 bp, Oryza sativa
ggaagtgaccagatcatccatgaagaattttgataggcatgatggcattcttatggttttactacctagctcacggagacataaagctgtgcagcaagctgttacagcattctggcgctgatgatctcccagcaactggagttttaaatcttgcaattcaataaactgcaaatataatcgtttggacttgataagtaaagagagagaaatcagtaatcccctacttatttctggagaaatagataaggttggcaatggaactataccaatggaatatcatttgaaatctcgatgacaatgtcacagctttgataaggttttccacaatcccaaccaatgcatcttgtgatgctcctgatgccgggatcgcatgcagatattacgggagattgtgttaagaatgctctatcccggagaatttgctcgatatctggggaaaatgggccaccaattataacctgaaaatatttggtatgcagacagcaaactccatgtcaggaaccatacaggtaacctggaactgtggtgacattggtctgaacacaatgcagcagcatcacttgatatgtaaataacattgcaaacaactcaacaaatttaatcacataaactcttgctagaagtggcacatgtgagaagtgcttgcaatgagaatattttagccatgctggtcatgctcatgcctctgaggaatgaagcttcacatatagaacttacacttagaagaaaaacaggatttgtctggtaaaatagtttgataacaagtacaaaattaacatagaagacagtaatcaaaatatgataagagaaaagcaatacaaaattaatcactcaatcagaatataagctggaattacaagcaagagcaaattaatcatgatgaacatggaaagggccaaagatgagagaacaacataactggtcgctcctgcttgatgattccagactttgccactgctatactttgtaaagaaccacccaaagcagccaaatgttctttccctactgttgttatgacagatgcagctaattcagtactttgtatgacgtttgtggcatctctagctccaccgaggcctgcctaggcaaccaatagaaagaagagccaataatttgtcacagtaggtgcaaatgctataaagttgaattcaataatcagttttaaaccctagaggcctacttttgattagtgctagatctcaataaaagagaacaaaatcaatagttagaaccgactttggaaatacagacatcctactctccaaatgaggcctagaaatattgctaactcttagaaacttgttcttctgggaactgccttatgtcaaacctat

SEQ ID NO: 26287 - DNA, 5471 bp, Oryza sativa
tatcatattgttagccacaatatcagctgtatccaaattctgttgttacattggaagatcggagatgatgagattgcacaactgatgcaaggagcaattatatagaaaagaatattaaagagagaacacttgaatcattcctaaagatattttgaatttgagacagcagcccccacgaaagtttttttttccccagtagggcaggtgcattcctgttatttcatttccacattttgtaatataagtgcataggtgctagacaacttttgtgaaagcaaaattgatttctactccacttttaacattttgaagcaatatatatatatatatgaaaacaaaccataagaattataaaacatagtagcatcactatccaccaaaaaagttaaataacttacttcgacaatagcaatgtcaacattttcttgtgagaataggagatatgagagagctgtgaaaacctgcagaaccatagcagtactttctaagctcatggtcatcagaagtgaaatatgagaaattaatgcctgtcaatatttctaacatgactaaatatgctcagtgagtgcattttggttaatcttgaattgagtgagaacatagcaactgtacaaactcaatacattatcaaccaaagaaaagtgcaaatgttaacaaacaaaagtaacactgatgcagtagggcagtatgaggactcagaacacagctttgctaaatgatcacagagtaaaatgcaattaacaacaaagtgtggtgcccattttttccttattgctacaggcaccatcatgctttcctatactagcagttggacatggacttaaaccagcaagttcatgtaatcatgttatattggcaaatatattttggtatgaaatagttttgccattgtatacatgaaaattagactacttactcagaagagatgaaagaaaaggacagcagcaacaccatagattcatgaaatgatctgaactaataaaagaaaaaccatagattcaagaaagcagttacaaaatagactttgtttatttcatcttgcatgcattattgctgtttttttttcaatcgaagaatccaccagcatataataattctctgaggaaaaaagagagaatacctcaaagtgagtcagggctccatcttctgattctattgattgaccaatggcttctttagcatgaccaaaaagatccctcaacaattcagctgaacaggacctccactttgtccaacagagatgcgttcacgaattgttagaagatgtgggctgcaaccatagtttaatgcattataattatcacttaattgtaattctactccgaggaaatcaacaaggctcacttaagtataactctacaatctagatacggtgagtaaatgtttgaaacaactcaagatgaaaggaaacaacacagaaatatatcatagatccttcacatcctcattgtatatcgaacagtcaattaacaagatacattttccaactagaaaaaaaataagtgattaaataatcacagtgatgtcgtggagtacctagtatagcatccaacattgtagccttgttccctcatgatattggacaggaatgcagcagttgaacctttccccttggtgccagcaatatgaacagcctataaccacatcagttcagtttcacccaaatatccatcgcattgcttccatgcaaagtgaaatcatgattcatatgcaaggtggatgcctaatgcttgaaacaagcaaatgccccagcaaaatcacgcattatcccattcttatatttttactagtttcttgcaagtttcaaggcaaagctgtgaggctgtggtagtaaggagagggtggtggggggtctcaccgggaagtgggtgtgggggtcgccgaggcggcggaggaggcggcgcatgcggccgaggtcgaagccgtcgtcggagtcggtcccggcgccgcgcggcaccccggagcgctcgtagttgcgcagccgctccatgtactcatagaactccccgagctggccatcctccccgccgccgccgccgccgccgcgggctccggccatcgcagtgacgaggccgcggcgggcgctgcctcgcagcaggctgcgagaccggaggagcgagacggggaagcgggggagcatgcggtgaggccgtactgccgtcgcgccggcggcggcggcggagttcgccggagggaggagtggaggcgccgccgtgtcgtcggagaggttgtcgccttgtcggggatgagccgctcgccgtctttttgttggcccactactttttagtgggccgtagcttgtggacggcccactacgttttctccatttctcaatctcattcttgggccgcaggcgagttacaacactttaccggctcaacacagatgggccgcaggtagaccgaaagcctcgagaataagatcatctgtcatcccttaactttacaataagattgtttaactcgtttatacattactagtatataatactccctccgtttcacaatgtaagtcattctagcatttctcatatttatattgatgttaatgaatatatatgtttagattcattaatatcaatatgaatatggaaaatgttagaattatttatattatgaaacggaggaattacgtaataataaccatttatggtggtgtagccaattatttttcacccaacatttcgtcagggatgtcaggaagtgattgtttgctgtcagccattcagcttgatgaccctaaatcactggaccctcgtcatggtagtacttgttttgcttgtagcaatgcctagctttcatttgcatatcgacacagtgatctcttgttgctgcaagcctgaaatgtctggatgctgcatctgaagctacctgaagcaaagcaacactgcaagatttatcccatggaaggtaaagctccacttgtttcttccagactggaagctgaagctcatcagttgatcagaatagcacgacgtgctagctggtcaactcctggactacagcttcactgcttcagcaacagctcaagtttttatatattatgctctctttttttctctcctgcctgcagaagataaatttttaagacttgagctcacaaagcatattccaggatctctttttcaagagttgttacttttcttgcagggattcttggatcatgacatgtttcttggcagcctgtgtggtcttgacaaagattcacttctcagaaagcgatgtgtaagtagaaatctgttctgctatggaaattatggaccagtttttgagttttgacccctgcacagagatgatttggctcaactaccccatccttggtgaatcacagccacaaatttcttctatttcaaattctgaattctgtgacctgcactcctggttttccaagtaagtgtgaacttcccatgatttgcaaccttgaaaatgaaatgcatgcctaacatttagctctaaagaggaagaagaaatacatggacacacaatgtcattttcatttgatatccaccaacctcatgggagttaggagcacctaacatcttcctttttctcttttgccatgggccccacatattatgcaagcaaatgggtaagcatcattgatcaactcccctctaccatgacatgaacacataaactcctgctaaatcttactcaagaaaatggactttccatgattcaaaatgaggagatgtttgcagctaaggtgaccacatcatggttgttagggtaggaggaacaccagttaagatgtgcttggagtgaagaattgcaaatatattccatgttcatacttgattggcacgatcaaatcaagattccaatgaaacactttaaatttccactactcctactgctccagcctccacatggtttgcattgagttctaagatagtcagtgctcagttccatgttctgtatgatgcagagacattggcattaggagttggtgcatttctgatttcagtaacattgcatataatattatatactactacagcatacaaaatcttctttaaccttttgcattggttggctaaactattgttacactccatgtcaagaatgatagtagtactgactaagtgggatttggtaaaagtaaaaggttcattgaatccagacatagttgcacacaattccaggtgaagaaataactgtggcttaagagcaagtttaacagtatagccaactactctaaatcatctatagtcaatgtaatagctaattcatacaatagttgcttactatactattaatatctggtcccacctattatacacacattatgttttggagtccgtgctgtagctggctatctctttaaaatatgtttatagttgtcttataaccttctattgtacctgctctaatggttcagcttttttttaaaagaataagtaaaagccttgcgtatcttttgtaggattaagagaaggggagttttaaaactttagctgaaaggaaaaacaagggaacaaacaagaaagaaagaaaggaaactttaatggttaagtcacacctcgtctcaagaaattttcctctccaagctcttctcaggattcatccaaatttcaaagagctttgggcaaatggttggatacacccaagttccgtcacaaattattcaagaggattgaattctttgtatatttatttgtttatgatgttttatagcattccaaaggaaaagtgtatgctgaaccaaactaaatcaaacaaaattaataaactgtgagaatcttgcaagtagcctccagccaccatctcaccaaccacagcctctcacctactctgatcctccatgtttacttgttccatttgtttactttatggagaaaaagaccatgcttgattggtcactatagctaataaccatgctatatttctctcaataattatgtgcctttgggctctaaaaaaaactatgtcacatttgttacatgaatacattatacatgcatagctagctagcattagctgataatacgatgtggtaaaccataatttaatcggcgtgcctcatcatgcataaccgtggaaaaaggcagacaagctttcccaaaggcgactttgtttcggtggaaacacaattggcttgagttgggtacataatcatagctatataaatattttttttctaaaataatgcgatatgtaaaccttatctaacattaaacaattgtttatatgagaaacgagaccaggggtcttccggctagcttcacaaggtggttggctagacaacctgggtatttgatattaagttcttccctaatattcgtgtttttttagtttggtcagaatatgttgtaaacaacagtatgaaaaaaaaatctatatgttattgtttcctgacaagactgctattatggtggttgatgggcagtgaaaacagatcaaacttacaacaaataatctgaaaaatgtttctccattttcttgggaaaacaaaccaaatcacaacccatg

SEQ ID NO: 26288 - DNA, 1409 bp, Oryza sativa
agcagcagttatagacttgtttgtacacttacttgtagacaggaaggatgctgctcagaagggaaagaagagcgaacgacttctctacacccttggcaggtttggagagcaacaagtatgaaactggtccaacaagtactggcacggtgtcaacgccgagctgcatgaagaacaattacatgagacatacaaacgaccagattacatcttaatttttaagaaaacactatgattttcaatccagaaggaatactacttaattcagaatttgatgcttaaaaatagaaatgttactattcacaaactggaacaagatagtaaattcaaccaaagcatgtttcaggtaaactcaccaattaagcataggtaaaatcagacaatttcgccacaaacaacatggacatcttttgagaaagatggaaacaacatatagtgctaaaaaaacattatttcataaatgtaaagtgaattttagtctttgcaaatctgaaattgctagtttcaaaatactaaacaaggggccaaaaatttgcttggacacgagtattaacactgaacttaaacaaactgtcacttggagggcatgtgatttacaggccatcaatctgaaggagtgacaatcttcaaaaaaaatcatggtaagcatgccatttaatgtacatcagaatttcttttctaggacaaaattattaagcaaatgcactataatagcagaaagcaacacgctaaactaataagtaactttacgaactaagacattaatgacaataagaatgtgttagcaacgcctatgtagtcaggcagagaaaacaatcatgaaccagacagagacgtaagatgtaatcctagtatcttaccgccttagcctccttgtattcattcacagccttgtgggaagagtaggagaacttggtgttgggaccaagttcagggacgataaagtggctgtaaaggcacaacagcagcagttagcaaaatgttgaatgtgaaatctaaataaaatgttactgtcagacagcttaaatggaagcaaaggacttactagttggtgtcaaaccacttggtcatctccatggcagggacagtggcattgcccctagccatcgagaagtaggtgctgaacccaatctctccaccagtccatgagtagcgctctgggacagcaccaagcatggcagccgtgtcaagaacctgatcatagtacgagaaggtgttgctggggatgtacttgatcccagcgtcagccatttgcttccagatgctggccctgaggtcggtcgcaaccttctccaaatcctcagcgctgctcttcccatcccagaaagactccagggcaaacttgagctccctcttggggcccatgcgggggacccaacaatgtgagacgccatctttctataaaaaaaata

SEQ ID NO: 26289 - DNA, 1200 bp, Oryza sativa
ttcctgtttgcaacgagcaggcaatttttctagtaatgatagaatatcagaacagaaatagagaaaaacataagtcaacccggactaaacctcagcatcagatccaaaacccaaccaccggatggatagacgagtgagtagtgaacaaaccacgcttggcatgaacacttgaaatttaaaataaaacctaaactttttcggcggaagaaccgcagatccaatcgtaaccggacccatgcaacacacaccgacagaaacaaaaaaaaaatctaaataatcttccactccatttccggagcataatcccccagatctaagcacctaaccacacatcattcagatcggatcccatcaactcggaacaaagactctcgatcaatcaatccatccatgcatccaatcaagacgacgaacaggatcgcaacgcgaatggacacggatcgacgcacgaacgcaaaaaagaggagaggaagagaggcggcggtgcggggcttaccgtgggagagggggaggaagcgagcagcggcgatggaagagaggaggaggaggaggacggacgggagggagaaggggtttgggagggcttatttataagagaggatatatatgctttgctttttttttcttggttttttgtgatgtgtgagagtgtgcttttggatggtgggggttgggggttggtgagatcgatctggtggtgcacggttttttagatgaaaagtttcatctttttcatggagtaatatattgttactgtgttgtaacggaattttaattaaaatttgttattaaactattattatcgttagtttttacctatataattcttatttctatatatatttattaccgacatataagctctttggtccatgtgaaacttctgaccccgcatgtcattttactttctacagggaagggagttggtggtgggagtggtggcacatttaccagtttatcgctcaccaccgccactactcccttttaaaatgagtatagatattttgggattgtttcttcctttatgtcttgtgttgtttggtatgattatttatgttttcttttatatgtatttctagcttcacgaatttttatagatttagatttgtgattacattaatagattttgaataacatttagaaacttgaaaataatatcgagttgtgccaaacagggcattagactagggctgcaggaat

SEQ ID NO: 26290 - DNA, 1073 bp, Oryza sativa
ttactgggaggtaaattttaactcacggtgcatggacaaatcccggatatccatttctcgatccaacggtagtttccaagtttccactacatatatagtttgcactacatattttcccacgttgtaaatgctcaatgggagcttcattgtaaatgctctaactatactcattatctacatattccgtatgtttgataatgcatgtctaggaattttagttaccagattaggacgaccttaactcaacatttttctgtttaaaacggaaatctcagagaggtaattaattaagtgtaaaatatcaatcgagcattaaaatccattcgattagtttgctttgtttaattttacagcacattcaactacagttcatatatggtcgggccctagctccgccactgcctgcaagtgttgtcctccgttccatatatgtgggtccatccaagctacaattacagtacattctaaatgctcaatggaagctctagagtctggttagggaagcttaagattataagaagcggctggttagtaaccagcttgacggagcgtggggctcctcaccgggagaccgcgcaggcccccctttgccggttcggccggggactcagggtgagattctaagctctctgtatgtggaaggctcgcgagacaggaaacacacaagacacgggtgatgtatacaggttcgggccgctgagaagcgtaataccctactcctgtgttttgggagatctgtgtatgaaggagctacaaagtatgagccagcctctcccttgttctgggttccccatctggaaaagtccagtcccccctctcagtgggcaaggtcctccttttatatcttaaggggataccacatgcaccctttctctcttttttgtggggacttaccccaccttttcataaatggacggagatttgtatagttgccgtccgagtcaccttctgatgagacggcccacaactacctccactttcgccgggagcagatgcgacgtggaatcgtggctgtctgctgacgacatgaccggtgtcaggccagtcacgtcggtcattcttgtccaccacat

SEQ ID NO: 26291 - DNA, 1398 bp, Oryza sativa
tggtgcgttcgttaggagatgtgataagatggaaaacttgctcgcttctctacgcgcatgattcccaaacggttaagcgatatgttttttattaaatgccgcacttatccagtcgtgttcacctctagatcttgtcgttgctgtttctctctctgtcggtactacattattgccagccacattcatgctattatgactttcttcattaccaacctccaccatctatggacgaagacactattcattcttggtctagcctaactatgctcctgaaccactcatataatattgagacaatagaatatgaatataacaggaaaattctaatttatgtcaataaaatggttacctattcagaaatgatggataggatttgtatttatgggctaaaataagtttttttttaatttctagctaattttagttgtttttccatttacaatattaattttagcactatttgatcgattaaaaattattgtattaaaattattaaataattttgtcagggttatggataccacctacctaatagtagttgactaaatctcggaaggacccaccacataccatgtcctatatggaaacaacctgtggatataggaggagttccggataaggaaagataatcagagttctacatggaaacgacaaggactactcggattatatccatattggtttccctagttcaacttggacaaggggacacctatgggtataaatacaagcccccttaggaggagagtggggacgaggcaatcaacacccaacacaatagacatagaagcctacatacgccaagacacgtcgccggatatcgacttcagggataggcatggctagtcccctacggtgtctctagatactgtcaggagagacgaaagcactatctctgatctcgccaggcacggatttgaggaggaaggctaccctgttgtcgactacgagttatatcatcataccgccatgtcgacaacagttagataggctaccccaaatattatactggtgtgattatcatgaataagagcaataccggcttcggccaacaggatgtagggttattacctgacaattcaggggcccgaacctgtataaaaatccctgtcttcatctcttttacctcggtctcgcgtatatcctagtaccaatgatccccataccatgcaaataccgtagtcgagacatcaaacgtcgacaaatttgaattatcgtttgggccaaagttatttatagtttcatgttgttatttttattattatatttccttcagtcgagttgtgatatatgatttaggattttaatttaagcatatttctttcagtccagttgtgatatgtggttcaaaattttaatttttgtcgatgaatgttatttagaaaaaccgggggatcc

SEQ ID NO: 26292 - DNA, 1354 bp, Oryza sativa
  unsure (1)..(1354): unsure at all n locations
cgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgctgcacctcgttgcccgcgtgccctcttctgtccaacggagggttgactaccactagcctcctcctcctggttcccctccatatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagtgtaatatgtcgcaccacttccgtagtcaataattacatactaagtctaattacaaataaagtaatcttatattaaaactcaaataatattacatgctaagactaaaatagccatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacatgtattt

SEQ ID NO: 26293 - DNA, 4124 bp, Oryza sativa
tgggacgagctggacccagggtcgggttgccagttcggtctgaatcatcgtaggcctgggttaaggcaggttcgtgagggttcacggccttgtttaataatactgtgtagcgctaggatcgtctttataaaatggctttgggcaactaagtgacttttaaatgctgtttactgcaaaacttaaaccctatattattacccccttgtactcctttgcattaattgtgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaagggttactcttttctttcttcggatttcaactaagtactagatggtcagctttgcgaagaagaagatgtcgtcagttgtttgccgaagctccggaagactgcaggatccgccagcgaagcgaaggaagcagtgaagccagctgtgaagcaggagtgaagatcttggagaacccgtcgcagaacctaagccaccctctagggtagagtcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtcctgtccctagctctggtctattctttccttgtatgcttcccctctcaacctctaccttgtgacagatggataatactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcagaggcaaccaacgttcaagtacctacagtccaacaacagtgcaagttatcagaatttctcaaaactgagcccccaacctttgccattgccgtcgatcctatggaagccagtgattggttgcgcacagtcgagaagaagctagggttgattcagtgtaccgaccaggagcgggttggcttcgcaactcatcagttggttggaccggcctcagagtggtgggatagctacgaagcatcccggccagaaggacataccatcacctgggacgagttttcatctgtattcaagagatcacatgttcccgcaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagctcgcagtgcaactacttctagaggattatgaagattttgagaaacttgtggacaaagccatgcaactcgaaagtgagcataatcggatgacgaactgcaagagaaggatggttaacaacccagtatttccaggtggtaaccaaagacagcgcactgagccacttcagatcaccggatcttctgttgtgtatcaagagttcctgccccaagaagatgaacgcaatgcaggcaacaacaatagcaatactaatgatgatgataccaccaacaaccatggttcttgccccattagtgaccactcgaataaagcgtgccatgtcagtagcattcaccaagatgtcaacaatagtatcaatgatggcacccaaaatgacaaccctagtaattgggactctgggaaagactccaatggtgatagcaataatggtaccactgatgccaatgttagcaaggattcccaaccaccacttccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacttttgtttggactaagagtttcagatgtgtcttctttggatcaaaggcaacaaccgtcagtatagcttttggcaaaacactttaaggtttcactgaaaggcagcagaccaaaggaccacatcgtcaccagaagcatccacaactctcggagtgaagagtacttggttgacaaagttccaaagatgactgatagaagataccagcaaaggtgtttattatcgggcaaagaggtaggtcgaaaggtgattgataagagaaatcgggaaagaacacatcaaggtcaaagggtaaaggaatacgttgaatgctaactgaggacaacatgaagtgaatagtggtaagttagaagtaaatgacaagcatgatattctcatgataacaagcatggtatcctagtgatgacaagctgatatcgacgcataacgtgaagtgggtaacttgtatgaggttgacgccaaagatatgaattatgagaagtctggaaccgaagtcccatcttcaagtgccacaatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttctagctagcctcctcgaatctcggggacgagattcttgtaaggggggtggatttgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgccttttcccccccctcttccctcccggcctgctcggcccaggccgccttcccctcctctcctcctgggccggccgcccggcccaaccctagccgcgcccccgcccgtgcagcgcgcgtgcgcgcgctgatgccgccgcctgaccggtgggtcccacgcgccaggccgggcgtcgtccccttcctcccgcccggccgtcctctctccctctcccgtgaaccctagctcgtttcctcctctaaatccgctcgattcaagcacgg

SEQ ID NO: 26294 - DNA, 15988 bp, Oryza sativa
  unsure (1)..(15988): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggatgtgcaatgcgtcaccggttgcatggccgccctaagtcggttcatatcgaggctgggagagaaggcgttacccttgtttaagctcctcaaatgctccgggccgtttacttggacggaggaggctgaacgtgccctcactcagttgaaggcgtatctcagctctcccccagtactggtcgccccggagccaaatgaacccttgctactctacttagcggcgaccccgcaagtggttagtgcggcgttggtcgtggagcgcgatgaggacaatcctcattccgcgcacccccaccttgtgcagacttggcccgggagagagaagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccaatttggcccgggagagagcagggaggagaggcccccgagccgaacggaggcccaaggctcccgacgaccggagatggccctctgcccgcttgtccgacgacgctaggggcccccgacccccagggcggccccgaggccactgtgggaaggccgcccctgtcgtcctccgaccccgaggtcgtcggcacagaagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgttgttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgctcactgggtgatgcagttcgacggctccctgtctcttcagggcgccggtgcgggggtcacattgacctctccgagtggagccgtcctcaaatacttggtccgcctcgactttcgagcgaccaataatatggcagagtacgagggactccttgccggactcagagtggcagctggactggggatccgccgcctcttggtgttaggcgactcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgtccagccatcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgagcgcgtccatcgcatctccaaacgctacgtactggtagaagggaccctctatcggcgcgcggctaatggaatcctcctgaagtgcattcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccgccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcaacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactgctgcgaagacatgggcatcaagctctgcttcgcctcacctgcccacctcagaagcaatggccaagtggagcgctccaatgcggaaatcctcaaaggtcttaaaaccaagaccttcaacttactcaagaagcacggcgtttcatggatcgaggagttgccagcggtgctctgggcaaaccgaactacaccaagccgagcaaccggggaaacgcctttcttcctcgtctacggcacggaagcggttctcccatccgagctcaccctgaggtctcctcgggccaccatgtactgcgaggctaatcaagatcagcttcgcagagatgacctcgactacttggaagagcgaaggcggcgcgaggccctccgagccgcgcgctaccagcagagcctgcggcgctaccatcagcgtcacgtccgggcccgatcactctgcgtcgacgacctcgtcctacgccgcgtccaaacgcgtgctggattgagcaggctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggagttgggtgtcaggtttcgggctcgggccaaccccgcaccccctcgggcgtgcagggttggccgggggctgccacacatgcactttcttatttctcttatttcagaatttcaataaaagcagtttcaatttcctaaaggttgtatctgtgctgttttttccttttgaagaatcttgacttgaaatagatcacttgcgctcaatcctgccctcgggggctcgggtcggctaaaaatcgccaaacggggcccagaaccgagccgtgcctcggggcgtggtgaactccgggggggaatcggcaaaaacccacaatcgggtcacccataaccctcggtcaccacgttcccggcctggccagtctcgacatgtggatctccctaggcactgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgccttttcccccccctcttccctcccggcctgctcggcccaggccgccttcccctcctctcctcctgggccggcagcccggcccaaccctagccgcgcccccgcccgtgcagcgcgcgtgcgcgcgctgatgccgccgcctgaccggtgggtcccacgcgccaggccgggcgtcgtccccttcctcccgcccggccgtcctctctccctctcccgtgaaccctagctcgtttcctcctctaaatccgctcgattcaagcacgggattcccaaattaaataggggaaattaatccccattgactcctcttcatttccccctaatttcccccttgaatgccgcccccaatcgccgggaacgcccgcgttttctccggccaccaaccattgccgccggccgtggttctcgccgccgttccgacctcccccgtggccggttccctcccccatcctataaaatgggatcctcatcccccgttctctcgttttagccccatcccgagcctccccgtggtccctagctccctccccaccgtcgccctctctctcccacgttgccggccgcctccagccgcctgtgccgcctcgaccgtgcgccggccggccgcaccgtcgcctcctccagcatcgccgccacctcctcttcgccggcctgccctccgtttcgcgaggtgacccccggagctgccttctccccgtcgccctcctcttttctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcctctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgtccgtcgtcgtcttcaccgttccctctcgccggctcgtcgtctcgcggcgccgcctccgtcatcgtcatcatagcggcgtgttccacgtcatcctcgaccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcaagccgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcagtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccatcgacccgtggaccgtctctgtgtactcggtctaccgtggtcctttttgttgacatgtggggtccgcatgtcaacggcgcagccttcctgtcttttcccaggctagcgcttacacatgttttataattgcaaagcttaattataataatccgcaaatctccatataacagcattaaacttcggatgatcatatcttggtcatacgaactccgaatcgacccgttcaagtctcttaatgtttgttataacctaaagaacccggtgctttctttttatgtactgttattgcttctttataggcttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattatgttgatttaaattaatgcattaccgctttatttaaattcccgcgttatcactgttttatttagccatgcctatttacctttgttatgaccttattattgctattgttattattattcccttgttcaccctagattaaacaaaacctcaactagtgggtactctattcatggttccactagtatgaatttaggtagatgcttcgctgtttgaattagacaacattaggtggtttcacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggttatgggcaagccgagcaatgtacccaagtcagtgttttaattcttaaaatttgctcagcaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagcgctaggatcgtctttataaaatggctttgggcaactaagtgacttttaaatgctgtttactgcaaaacttaaaccctatattattacccccttgtactcctttgcattaattgtgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaggcactagccccgacccgcgccttttgaggaccagaacctgggcacgagcccttattcaagctaagacacaaaagggccacggcacagatcatcctcatctcatacacatagcaagataaaattaacacaaaaatttcttcatttttgattacagattaagttgatctatacaaaaaagaggcccgaaggccttagaagaaagaaaagaagaaaagactgaagaatggcgggggtctgggggctcattccgatgcgcccggatcgccggcctcgacgtcactgtcgtctgcaccaccggcattgccctcctcgtcggagttgggggcaaacgcaagccgaggggccgagccctcgaagctgtcgacgatatagtcggcggcatcccggacttgcgcgcgcgcgcggtcctcggtcccaggagggaactcatccagcgccatccatggagagaagttggggtccctggcctggtaactcgccaggacgagctccaccgctccttgggcgaggtccctcgaggatgacttaattgtcttctcgagctcctcgggaagccgttggagagccccggccatcttcgagaggtgctgggcgaggcctccctggttgtcggcgtactttgcggtctgccctctccagaggcccacctgccgaccggcgcgatctaggcgggagacggcgtcccaaagcatgccgggcccgacctcgcctgccaaacggagggcttcgacctccccggcggatgagtccagcgcgctctgcagaccggcgatggtgtgttcagcatctgcgaggcgggcggctaagtcgctttcgcccgcggccgccccgccgctgcgcgccctcgcgtccagctccttcgcccgcgcctcgagctcagcggcccgctggttcagtgcggccctctcggcgcgggcaccttccagattgcggcgcgcctgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagtgtcgcttcccggatggtgacagcggcctcgcggtccgccagatccctctccacgacgcaggcgcgctcttccagcgccatggcgcgcgcctcgagggtctcttgacgccgccgggacaccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcattacggtggtggcaatgagggcagccccccgctcctcctccacttccttggcgatctccgccaacaccttcttacgggtttcaagctccgagacatgccggcggtgagccttacggcccacctccaccatggcctccaccgagcgtcgcccctcttcgacgcgcgcccacgcggtgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagtcgcctcggagaagatgccgcgcggctcggcccgccgatggacgtgccagacgcagggatgtcctccggacctggttgagcctgagcgtcgcccgagggagtgggcccaagcgacgtgcccgctgccacgtcgccagctgccccggaagttgtcgcctgagcgtcgcccgagggagtgggcccaagcgacgcacccgcggcctcgtcgcgagctgcctcggaagtcgccatcgcctcgtcctggcgaaatccagcctcctcccgagcggcttcctcggcatggtgggctcgggcggcctcctcccgagcagcttcctcggcctggcaggctcgggcagcctcctcccgagcagtttcctcggcctggcgagcccgggcggcctcctgggcggcctcctcggcttcccgtaggcgatccgcggcctctcgccggtcagcttcccgcctgcgggcctctgcggccgccggatcctcggcctcaggctggccggacttggaatgatgggagggacgcgacgggatctcgctgaaacaaaagaaaagaccagaagacgaacaagatgggcgagtgaaaactcatgttgagagaatgaatacagccacgatgggtgagagacgaacctgcgagggggtcggttaaacgaccactttggaggggaaatgaggtttccccgagatggttctgtctcctccatcttgcggggccgcttcttcttgcgctccccctcgagctgcgatgctggcgcggccccctccgggcgcttgctgctggcacgcgccgccccgccccctcggggaggagatgggggaggtgttcctccctgcttcctcttcccccgggcgtcggcagggcggctgctccccgggcccctgacacgggacccagaagcacgaccccctctcggggtagattgctccccccggcggctccctcctgcgccgtcatggccctttggagctcgctcctcagaggccccgacccccatcataatggtcaggatcgaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcaccatacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgagggcagtgtagaaccaatcgctcttccagtcgtcccacttcttgcggagggcgcaggggatgtagcggttcagcgccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaagggagaaagaagacggaccgccccgggtagtctggcgccgggcgtccctcgcccagcgtgactatctcccggccggcggcagattccggcatgaagcggcgcggcagcccagcctgcctctcactcacgatgcgggagggcggcagcacgctaccatcgagcagagcggagccccgtgccatggcgccggaggaagagaagattaagagcgagcgcgtgtggctagggtagggcgcaggaaagaaggagttagggcgcaagcggcaaagacaaggggaataatggcgaaaggaaggaagcaaatcccttcctcagtgcctttatacccttgccaacgctgtgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcatgcgcgcgttaattacgctcgccaaccgaagcgacgttaccatatcttcagatgaaacgaatcgccatgtccagattcgtgtgctactcgagtaatgtggcagtcttgaagagaccgctcattattgacaaccgagttaccattgccgatgtgcgtgatttttgaccgttggttttctgcccaattgtggagaccgatcccacctgtcaccgggccttaggagtggcgtcacgcccgaccatttcccttgaggagggcgatcgccctggcataacgccgggggctactgttggtgacatgggatcgggagtatcatgactagaggtttgaggcagacacaatcgcccacgtggcctggcaccctcgggggacgtcaggcccgaaggtggtgtgttcgccctcctcttagtccccccgagggggtcgggctgcacccccctcggccccgagggccgaggcgccccgacccctcgtgggatttcgctccgcgtgtatggggtaggtgagcacagtggggctcacctaaccacatttattgcggcttggctgagcgtgtcacgacgcatgtaatgtagtgcattgcactcatttatccggtctgtgaccagtcacagaccggtcagatcgcgggattaggtggcgacaggcggtctgacgcacgcctcgccccatcccgtcaggacgagggcttctaggcgctcgtccccagctggagctagcgtgttacctcccagagatggcacgttagtcctgatcagatatatgccaggcttcatcctaaccattacaggcaaaatgtagtgtgaaggagggccaacatgcagattgctaagctgacacgaggtggacaagaatgaccgatttgtgaccattctgacaccggtcatgtcgccagcagacagccatgattctacgtcgcgcctgctcccggcgaaagtggaggtaggtgcaggccgtcccatcagaaggtgactcgaacggcaaccatgcagatctccgtccatttatgaaaaggtagggtaagtccccataaaaaagggggggatggtgcatgtggtatccccttaagatataaaaggaggaccttgcccacggagagagggggatagattttagagagagctttttcttggactggacctttccagattaggggcccagaacaagggagaggcgggctgatactttgtagctctttgatacacagatctcccaaaaacacaggagtagggtattacgcttctcagcggcccgaacctgtatacatcgccggtgtcttctgtgcttccggtctcgcgaaccttccacatacagattgggagtttagagtctcacccagggtccccggccgaaccggcaaaggggggccagcgcggtctcccggtgaggagccccacgctccgtcagcgtgggatgcattacatatgaaacacttagcaagttcgtacgggaatgaaaattggtatgtaggaagacagtaaaattaaactaactctgtgttgtacggtaacagtatgaacgtcttgtaatgctgcgccttcaggagatggacgagattgtcctctgtttcctgcggatattggtcgagcattgcaacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaattataattgaacgatatacttacaaagtccagcaactcataatagagacgtcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcggacttgacaagcggtttaccgagttcgtacatgtatttcaattccgccttttctattggttcaactcctagcaattgatccgtagatagaccggtgtcaataataaattcttctatcgtcatgtctttcccggttaccaacggctcgatctcctggtttggttgctctccaagctgagggactggtttggactttccagaagatgctttcttcagcgttcgctcagagtccgatagcttgatggcctccttgacaggtgcagacatacccctgaagaagttcatgacactggggtctataggaatattcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgtttgtcgcccagggaggatgatgtaccgcctgcgccatagaataatggcatggcttgtgtctcgtaaatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatactctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttcccttgtattcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgagaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgttcaacggagggttgactaccactagcctcctcctcctggttcccctccacatccctttccacgtgcccctgctggttcctcctccgcatccctctccacgttcccttcctccttcaagtactggtttggatcctcgttcctttcttcttcattccagtactggc

SEQ ID NO: 26295 - DNA, 4069 bp, Oryza sativa
tagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactaaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatacatatatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttctcgtggcaatgtacgttgacgtgttcgttctcgttcggcgaaggcggcggcggcgtggcgacggcggcggcggcgtggcgttggcatgcggcggcggcgttgcgcggcggcgaaggcggcggcgtggcgtgccggcggcggcattgcgcgcgcgccggagaatgcggcggcgtggcgtgccggcggcggcattgcgcgcgcagcggcgaagacggcggcgtggcgtgccggcggcggcttggcgcggcgtcggcgtggcgcgtcgtcgtcgtggcgcggcgtctcgtggcgggcggcgcgacggagagagatcgagatcggagagatcgagatgaagggagatctggcggcggcggctctcaccccagagatgcggcggcatcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgagggcgcaccggaaatatatatacccccggatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaagagtacaaagattaatgataattacttcgaaaaattatttttgtctgtaataaattaagtggataaatcgtaataagcaaatatatgacttataattaataaaaattccaatatatatatatacttagcatatatatgaatgatattattatatgggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgtttaaaactctaattaacatacatatgaaattgacacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactctgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgtcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgtatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcggatgacctcttctgttcccataccccttggcgatgtttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaatgaaggtggaaataccaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagatgtgtcatcaacacgtgacagtcatgagactttaggtttgtgaacttcttctccttcgtgcttattattcgcttgatattcgtggagtatccagacggatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcattacgtcgattgcgtggcgtacgtccaagaattcccaatatggtaactcccaaaa

SEQ ID NO: 26296 - DNA, 2000 bp, Oryza sativa
acgtggcagttgttccatcgtgtcccatggcatcgacacgaacagcgctgttttggttcgtgctcttcatgtcttgggctcttgtgtagaatgtgtacccattgatctcatatcccaggaatgtcgcgatcgacccagacggtcccctcgccaggaaggcaagttgttggttgattgactcgttacccatgagatattgtcgtagccacgcggggaaagtatcaatgtgatgccgtgtaatccatgcatcggacataccgatgttcctagcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatatgtactttctgtttcatccatacagtgagggcaagccttgtaccccttgttgaactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcta

SEQ ID NO: 26297 - DNA, 8119 bp, Oryza sativa
ttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatatgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagttccttttcctcctttcccgtgtgctatttgcaaaatgtttactctttcttccgtcttcaaatttcaactagtactagatggttagttttgcgagagaagaagatgtcgccaattgtctgccgaagctccggaaggctgcaggattcgctagcgaagtggaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagaatagtgggaagtgaaccaaatgtaaagaaagtgaatccgagttgcttgttcatgagagctattcccagttatgaaccaagtgatatgttcgaagatagtctatggaggtcagattaaaatcgcatctaacaacgaagcttcagatttggcaggataacgatcagaccataacaagtccagcagcaaagtcatttggggagacgtcaaagcatgtcaagtgggataagttggttctttttagaaacataattcaaaggcaaagttaccgacccttgcatcgaatagcagaagtagctagcacctggagagcaggaaagctaatatgaggcagttggtggcaagttagaagtaaatgacaagcatggtatcctagtaatgacgagctgatctcgacgcatgacatgaagtgggtaacttgtatgaggttgactccaaagatatgaactatgcgaagttctggaactgaagccccatcttcaagcgccgcaacccagtcgaagtcagctaaaggttcaaccagggacaagtcaggcgaagagaagattccatctgcaacaagggatcgagccaagcagcctagagtggcgaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctcataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagcccttaaattttacttgaattttcagagcaccggaaataattattaagcaacaaaaacaattatcaaagtttattaaaaagaaaaacctaaaaaataatcctcttcctcctttgggccaagcccagcccaaagtctccctctcctccctctctttctctccctctccttctctccctcctcctcttgggcctcctcccctcccggcccactccctcctccctctctctcccgggctgcctctccctcctctcctcctgggccggccgctcggcccaagccgcgccccctgcccgagccgcccctccctcccgcgcacgtgcgttgcacgcgcgctgagcgcgcgccccgcgtgggacccgcctgccaggcgtttcttcctcctcccgcacagcttctctctcccccgtgcgaaccctagctcgctccctcctccaaatccgcttgattcacttggttaattccaaaattgattagggggttttaatccccattgattcctcttcaatttcccccaatttcccccttgaatggcgcccccaatcgtcgggaacgcccgcgttttctccggccaccaaccatggccgccggccgcctttaccgccgccgttccgacctcccccgtggccgtctccctcttctctcctataaaatgcaaccccctcgctccgttctatcgctttagccccctcccgcggtctcccatggtccctagccacctccccaccgtcgccctctctctcccgtgccgctggacgcctccagccgcccctaccgccttgcccgtgcgccggccggccgcgccgtcgcctcctccagcgtcgccgccacctcctccaccccggcctgccctccgtttcccgcggagacccccggagctgccttcccgccgtcgcccttctctttcctccgtgctggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcaccgacgactagtggtgtcgccaccactccaccatctccagccatccctgccgcctcgcctgagcgtcggccgacgtcgccgtctcctccctcggcgtcgccgcatcgccctccaccccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagccgcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagtgagccgccgcagccccgtcatcgtcttcgtcctcggctccgcatcgtcaagcctcgtgccggccgcgtctcgccttcgtccaaggatcgccgccgaagtcgttccctcgcctcgccgcgtagtggtaaggacctctccctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgttgacccgtggaccgtctctgtgtacccggtctaccgcggtcctttaggttgacatgtggggtccgcatgtcaacagcgcagccttcctgtctcttccaggctagcgcttacacctgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagtaaggcaagtcacgtcatccttgaacatattgaatcccagtttataaaattatgttgctttaaattattgcattatcgctttatttaaattcccgcgttatcactgttttatctagccatgcctatttacctttgttatgaccttattattgttgttgttattatttccttgttcaccctagaataaacaaaaccccaactagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtcttgtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacacgtactcaaaccaaaccgtatgtttcatgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttcctgtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacatcgttaccatcagcagctatttcctccttgcccgtttgatttgcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgtttcacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcataacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggtaggtgcctaaaaggtttgcaacttcat

SEQ ID NO: 26298 - DNA, 4060 bp, Oryza sativa
accgggatctttagccccggttggtataccaaccgggactaaagttacggttggtataccaaccgggactaaagatcccggtggggcctgacatgacctgacagcattcgaaccgggactaaagatgatctttagtcccggttggtaacacaaaccgggactaaagatcaaatatgcccgttacccttttgaaccgggactaaagatcatctttagccccagtttttattgcatccgggattattgtggaaatcggccgaccgacgaaagatggtttctccaccagtgttgcctacttcaatccctacgagcagaacaccatctccgattatatcgacgacaacgagacgaagttgggtcggaacgagctgtacctgggcagcaaatgcatggaaggggcccacaagctcaatgccaagctcggcgacaacggcgacacccagttcagtttggacgagaagcaggaggtcgtcgacagcttccgcggcacccgcatgtggtggaaactgtccaaggcttccgatgactattccttgtatggacgtaagatccaacggcgcaactacatgctggtatttcacaagcgccaccgtcagctcgtgcaagactcatatctccctgaaatcctccagcaagggcgcgcgctcaccgccaagaacaggcagaggcgactgtacacccaccacgagaaccatatgagcacgtggacccacgtcccgtggaagcacccggcgacgttcgacacgctcgccatggaccccggcaagaaggatgagctcatagaagatctcaagatgttccagaagggaaaggagtaccactccaaggtcggcaaggcgtggaagcgaggatacctgctatacggtccgtccggaacaggcaagtccagcacgatctcagcaatggccaactttctcaaatatgacgtctatgacctcgacctaacgaccgtcacgaacaacaccgacctgcggaacctcttcctccagacaacagagcaatccatcatcgtcattgaggacattcatgcgatggaattggaggataaacgcatgagcacagacttccagtggtactatgaaagaaagaaaataacgctgtcggggctgctcaactttattgatgggctgtggtcagcatgtggcggtgagcggatcatcgtgctcacaaccaaccacgttgataagctcgatccgggactgatccgccgggggaggatggacaagcacatcgagatgtcctactgccggtttgaggccttcaaggtgctcgccaacaactacctagacatcaccgagcacccattgttcaccaaaatccaacgactgctcgacgagactgatatgacgccggcggatgttgcccataacctcatgcctcagggcaagaggaagaggaacacgaacaaatgcttgacaggattaatacaaaagctgaagaaggccaaactggaatctggaacgcgcctctcccgaggccgagtcctaccgacaggccatcaaggtataatctaaggcagaagagagctacaccggggaatatatgttgagtgggatcgatgctggctcttgtgtggtggggaattgcctagcaagctagctagctgcatctttctgtgtttttctgttacaatgcattttcgtgtttgtttagtcggttaaactctgcagagtcatagcctaaataaacccactttaattaccacttaccagtaatatgtactgcaggtctccatcctttttaatttgcgtgtgttaggagacgcacaagtgtggtgtgtgataaataaactggcgagtcatacataactactcagtgtaaaactacttatgtaccttatacttcacgttctagaatttgtgttctcaaccttattttgtaaaaaaactgcattgacggacgcttttgtaatattgttattttattgtaacacctaattaacaaaatgtagttggagtttaatcttacttaattacttaagatcttagcctaaacatgatcacctttgtttaatgcgaaaattgatctaactgaccttatttgtgaagccattgaagccggtatttggtttgttgttcgtccttttgctttttctccttcttcttcttcttcttctctgtactgattttctattgatgaaaaggaaacaaagagaaacctcatgaacccctttcagtgtcaaatcgatccggcgattgatttagggcttagggttagagagagagttcaaactcgatcagttgcctcttctcatctttcttatacaacgacactggtggggcttgattagttttgaattatgttttgcaccgatcacacaaaaacaagatcttatctctttttttttctttcttgattgggaaggaaactggtggttgttgattgataaatttaacaaccctttatccatgatcttatttaatactttaattacacatgtattgtccagaacattatcttaattaaactcaatttatgagcctttcgagtatggatccatgagtagatgctcagcttaataattcgattatgggacatatcttttacaaccatatcaatgagttaggtagaagacacacaacatgttgttaccataattgaaaattgtgttttattggtgcacatctgtagacccccgtttttataacaggaatcaatcgtgtaaacagtaccatttccctggatcaagtagtctggtacacacgagttcatagccggaataccaaatgctcatacacgagagtctaataccaaatgctcatacacgagagtctagtacgaattattacaacatgagcccgcaggcattgtcttaaatcatcggaccgagcggtccggaatacaaccaaaagcagagtttagataaggcagcggaatttaggcagcggcatgccattgccacaggcaacgaccgtactaagacctattgggcaccgtcgtcttcatctctctcctggtagtaggcatagggatcctccatagcttcatctcccgtttctgattaattttatatttgcaagggtgagtaccaaccgtactccgcaagccaccacagcaacaatacatatgaaaggggtatttcaaaggatggctatggttcttttgcgcaaagccaattttgtaattcttttcacaagcctaagacctagcatcaactgatcaaattttagtaccagtgtttgtatttaaacaatgacggttatgtccaccatccattgtgatcccaaggatagcttcccgccattgagtcgttatggttttctgaggacgtccactttcccccatctcaggaagtgactccaacagcataaaaattcatcatgcgataacccatcccacacaagttaagaattcagagtctagccaagtgtaatacatgtcccggtgctcaataaccgcgagcacggctattcgaatagatttggtttactcactgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccaacacacgaagacaaacgaggaacagcggaagactagggcgacgaccacaggcgcttgacggcaggcacgagctagacaccgaagccttcatcttccaggaactcctcatctgggcttgggaaaaattgagcaagactgagtacaaccaccgtactcaacaagacacacccacaaatgcagaataaatgcaagggagtacaagggaattataacataaagggttagggttgcagtaaacagcatttaaagacatttagttgctcagggctattttgtaaacacgatcttagaactatgcaaagttgttaatcaaggccgtgaacccacacgaacctgccttaacccaaggcctacgatgattcagaccgaactggcaacccgaccctgggtcccagctcgtcctaagccaacccaggccaaccattccacattttagttgttaagcaagttttaagaattaaaacactaacttgggta

SEQ ID NO: 26299 - DNA, 710 bp, Oryza sativa
caggtaggcagagatggcgtcgaacagcatgttccgttgcaatgtactcggacacagtgatctgctcgtaggggttgaagtaggacatcgccatgggaaccaagctactgatgatgtacctagcctcctcatggacgtgctccggcatcgggaccaaagcaagccgacgccagccatagctgacccgaaccctacccacttctccacagaaaacgccatgactgcgcggtgcagccactacgtactcgcctagtcgcctaattaagcgtatctagctacttacactgtagctcccttcaatggttgccgttgtggatgggcttgcttaccgttgcttctgtggcggtgtggcctcggcttatataattggcgattgtggcgcgcaaatgatccctgccgtttcatcgtggaacaggaaaaaggtgacaacgcgcctcgtcgaagtttcgtcgaaccaagcgcgatgatgcgatttggcttactccacaggaaaagtaagtagtagtagaaattgcaaggggctcaaagaaaccacgagaagggactatatcaccgcgttgggtttaactattaatgacccgagctgaaccggtgggctagaccacggcaccacccaccaaccactggtggagaaaccatctttcgtcggtcggccgatttccacaatagtcccggatgcaataaaaaccggggctaaagatgatttttag

SEQ ID NO: 26300 - DNA, 7042 bp, Oryza sativa
gacccgacaggtgggccccacctgtcggcgacccgagagaggaggcgggcggcggctgccaggctgggccctcggcctgcggccggcccagcaaggaggagggggaggaaggaggggaatgggccggcggcccatccgaaaagagaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaacccgattattgtttgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtacggatgggcggctttcaactcctcttccctttcccaggtcgcttcctcttccgaatgatgactccactgaactcggcaaaaccgggtgaccttgtttctggttctcctttcactggtatcaagtatgcgaaccggcttctccacatatgtcaggtcctcctggatatcgatgtgttccgaatcagcctgctcttcaggtacccttaagcacttctttaactgggaaacgtggaacacgtcatggatgccgatcatattggatggaagttctagctgataagcaacttctccccttcgttccaaaattttgtatggtcccacgaagcgtggtgccaacttgcctttcgtctggaaacggtgtactccccggagcggagtgacacgaagatacacgtagtctccgacctcaaaagttagctcccttcgacggttatccgcgtagctcttctgtcgagactgagcaaccctcaatctctccctgatgattctgactttctcttctgcttccgctaatacttctgttccgaacagttgacgttcgcctgtctgatcccagaaaagaggtgtgcggcacttccggccgtatagagcttcaaacggtgccatctgtagactggcctggtagctgttgttgtacgagaattccgcatatggtaagcttttgtcccaggctccaccaaaatcaagagcgcaagctctcaacatatcctccaagatttgattgacacgctcggtctgaccatcagtttgcgggtgataggccgtgctgaagtttaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgttataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaatttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccatgttgagatgttcaagctcctgtcgcaattcctcacacatgccctcgatgcatagagcagtgcagtaacttttccggcttaatgcgtctgccaccacattggctttacccgggtggtagtgaatactcatgtcatagtctttgattagttccaaccatcttcgttgtcgaaggtttaggtctggttgggtgaagatgtatttcagacttttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaactgactccacgttcgatggatcaactgctacaccctgagctgtaatgacatggcccagaaatttaacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcataaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaaaggatatttattcttgattgtgacctcgttaagtgcgcgataatcgacgcacatcctctttgtcttatcctttttctccacaaaaatgaccggagcgccccaaggtgaagtgcttggtcgtatgtaccctttctgcagctgttcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggcgtccattgggatttccgtctcaatctgattcaacgaggctcctttctttggcgagactagagatttgtacaccacggtttctcctttctcattggtcagggtgactgtgcgattcgcacaatcaatgacccccttaaacttggtcagccaatccatcccaagaatgacatctaggtctttggattcgagaagaatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgtaccgcggttgggctgacttccatggtggttctgactgccactagtgccctggtggaagttgctggggttgaatgggcggtgttgacgaacaatcatggtggtaggtccaccctgctgtccgggagtgaggcgcggtcggtgctgactaccttggttggaccggaactgcgccgcctttcttttcctgtccattttgttgcgctgatcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccgtctggcacctgtgccttcctgaagctacggcagaactctgcccatgtaacttcagtacccggtgggcgggtggccatgtggttgtcccaccaagctgacgcaggaccctgaagctggtgtgtggcgaaagcgaccttctcctgttcattgcactgcaggagattcagcttcttctctatcgcatggatccagtcatttgcctccatggggttggtggtgctggagaaggtgggtggcctgacacgtagaaactccggcaacttggactgagggggagggggaccaaactgctggtgctgctgttcggcgtgctgcatcatcctctggtgcatctgctggtgctgctgttgcatctgctgcatcatggctgccatcatctgagtctggtgtgccataacttgggcaagcgtcggattctcgggaagtggtggcggaccattgccagaatcactgttggggtgcacaccatccacgcgttcttcgccgttgctgccctcgcctgtcgtgcggttgccagtcctggtgtagaccatctggagggaaaagcagacggggggaaaaggagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggctcctgcggtcggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggagagagtgaacgcgggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtaaccatggacctccaagcggacacggtgaggaagctcgccactgagcggcggaatcgtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgagaaattagatacatattaataataacgaacaaagcataaataccttgcaacccatgataccgagctaggaccgagtgcatttcacccatcaaatcccaactgactgacgaataaatcccaataattttactaaaaccctagactgactcgttttgaaaaactcactttaaacgagcgaccaagatttttcccttgaaccataagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaagccttgacttgaactgcagcgggaacaccactccacaggcatcctcgacggcacggacgaagcctactcctcggagaacccgccatcggacacatactcgagctctgaggttgggggggaaaagtagagcaagactgagtactacccactgtactcagcaagtcataccggaatagaggtatgatgcagggatttaa

SEQ ID NO: 26301 - DNA, 15984 bp, Oryza sativa
gaaaaagaacttcttttaggattttctttttataaacctttttaactttgttcatttcttttcaattattatttgtgctctgaaaattccactaaaatttgtttaagcattttaggcttttaggaaatatacaaaaatcctccaagcctcatttgacttttatctttgcacattttaattgttggaggctttcacattgaattttaattattctttgcacaatttcgaggatagatttttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaagccttgacttgaactgcagcgggaacaccactccacaggcatcctcgacggcacggacgaagcctactcctcggagaacccgccatcggacacatactcgagctctgaggttgggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcactcccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacagtagagcatttgcaatataggatcaacatgttcaagtgacaggcatgacttgccttgctctgctgctggagggacctcggcgactatctcgaagtacaccggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacatgcggggcccaccggtcagcggcacggggaggagagaggaggtggcggcgcgcgggcccacgggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaagaggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggccggagtagcaaaagcggcggcggcgggtggttgcacggcgtggaggcgatggggagctcgggagagatcggcgaaatggggaaaaagcgagagagggggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccggggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagagaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaacccgattattgtttgcattgttttcttagggttttatcctgatttcctctgcattttcttggggtcatttgtaatttacaatttggcttgggaggaaaacttcggggtgtgacaattttagagtcgttttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaggtcttcgcgaacttcaatttgctctgagttggcctgctcggatggcactcggagacttttcttgagttgcgacacatggaacacatcatgcacgttacccaaggaggcgggcaactccagctggtaggcgacttctccgcgtcgagcagtgatacgaaagggacccacataccgaggtgcgagcttccctttcgtctgaaacctgtgtacacctcgcaatggcgtgacccgaagatacacaaagtcatccactgcgaattccaggtcacggcgacggttatccgcataacttttctgccgggactgtgccacctttagattatcccgaatgattctgactttagcttcagcttctctcaggatatcagtcccgaacacttgactttctccaacttggtcccacaatagcggtgtccggcatttgcgcccgtacaacgcttcatatggtgccatttgtatgctggcttgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgggtacccagctcttcttggagcttcttccaaaagcgagaggtgaattggcttcccctatcagatacgattttcttgggaataccatggagactcacgatcctagcgaagtagagttccgctagtttattccctccataggtggtcttcacaggaatgaatcgagctaccttggttaatcgatccactattacccatatagagtcatatccaccttgggtttttggaagaccggtgatgaaatccatcccaatttcatcccatttccattccggcacttggagaggttggagaagtccggccggtcgttggtgttctgccttgacacgctggcacacatcacatagagccacaaattctgcaatttcccgcttcatgctaacccaccagtatttctccttcaagtctaagtacatcttggtactgcccgggtgaatggaataaggactttcgtgagcttcctgaagtatcagctgtttaagttctcggttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccgcgaccaactatgcttaggttcagggcttccatctgttgattaagctcgggcggaatgctacggacgttaagagtattgcaatggctcttccgacttagagcgtcggcaaccacgttagccttaccaggatgatagtgaattcccacatcataatccttgatgagttctaaccatctcctttgccgaaggttcagatctgactgagtgaagatgtatttcaaactcttatgatcagtatatatttcacagcggttcccaatgagatagtgccgccagatttttagagcatgaaccaccgctgctaactccaagtcatgtgtagggtagttgccttcatgaggacgtagctgacgtgaagcataggctaccacatgaccgtcctgcatgagtacgcaccccaatccttggcgcgaagcatcacaatacaccatgaaatccttgcgagtatccggcaagattaacactggcgaggaaaccagcttttccttgagagtttggaacgccttctcgcactgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatataacccgtatcgcgtggtgaatgcggtcttcggaatatcttcttcacgaatacgtaactggtgatatccggaacgaagatcaatcttggagaatacagtggcacctttaagctgatcgaacagatcatctatccggggaagagggtacttgttttttatggtgacttcattgagagctctgtagtcgacgcacatcctcttcgtcttgtctttcttctctacaaaaatcacaggagcaccctatggggaagtactcggacgtatgtaccccttttctttcaactcttccaactgtttcttaacttcggccagctcatttgctgccatacggtagggtcgcttgtacagaggagtggttcctggagcaagatctattcggaactcaatctctcgcttgggcggcataccaggtagttcttccggaaacacgtctccgaactctctgactatggggatttctgacagttctatctgatgaagttccgaacttctgacagaggttgagggtgcaaagaaaacaaccggttgttccggtcctcggtacagagtgacagtgcgcctcgcgcaatccactaccccttggaattgggccaaccaattcatcccaaggatcacatccaagttctttgtgtctagaagaatcagatccgagggaaaaggaatcccctgaatttctataggaacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggtgcttggccttgctgacgccttggcttcgggcatttatccgcaaagtgcccgggctcgaagcagttgaagcacagacgctgctgaccttgagcgtccctgcggccttgaacgggctgcacagctggcgtaggaggacggggtgcacgagtcccttgctgattctgctgctgctgtggctgtgggacgcgcaccacgaattgaggtcggggcgctgggcgaggttgctgctgctgctgctgctgcgaggaggatccccctgggtagggattggtgtagcggaccctctggttagcaccctgttgattgcggaaattcgccaagcggcgcttgtgcgattccagctccttgtgcttggcttccaagcggatgctcttgtccaccagtcgttgaaaatcaggatagtccccagagactagacgaacggacagctcagggtccattcctgccaagaacttctcctgcttctcctcgtcttcccgcacatcctccggggcataacgggctagattgttgaactcatgcaaatactccatcacggagcggttgccttgcttcaactcccggaattccctcttcttgagagccacgactccggcgggcacatgggttctccggaaagcggcggtgaagcgagcccaagtaatcggttgcccctctggctgcgtagcctggaaatggtcccaccatagagatgcgggtccctgcagctgatgggcggcgaagacgactttctcctcatcgctgcactgcaccgtgtctaacttcttccccacggcatgcaaccaatccaaagcatccacggggttgttggagctggagaaggtaggtgggcggatgcggaggaactcggcgagtttagagtgttgtgggggtggtggtggagcattctgttgtggcgggttttggaggtggtggaggaaagcggtcatcatgttggcttgctgggcgaggatttgggtgagaatggcgttggtgtctggcggtggtggcggaggtggattgccttggtggttggggttgctgccttcgggttggttgccttcaccggtgttaacatttctcctggtcgtcaccatctgaaaaccccacacggaaccagcaaacagagaaggagctgacgattaaaactaaccacccacgactaccattattcttaaatttatcactgctattaaattggttcattaatgttcaagttgcttaggcaaataaaataagacaggctccgacatagatacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgggacggctgatctctccctgggcgatcttgagctggtgcagctgcgcctccaacgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtctccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccaaaccacgacgggtaacgctgccggccatctacaaacaaaaacaaaaagagaaacaacattttaaaggccagattttgatgataagtgaagcagcaagacagagagagactagacagttttcacaaataacaaaggatttttatttttgaaaatattgctaaggcttgggatctacggctcgtcctagggtcaaggaaggctctgataccaacttgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccaacacacgaagacaaacgaggaacagcggaagactagggcgacgaccacaggcgcttgacggcaggcacgagctagacaccgaagccttcatcttccaggaactcctcatctgggcttgggaaaaattgagcaagactgagtacaaccaccgtactcaacaagacacacccacaaatgcagaataaatgcaagggagtacaagggaattataacataaagggttagggttgcagtaaacagcatttaaagacatttagttgctcagggctattttgtaaacacgatcttagaactatgcaaagttgttaatcaaggccgtgaacccacacgaacctgccttaacccaaggcctacgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacaactttacccacaagacacatctttctcacgtgcaaccacgtgccacataccaccacggtatacagacgaaagacatgacatagtttccaacccatcctagccttagacaagagtaccgacccaatcctgcctacggccggaacccccgggacaggcaggcaagactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgaagaccggtccttaaacggccgaggtgctactatcaaaaccatgcaccccgagcccagcctaaaaccattttaggggattttgaatagagggggcggtgtgaagccaattccacaataatccaacaattccagagtatccaggtgatatgaaataattcccaagtctaaagttgtaaaaccacctaaggttacctaattaaattgcgaagcatctacctaaaattatactagggataccatgagtagagtgtccactagttgaggttttgtttgtctagggtgaacaaggtagtaataataacaataacaataataatatggtcataacaaaggtaaataggcatggctaaataaaacagtgataacgcgggaatttaaataaagcgataatgccataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaaaacccatttattgcgtcggccgagggaaggggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagcggagagaagggggaaagcgaacggcggtcttcggctcaccccgggacaacgacgacgacgagaacggcggccggagtggaggaaagcggcggcgcggctcgggatgacgatggcgacggcgctccgacggtcggcggacggagcggagcggcggacggggtcggcggcaacacggcgaagcggacggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacggttttatagcgtcgggagggagagaaggcggccggggaggaaggaaaccgaccgcggagatttcggccgccatagatgcgccggcgatgaatgcgggaaggaaatcggacgaatccgagggagagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagagagggagaagtgggccgagccggcccaagagggaagggggggaaaaagaacttcttttaggattttctttttataaacctttttaactttgttcatttcttttcaattattatttgtgctctgaaaattccactaaaatttgtttaagcattttaggcttttaggaaatatacaaaaatcctccaagcctcatttgacttttatctttgcacattttaattgttggaggctttcacattgaattttaattattctttgcacaatttcgaggatagattttagagtcgttttgggacgcgacactcacactgcagtggatgtacactttacccacattctgcgactgcccaacacatgagccttgtctcaacacatgagacgcgtcacggcaaagcctttcgataacctcgcattggcagtacccgctccatgaacttttcatcctcatgcactctaggcgtacacggtttctagcagtgagaggagttctggcgcacccaggaagggaagttttacacccatgcaattaagttataactaagttcaactcaacacacgacagtcctaacaatggcgacaccattgtagagcccctgccttacacatgagaaaccactatgcatggatactgcttccgctcggctattaactccgctaggtctatccccattcgagaaatccggggtcgtttcatgcttaacttcatggctcggtccttaattgaccagggacggtactagcctttcccggataccacccaaatccaccatccgccccggtctaaaacataggtttttaattcctttcatgtcaccattatcatggcaatgtggtgctcatgcctccacatgccgcatctcaattaccttcccaaaggtaattgcccaagcatatagcatttgataaatatgaacatgcaagattctagaatagcattttctaagcaagtgtcataattgactagggactcatacgtaattatggttacaaggatttgaaggaaaacaataacaaggcatggcataaccacaagtgggatgttgatcattgcatgcaatcttgtttgtaaacaaaattaatttcgcaattgggatcaacgtgatcaaggaatagtgatgacttgccttgctcgaggtcttgtgggtcttgaccttcgcccggatccgcggctccctcggtctctgtagttacgtgcgtaagaacaatttgaattcgattagaattcaaataaaaatccaagtaaatccaaatggaagtcgaatgcgaaaatcaattctcttatattatctttactattcgcgaattagggcgaaccccattttgatttaaactattttgcgtgtataaatattttgttgtcataagtttttaatttaatcaacccgatcaatataccaatataataggctagaaatttctattgcgagctaaacatcggacgaaatcctagaaatattatacgacttaatttagtctatgattaaatataatacacggctaaaatccctagtaattaaatacgaattgctaccgttaatcgattacttatagagattacccaaaaataatccataataatttacgagaattcatacatttgtttagttattaattacatctaaattactaccgcgaattgatttcttatagagattactaagaataatctataattaaattttgcaattctacgactataactaatctataatcatactctaattattttaaattttctaaacttcccaatctccctctaattccctatttacttctttttttcctttttcttttcttccctttctttttcttttctttttctctttttctctcttctctcttttctttcttttctttttctctctcctttcctttctcctcccggcttccttctctcttcctctcttcttttctctctctctctcggcttcttcctcccgggcggcgatgacgatggacgcagggggggggggggcggcggcttaccgacagcgacggtcggcggcgacgacagcgacggcggcgcacggcgcggcggctccgaggcgacggcgcggcggcttcgaaggcggcggcgcgatggcatggcaacagcggcgcggcggcacaacgacggcggcgcgtggagaagagaaagaaggaggggaaagatggggatgggtgtggagaggcttggggatggaggggaggggtttttgtagggcgtggagaggaagaaagggaggggaaggaagagaggggaagggggagacgagacggcggtgcggggctcggggtgagggcgcactgcatggggctcggggcgggacgcgacgggcggcgacgcgacgggcgacgcaacgggcgacggtgacgagacggccgacagtgacggcgcgcggcgcgacagcggcgacgcgacgggcaggcggcagcggcgtcgcgcggcgcgaggtgcggacgcgatgggcgagcggcgcacgggcgagcggcgcgcggggcgcggggcgcgaggcggcgacgcgacgctggcgcggcgcggcagcagcgatggcgacggtgcgcggcgacaggtgacgatggcgcggcggcgcggggcgcgaggaggggggacgcacggcgcgaggcgcggcagcggcgcggcaggcggcgagggtgacggcgcacggcgacaggcgacggcgtgcggcacggcgcgggctcggcgcggctagggcagcggtggggagaggggaggaaggctaggggacatcgtcgaacacgtgtggcggccgatgaacagtggttttttctattaaaccgatttttgtgtatttcccatataaatttaattccacaattcctaatttttgcatatatgcattttactcaataattgtgttatctcaactaatgaactcaccctagattaatatcacacatttattattattattattattatttatataatttatttgaagttttttaattagggttaattattattccatcgtatttaaatttaattgatccaaatatggtcgcgacaatattttatttacttctatccacacctaatctttattttaatttatatttattttaccaatttatttttaaggtttatttctaattaactattctttactcacgattaataaacttcgagatcaaatccaaaaataggcgaataagatcagcatgatgcaattgatttaaaaagtttttgaaaatccgtatttttagagttttggttttatcggtcgaattttcagggtgttacaacatcttataagggaacctgtatggctcgggcgcccgatcatttcgagaaattcggtgacgtcagcgcccgatttacgtgcaaaaactcctttcaactgttttttctcttaaattacttatccaaattatgatccaattgcaccattaaattcattgcaattaaatcttcaaaacaagaccacacatggatatattccgacgaaaaatttttttagcttatttttgaattatttttaaatgttacacgatgttccacctggtatatcgaaattatttcactaagtagatcgaaaatgtttcactcgtttaaatcgagtgttgtttcaccttatataaaaacaatgtttcagcaaatagcgaaagattgtttcagttcactgcaacatttaatctatatatagtgaaacattataagtacaataggtgaaatatttttcggtggaacaaaaaataaaacgaattcccttaataggggtttccaaaatatgtaggtttttttgttgcaatgaaagatttcagttcactgcaacattagatctatacatagtgaaacattgtgagtacactcggtgaaacattttttgtggatcaaaaaataaaccaaatttctttaatagatggtttccaaaatatgtggttgatttgttgcaggtgggggcagatattatggtggggcctaacgacatcaccgcgcactgag

SEQ ID NO: 26302 - DNA, 10528 bp, Oryza sativa
cccccgcccggtagcccgaagacaagtattctcgatcttataacgcaatataattatgagtggttggacaagaaccagcaggtcatcgacagcttccccggcgccaacacgtggtggaaccagctcaaggacaagcgggaattgaaagcacaagctggtgttcgtgttccacaagcgccaccgtgagctcatgcagagcccctacctgcgcgacataatcctgcgggggcacgagccaggaaccaagagccggctcagctgagagataggtggctcttcaccaactgtggcagtggtggtaatacgatgtggtcctgtggagccacatcccgtggaaacatgcacccagccacgttcgttccacactcgccatggaccccgccaagaaggatgagatcaagcacgtacgttgtttcgggaggggaagaaatagcacttcgacgttggaagcgtggcttcctgctgtacggtccatccggcagaaagtgcagcatgatctcggctgtatcccactccctcggctacgacgtctgtagcatgtttagttctaaaacaaaacattttcacgctgtcatatcgaatatttagacatatgtacagagtattaaatatataaaataaaaaaataattacacagattacgtgtaaattgcgagacgaatcttttaagcataattgcgccatgatttgacaatgtggtgctacggtaaacatttactaataacggattaattaggcttaataaattcgtatcacagtttcctggcggaatctgtaatttattttgttattatactacgtttaatactttaaatgtgtatccgtatatccgatgtgataactaaacccaaaaaattttcccaactaagggggtgttaagatccaagggtgtgtaaagttttgtcgtgccacatcgggtattatataaagtgttgcatagggtgttcgggcacttataaaaaaaaactaattgctgtaggatcacattgtcaaatcatggagcaattaatccgtcattagcaaataaatttattaagcctaattaatccgtcattagcaaatgtttactgtaggaccacattcgcaaattattcgcaaattagtcgcaacctatgcagatagttattttttagcttatatttaatacttcatacaggtgttcaaacaagaaccgggaataaagaggtttttttgtcccagtttattactccaacgggattaagtgatctttagggctggttttccctctgacagggcgtgtcagactcctgtcggggggctggggaactaaccccatccgggactaaagatcatctctttagtcccggagatctttagtcccggttggtgacccaactatatatatcctttcttcctcctccagcccaagtcattgctgcaaaatggagctttgagggagggaggtgctgccaaaatttttaataaatttttttgttgataatatacaaatcggaggaatcgagaaggttagcaacttcattatctaatgatgtgtgtttagcatgttacatttatggctttgtttgtattcaatattttctccaacaaggtatatgggtgggaaatgatgagagagaaaacttgttgagggaaaattaggttaaaataatttggataaatatgttatagaaaagttgactgttatcgaaacgacaaccgcatacgttgaaagacgtggttactaaacagtggatggaaaagaagtaaagtgtattaatttgagaatttttacttgagatccccctattacatggccctacgggggctatttatagcccccattacaggtcttactactagggctttagttatacaggggaatttacatggttgcccttatgaaagggacatttacatgggtacatagcgtaattgcggtccatgggcccttagcgagccgacaggttattgtcgacccaattaacccttgggcttgatgggccaggacagattcttcggccctcccggggccgaacctgctacggcgaagtcgtcccccttcggcatatgctcttcgccttgcgcaattcgcccaggaggcctctagcttggctgctctttgctccatagtttttgacatggggagggttcgcctcgactaaccctgacgtctcgggcttgaatcctcatcggtcgcatgttttcggcaggtttggtcgaagggtctcatgccatatcgccaacattgacaaaggaaaaaatataaacaactattgaaaaacaatgaaggtatgtttggaaatttaaaaataatgaaaaaatggatactttgtggaattattgtataattattatatgattatttgtacaaaataattgaaaactaagttaattggaaaatagtttaaattattgtatgattatttaatgattttaaggatgatgttttaaattattgtatgattatttaatgagtttgtctttcgtggatttttttttaagatttcaggtagatggatcggcaatggatgtacgcggactggcagtcgaaagagtttattaacgacgtgcattactttttgagtgtggccaatgataacaagcgtaacggttttatatgttgtccatgcgataagtgaaaaaaccagaaggagtattccactgcacgaactattcattcccacctgtttcagtgggggttcatgcgtagctacaattgttgaaccttgcacggagagctaggggttgcaatggaagaagatgaagtagaagacgagaacattccggacggggctttgtactagggatttgaagaaaacacaatgggcgaggcagacgtagatgttgaagataatgacggtgcagatgatcttggtcaaatgttgcgggacatacctgaggactgcgaaagtgaaaaggaggtgcaataactagagctcatgttagcggaccacagaacgtcgttgtacccaggttgtgagcagggccacaaaaatttgggtaccacgctgtaattcttgcaatggaaggctaaaaatggtatgagtgacaaggcattttctgagttattggagctcgtaaagaacattcttccggaggggaacgaattgcccgaaacaacgtacgaagctatgaaggccatctgccctctaggactggaagttcagaagatacacatgtccgaacgattgtatcctctatcgcggtgaggtgcacgaaaacctgaaagcatgccctgtttgcaaagcactacgatacaagattagacgagatgatcgaggcgatgttgaaggacagcctttgaagaagagagtttctgctaaggtgatgtggtatttccctataataccatggctgaagcggttttttgggtataaatcacatgctagaatgatgcggtggcacgtagaagaatgtaaacaagacgggatgctgagacaccccgtcgacgggtcgcagtggctaaatatcgacagaacatttaacgacttcggagagaatgcatgaaacgtgaggttcggtttaagtacggaaggaatgaatccgtttggagagatgagcagcggccatagcacttggccggtcactgtgtgcatctactatctcccaccttggctatgcatgaagcggaagtacatcataatgtcgattattattcaaggcctgaaacaacctggtaacgacattgatgtgtaccttagaccattggttgaagatctgaaagtgttgtgcaggaaagagggcgtcctcgtgtgggataaggacaaataggagcaatttaacctacgagcgttgctatttattaccattaatgattggcctgcacttagtaacctatccggacagtcaaacaaggggtacaaggtttgcactcactgtatggatgaaaccgaaaatacgtatctgaagcattgctggaaggttgtgtacatgggccatcgtcgattccttgttgcaaaccaccgtgtacggaagaaaggcaggcacttcgaacagaaggcaaaccaccgtactaagcctaaacatcacaacatgaaagcagtgtttgatatggtgaaagatctgtaagtaatatttggaacggggcctagaagccaacctatatagagcgaagatggtcacgcggtgatgtggaagaagaactctattttttgggagttaccctattgggatgtcttagacgtctgccacgcaatcgacatgatgcacctcactgagaacctttgcgtaaacctgctgggctacttaggtgtatatgggaaatccaaagatacacttgaagcacgtaatgatcttaagcatatggaacaacgcgagagccttcatccggaaccaactgagaaaggaccatagccctcaattgttgcgtggctgcgggctgaagggtcaaacgacccgagaccctcacggtcgtggttgtaggatcacacaggaccaaacaaacctaccagaggggttgaatagtagggaaaaccaaaaacccaaaaatcttatgtggaattaaagattaccctcaaacggagttgataacgaagccctgtcgccgtcggtcgaaccacccactcgccgccggtcagaccgtcgtatcgtagccccgccggtcacaacgctgctatcccaccggtcagaccacacacacacctgcggttagaccgtcgggacccagaaacactggtagatgacaaactcgaagatgtagattgaaactttttgactttattgcatcaactagtgtttacaaagtgcaccaacagcactccttaccaaaatctcgaattaaactcgaaaccctaactttctcgcaactctaatatctgtaaaaccgatactgggaggcctcaccctccctatctttttatacatgaggtaggctgtgcaaagcccacgaatctaacacaacttacgactcctaactcacgtaggaaaccctctcttgcaagtatccaacttatctcttgccttatctcaaacaatcttcccgaattcggactcccttccaaattcgactcctctttccatatgtacacaaatcctcttgtataccatatggatttcttcatcaccacatgcattgtcctctagcctttagtatcccgcatgatctcttaatccctggacatcaacttctcccaatttgactccgatctatcaccggtaacactctcccgaggtctcaagcaacaactgcacatgcaacaaccaagaaaccatattccgagcccaagttagtcccaacttgactcacattagtataacaacaatattcatatgcatagaaaccatttagaagccaaatccccgaaggaaacatccaaatccaacaaaacaacccgaaaccgaacatgatcaggatcctgccggtcagaccgtcgggccggccggtctgaccgccgcaacacctgtggtctgaccggcggcacacgaccggtctgaccgccaaggtcaaccgaaactgcacacttcataaaatcaatcgtcttataaaatctctaaattaacattagcaaaccatcaatattttcttcacaaaatctaaattaactcctttattttatagtggtgtcctcgatgcatatgtgtctcgtccaggcacgcggttgacgcgcaccatcggtggtgccggggctctcaacgcacgccggaaaagacggagccatctcccgaaacgagcgtcgcgccagggcacgtcaattcgcgcgccaatccatctctcgaaccgaccgttgtgccaaggttccccggtgccgcatcacgtgcgccgtgcgttagggccccacctgccgtcgatggtgagggcaaagatagcagccgccgccgtccctcagactaggacaccccactaatccaaaggaaaccctaaaaaatccctcaatgtcgagctggaccacaaatgaattagatgggcctcaccatcacgcggtgactggtggctgtgtgtgagatggtttgggctctgtttaatcagactatgttgtgtttcattatcagctcggaataagtacacttgagatcccttaacttatcaacaaatccgattttcgtccttcaaccgaaaaaccagatacaacgggtccctcaactatcaaaaccggtgcaaagcaggtccctcagcggttttgatagtggttttggccgatgtggcatctacgtgtcctgtttgcgtcctacgtggcggtgacgtggcactggaaggaaaatataaaaattaaaaacaaaaacaaaaatatgaggtccacatatcagttagacaaaaggaaaaaagagtggacccacctgtcagtgggtcctaccatcctctctatccacaaacgattggacgacgggagactgggagagggagcgaccgacgcctcttgtctctccctcccggcatccatcctcgccggccggcgagcgcgcacggagagggaaaaaggcgccggccggcgagtggggcggagacggcagctggcccccgcccactgcgcacttcttcggcggtctgcgacacggagctagggttgcgggagtcggagggtggcggcgccatcatcctgctcgaacaatcggagagacggcaacgacgaacagtgttcatgcaacagtgtgattacctggccggcgacgaactcagtgacgatgcggctgccgccgaggacgagggtattggagacgttgacgccatgctcggcggtggcgtccgtggactggtcatgtccgatgacgcccatctcctcgttacgactcgccgcggactccatggcggcggccgggccgcccttgaccgtcttccccaacacgaggttctccgcgcgccgactgcaagtcgccgcgtcccgcggcgcgatgggcttggccgcgaggcttctggtcaccggaaacacgtcgccataccagatcccttgctggctcatcctactacactctcaaagtagctagtactagtgtggtgagatcgtgtgtgcactgtgctgtgcatgagagagagatcttcaaggtcatatgcggcgcgcctcgctgcatgggtcgaacgggggacacgcagggtggccggcaatggcggggcgccgtgggtggggcactggggctcgacggcgacgggcggtcgcagcccgccgaagaggcgcgcagcaggcgggggccagctgccgtctccgccccactcgccggccggcgcctttttccctctccgtgcgcgctcgccggccggcgaggaaggatgcgggagggagagagaagaggcgtcggtcgctccctctcccagtctcccgtcgtccaatcgtccgtggatagagaggatggtgggacccactaacggtgggttcacttttttctttttgtctgactgacatgtgggccccacattttgtttttattttttagttttatattttccttccagtgccacgtcagcgccacgtaggacgaggaccaagtcaaaccggccacgtaggcgccacattagccaaaaccaccatcaaaaccgctgagggacctgctttgcaccggtttgatagttgagggacccattgtatctggttttccggttgaaggacgaaaatcggattcgttgacaagttaagggaccacaagtgaacttattccttatcagctcagaagtgatataatgcactgatccatcgtcttacaactaatgatgatatagaagcgtgaggtttgagctttaggttttgatttcagttagtggccattagcataaagacagagatacagataaatataaaaaatttccccatgtgaccatgtcaaagcatctagaataatggttgctgactaggaggaagaagcccaaagtttcctgtttggctgtttgccggatgctaggaattgggccatgctttcctagcctggtccaaggcggtggtcaggcacagcccgatttcaggccgtacataggccacgctcgtgcttgggactttggcgtgataggtcgccgcatagcacgttgttagcctaatcctaatagcccgccgagtcatgtaggccagctagagacatcgggcccgtttactttgatgtcattttcaactttaccaagttttggtaaagttataaaaaaaaaaattagctacatttagtttgttgtcaaattttggtaactatataaaaaatcctgctaaaatttagtaaggttttttttcgttagagtgaacagccccatcatatatatccgagttatgaggctcctggcccagattggggtgagtctagtacgcgactgctcgtgtcgagcaaacgcgtggacgctacctatttcttccgtgcgtatctgaacctgctcacaaaactctactccagcccacaacatagtccacgtatatgcaaaattttcatgggcccactagcatatcccagccttttcctttctcatttagactaaaatccaacataaacaattctatttcatacatgtaactttatctgtataaactttacatatactagctttatgcatagtagttttatgtcttgttatatataaactttgcatatgcaaactttcaacatagattttttttcaaaaaagtatgagtgaattttaaacaataaaaaaaataagtccagcgaaaaaatatttaataaaacttctattgtacttaaatgggccaaagtagaataataatctttctacctataactttattaataaataatatactttccacatgataagtttatataagatataaaattctttctctaaataatagaaaaaaaattcaaacataatttttgctgatatgtttgaaaaatgagtacatattttgtgatcacaaaataaataacaaactagaagaaaaaataatttcacaaaagaaacaaaaaattaaaaataagataaagatctcaacttaaactatggcccacaaggcccatgtcgtatatctccagaatctaatcagttggtgatttgaaattaccacgacctggctagggttagtacacatatgtgatccggaaaagcggcattcgcgtgaacttgttccgggaacgttcacgcaatagctttttcgctcagattgtatatcggtctaagtacgagatgctacctctgagttttttatatttctttaaacaattatagaaacatatacatttgttttaaaatttatagaggtttattccgctctctagtacatagtgactacaacgctggaaggtggagggcccggcaggtatgagtttaggggaaccggatcctctgactttgcttgcaaagtcacggacgtgcagtcggggtccaaatcatagtagaaaaaaccggaccggaccggcggttcaacaggaaaaaaccggaaccagctccctgaccggctcggttccctcaaaggatcgttcacgcaatcgacccggtgtgaaccggctgaaccgggtggttttcgcgcgaaaccgctgaaccgggtgaccctaaaccggctggcttgtatatttcttatgagccttgtaagactggaggcccaacttgatttttatgcgagaaaaaatatggtgcaaaggtgggattctaccccaggctgttaggatagatgcaaaccttgccaaccactaggctaagttagctgttttgactagaagacaacacagaatatacttagccaataaaccgtggttcaaccagtgacccaccggttgaaccgatagaccggtgaaccaaacactccaccggatcaatgaccggtccggttttttctactatggtccaaatccaccgtctgttgcatctgacggtcctggcttgcatagcgagtcgcagcacgcatggccgtgcggactaccagtcacgaagcggcctagcggatgaactagctcgatcaacacaacacgtgaactagcagagggaaaataacaaaatcttcacaaattttgcgacataacagaacacaactgttctatcgtatccttgcttgttcgttccaaaagaaattgaagcatacgcgatcaggcaaaaaaaaaaaaagcaatcaattgtaatggagattcaatttctatcaccgatcaaataccgaaagaacttccaagctgcttaaccaagagaccacggtcaattggaagacgaggctggaattgatatgcctcatgccatacatgtacgcgcgcgtgtgtggatgtgtagaaggagaaggtgaaggtgaaggtgaaggtggaggcgacagaaaagggaacgagcacgatacgccagcatcggaggaaagagccgccacggcgccagcggcgctgcccttgccggaggactggaggaatagatcatcgtgcatttgtgctattgggccgaattaggtcgcagcccgcatggtagtgcatggcagaaccgttggatgcaacgaacggtggatttaaacccaactgcacgcttgtgactttgcaagcaaagtcagaggatccggttccgagtttggggctagcatgtcttatctctataaggtcttgtttggtttggagtctggagggaattgaataggatttgagggattgagagagaataattccataccacaataggtgtggaataaatcccttccaacccctccctcatggggattaaacgaacaaggcctaacggaagaga

SEQ ID NO: 26303 - DNA, 3691 bp, Oryza sativa
ttattttttttactaaactttgataaatatataaagaatcctgctaaaacttagcaatattactaatttagtaaggtttattttgactatagtctgtatagtccataagggagtaggtggctctaggtggagagtgatacaaacgccaacggtgaaggaaaggtcaattaatgcttatcgaagcctaattaagcgtcacggcagagcggtcaatgcttatggaatcctggatggcgtgcgtggtaatttttatacatatatgagtatatatacctggagcttcgtagaacttttctcttcggcaagaagtggtgataacctcgtataaaaaataaatgggtcaaacaaatgatttatgtgtatagaaatgggaaggataagattaattacagggtcaaatggattgttacatcaacggctacctttacttaatctattttagtttttcctaatcttcaagatgtggggcctattcactttgatgtcatcgtcttcaaccataccattttttttataaagttaccaatattttggctaagcttagtttgttgtcaaattttagtaaatcaaaatttggttttggcaaccttaccaaaatttggcaatgtcaaaacttgataaggttaaaaatggtagcaaagtgaacaagcccgtgacttccactagtatttttacaaatctcactactacaaaaacaaccattagtgtcggccacaaaggtaccggttagctaaaaaagacacctataagacacttcccgccaatatagtgaaaaactggcacctataacggttaattggtgtcggtttttgttgggagggacattggtggcacaaaaaatcctcccaccaactatcctaaaatacaacaggtggcggccgtgcgaaaaaaccggcacatatatcaatggtgccggttatttaaccaaactgacacctatagtttgcatcatataggccagcgaggagaatagacgccggttcggctaaaaaatcggcacctgtaatattataggtgttggttacaataatataggtgtcggttctgggtgtacaaccggcacctatagtgccatataggtgttggtttttggtgtagaaccggcacccataatattataggtgctgattttaaatttgaatttgaattatatcctattcaaatttgaatttaaaatttaaatattttttatatatagtatttctgtgcatctaaagtttatacacctaaagtttttagacccaaactttataagtcaaaagtttacatacccgattcaaatttgaatttgaattcaaatattagtttatagatctaaagtttataagtcaaaagtttacatacccgtttcaaatttaaatttgaattcaaatattagtttatagaccgaaaatttataagtctaaagcagggccggtcctgactttttagggccccggtgcgaaactaaatatagaggcccttatcatataattagtatatacatatactttatatataaattattgtataaatattaaaattttattaaaaaatatttatatagaaaacattatagtacatgttacctcaaatatttcttcaaacatttgtgccttcgtcggtttgtccaattatcggaacaattaaattaacctaacataggaccatacatcaatacacagcaaaaaccaacacatgagattacatgttaacaaataaaatcacaatgttacaaaaatttcaatttttcacttggcgatggcgatgtattggtgttacactcaccttaatagaatgattgttgattgatcactgatcagacaaatacagtattcagattcactaacccccgtcggcggtcggcccatccttctcgagtcctcgtcaagacatccagtgctctaggggctagggcagccggcggcaagcatcaagccatcaagcaagcaagcagcggctgccgccgtgcccgtgcagcgcctggccggtagccacctacacctgacacaaggcctgactcctgagcacctcgtgtcctcgtcgatcgtcggcagtcggctcgtcctcgactcctcgtgcggattgcggaacgagcggtgcacggtgggcgtgaggagaagagaggagacgacgtggaaggcaggcggcgccaatctcgcgagtcgcgtattcggcgtctgttcgccttcgccctaacgccacatcgtcgcgccgcgcgcgccggaggggggggggtggggttggcgcggggccctgcgatttgggggccagagcgaccgcaccgctcgcctccctaggaccggctctggtcaaaagtttatatacacgttttaaatttaaatttgaattcaaatattttttatatatagtatttttatacataatttttttcaactttttttaaatttttttatagtttactgtagtaggaagagaatgagggaaggaggaagggggagatccgtacgtatagggggtaggggcgtgcgggtgatcgcgtatagggggtaggggcgtgcgggtgatcgctcccgcattagccacaccctatgcgggcgagaccgcgggagttgagacccatcatcacgttcttaaaaaaaaaatcacacacacacatagagagagacccatattttatcacccatcctagctagctagctagctaacgatttgttttggttcagaattgctcgaacttttactagggacgtacccaagtgttgtaatgggattaaagaaaagaaaaatgggccaataattttacaagttcaggatcacttttgaacgcatgattatcaaatcatgggaataggaaaaatataaaaatagaatatcatatttattggattcctaggggatttgaaaacacaggaacactttaaaactaatgtttgatagtcacacagaaaaaatagaattcaagacattgaaagaagaaaacataatgtaagacctcatgctaattctctttcgaaattcctatacaataatcattccgtaggaatttctcgaaattactatgttatagccttttctgtacattcaatgtactctacggatagaggaatacataaagttgaacataataaaataagaaattgaaagattcgttgaaattgttcgtttggaaatttcccgaaaagctaatttcgaagtaatcgatagaaatcaatcatttcttttagaggtcttgtactattatctcccatagatataccttagatttctatggaacataatggttttacggtttcagttatctttggacttattgacttgttgttagagaaatttatcggtaacgttccctgtgtatcaatttttttttaaaaaaataaaacgagtgaaatggggaacaacatttcgcaattgactcttctacactcaacccaacttgcagcctcagttgattaattaacacctcagcctaaccaaacccatttgaatctccttccctaatcgagcagctgcaatgatgacggcatctgaggtttggcaacccgagaacggaagctgctggcacatgttcagaaacgcttggagacaaagatcgctcttccttaaaaattgccaaagaaaacagaaatgaatcataggaaagaaacatcgcgataaaataaacatatggaacggccggccaacaaaggtgagaaaaaatagaagattaattgctgtaattaattaagcaactaggcaaaaagggggatcc

SEQ ID NO: 26304 - DNA, 1209 bp, Oryza sativa
aaaaaattaaaaagacaagtcacgtataaaatattaatcatgttttatcatctaacaacaacgaaaatacgaattataaaaaaatttcatataagacggacagtcaaagttggacacggaaatccagggtttgcctttttttaggacggagggagtatctatctatctatcatacctctatacctatatactaattggacactttctaggagctctcacgttaataaaaaaaatctagccatctattatattatattatattatattatattatattatattatattatattatatactaaaagtccattaaacttcctataaacactctcatgccgccacgtgggactcctacaaatgctcctaggccgccacgtgactctgttaaatctaaccgtcgattttcacttaaattgatggacctgatattttagacttaaatttttccgtgaacctccccttccatcgatccccggtttccctcctttttctgatcctatttttatgctattgtttcacccaaaaaaaagacatgcgagtacatacgtgagtatagcacgatcagataaaccggaaagaacatactcctgtacgtacgtaatacatgatcagagaaacaccggaagaacacatatatatacttacacgtagtaacatatagaaatagatgaaacataatactctataaatttacataaatatcaccatcaattttcatttaaattggtggactcaattgatgttttacaacattaggttagatgtcttaaagcccattaaacttccaaaaatgctcctaattcgccaaacgcttctaagttgtcatctgatgctctaataaattagtgaaattcttaaaattctaaaataacaaaacatattttcattaaatttggtgaacccattatttacaagcattagattaattttcaagaaaaaattcctttcctaaactcgggcctaccaaagagctttgtatgtataagttaatttttttttacaaaaacgaatatacgtatgtacgcctcctcttacttcaattcatttatccacccacctattccttctcctatgttcatgccttattagttagataagcaataatatcgtgttaaacaattaagcttcttaatcatacaactaatttctgatcagcgtaaatctttagattatttataactcaatttacagttgaagaccatatttcact

SEQ ID NO: 26305 - DNA, 1843 bp, Oryza sativa
taaaaactaaaacactacaactcgggaattattacaattatatgcatgcataatctcctctcttcaactctctcttcctctcctcactcatttaattcctttgtctcctaatttttaactaagtaaaaacagatcaataattagaaagccaaatgattataattctaaagttgaatcataattttaacttatttgaatttttattttatttataattaaatagataatttaatatccatgttacccatatttcactctatagacaccgttcctttgcatggtaaccaaatagaaaaaatacaaaccataatacaaaatgaaaatgagtactatattatcgtaaatcattgtacatcctctgaacgcacttaaggcgtcacatgttacgccttaaataaaaataaaactttacaaattggaagaaaaatcatctgaccatcagtttccacttaaataggtagatctattattttcaaccaatagatatacatttaagaatgtcttaagccgcaatatgttatgtcttaaaaattggaataaaaaaaatgtgataaaaaatatatcaacggtttcacttaaatcatttagataaaatagaaaaatccacgcctccacttcgccctcccccagaacatacgcacaacacgacactactcgtcacatcccttctccactctatcccttcctgtttatacagccaaaaataatcaaaatattaaaaaaatgcataaatttcaagctcatctgatttctaatctaaatattattgtatttataattagaataatgatttaaagatccataaagcctatattttgaactgtataaaatataaaataaagcaggtaatagaaaatatcaatagggactaaattaaactattttgagaaaacgtgatacgttcataaaaaaattggttcttacatttcactaaaattggaccaaccattgcatgttccattttcgtaacaattttaaaatgcttagacattaatggccttacatctatcctatattattgcattatgagtttctccacatatttttacatatataaaccgcactaaggttcgcagtatatagttctttgaaaagttatatttgttactactaaatttaaaattttggattcatgttaactaggtatattcttttgaaaaagatagtataggtcacaacgaagcgaggtatatgacatgtctctattaatttatatataagtatgtaacaactcgcatcaacttaaacctactaaaaggagaactacttgatggtacaaataaaacatatttattaaaaatatagttctttagaatttgttaaaaaaagaacaaaacaccttacttctaatttacagttgatttgttagacacgttttccaaacaaactaaatcgaacttccttatatataataaagagattgtagataattatttatatagatgtatcaaatttgatatattttagaacctaacaaatatcttggaaaaattatcaaagcaaaatattgaagaacagcggaggcctcacctgatgtgtcttattcaaataaaaaaataaaaaagtacttttaaacatgggaggtgtcaaccaattgatattctgtttatatatatatatatatatatatatatatatatatatatatatatatatatatatatatatatatatatatatttcaaacgcaatgtacaaatcaaggttggaaatttcagaaatttcgatcatttcggacccctcagatatgatattattttggccgaatttttttaacttttcatgaattttggtaatatttgttcaaattcaactaaactatgttttcaaaatttcagaaatt

SEQ ID NO: 26306 - DNA, 6550 bp, Oryza sativa
aatatatacaggtacaagaatacccaaatatgcagaaaaaccctttacaaataaaggaatataaaatctaaatatacatctaacacaccccctctcaaacttatggtgaatcaacaacactgagtttggagagatagaacgtgtgttgagctctagtttgtgccttggtaaagaaatcagctatctgcaactcggaaggcacatactgaagagcaatcacctgatcatgtacctaggtgcgtgtgtaagaagcatccacaccaatatgcttattaagctcatgcttgataggatcatgagcaatactaattagcacctgtactgtccgacaacaaagaggtcgaggaagtcacagaaacaccaagatcctcaagtaaccaatgtaaccaagtaacatctgctgggctatagctcgtaactcagcctctgcactagaatgagaaactgttgtttgtttcttagtcttccaagcaatgagggaaccaccaagaaaaacacaataagcagaaagagatttgcgattaaaggaatcactagcccatgcagcatcataatacacttgaagttgtaaagatgtggaccgagtaaagaaaagacaacgagagatagtcccacgaagataacgaagaacacgaagaagatgactatagtgaagttgggtgggagcataaacaaactgactcagaatatgcacagcataggaaatatcaggacgagtgacagcaagataaacaagactccctacgaaatggcgatagcgagtgggatcagctaatggcacaccagtagtggcagaaagatgaagattaagttccataggagtgtcaaccgtgcgttggtcagtaagagaagccctatccagaagatcctgaatatacttcgcttaggaaagataaaaacccttaggggtagaggaaacctcaatccctagaaaatagcgaagagaaccaagatcatacatcagaaaattgagcattgagacgtgccttaaccaaagcaataaaatcagcattatcgccagtgataatcatatcatcaacatagagaaaaagaatggtacgaccacgaggcgaagtatggacaaaaagtgcaggatcataagcactggccgagaaaccagctgcactgactacagaaggaaaccgttgaaaccaagcacgaggagcttgcttgagcccataaagagagcggcgaagacgacaaaccatacccttaggaaccgaatatcctaggggtggtcgcatgtaaacctcctcatgcaattcctcattgagaaaagcatttttaatatcaagctaggagatattccaatgacgagcagaggctactgcaagaagagttcgaacaatggtcatgtgagccacaggagcaaaagtctcatgatgaccatgctcttgttgaaaaccacgcgctacaagatgaactttatagcgttcaagagttccatcagagcgagtcttgaccttatagatccatttacaagtgataggacgaacatgagatggcaatggtacaagatcccaagtaccagtacgctcaagtgcagcaagctcttctgccatcacatgttgccattcttgatgaatatcaacatcttgatgagaactaggttcagcgagaatagtagcaacataagcatagcgaccatagcgatcctctggacaaatcgtaactaaattacgatcccgaagattgtatctcggaggagcaataggagaagcatcaacataaggctccataacacgagggcgacgactatagacttgagtaagaggaggcacataggaagatgcaagagtctcattagaagggtccactggaagaggctccactggagaggaagatactgaaagagggatgctagtacaaataggggcatcaggacaagtgaggaatgagagagaggtctcatgagaagatgtggaactaggacgcgaaaagaaaggacaagactcatcaaacgtaacatcccgagaaatcaacatccgacgccctacaggatcccaataatgataacccgtatgttccgcactttagccaagaaacacacactcaacagactgagcagtcaatttcgtatgctcacggggtgcaagaagcacatagcaagaactccgaaacatacgcaaattagagtagtcaggaggttgaccacaaagatgctcaagaggaagcctaccctaaagagcagaagaaggttggatgttgtcaagtatgtagctgtggaaacagcctcagcccaaaaatgaggaggaacagaagaagcaatcataagagctcgagcagtctcaaggagatgacgatgcttacgttccaccacaccatactgtgcatgagcaccagggcaagagagctgtggaagtgtaccctactcagaaagaaaactacgcagctcacgagaaaggtgctcaccagccgaatcagcacgaaacgttaggatgggtgtatcaaaatgagtatgaaccatgcgagcaaatgatttgtaaatagccaaaacctcggtgcgatgagacatgaaataaatccaagtatgatgagaaaaatcatctataaaaatgatatagtagcgattaccccctttcgaaacaaaaggggcaggtccccaaacatcagaatgaacaagatcaaaaggacgcttagatacagactcactagtaggatagggaagttggatctgttttccatgtttacaaccttgacattgatttaaggacacatcacccgacacagaccctaagagacctcgacgaactaaagacaatagacgagagccacaaagatggcccaaactatgatgacactgagtgaaggtccctgtagaggaggcagcagaagcaagaagactggaaagcgcagcggaaggaagacgaagccagtcaagctcccaaagacgctgagaatcatggtggcgagggccagtaccaactaggagacccgtgtgtcgatcctgaacacaacaagagtcagaatcaaaaataacacgacaaccatgatcagcaagctgtccagcagacatgagctgtatggtcaaatttggaacataggaaacagaacgaccactaaaagaagaaaatgaaagagttccacgaccaacaacagaaagaggggtaccatcggcaatttgaacagtaataaggactaaaggatgatatatagatgaaagacaagacttatcaggggtcatatggaaagaaacacaagaatcaagaatccacggaaaagtaccagaagcagatgaggatccctcattggaagtctgagaaccaggaacaatagaaccagtttgtgtagagggcaaagcaactgaaccagctgaacgtgtcgaagcagaagcagtgaggcgacgcaataatataaggatctcctgtgtattagaattgctagtactcttcttcttagaagagaaccacaagtatgcaatggccagcaatcttagaagccaattcctcggtaattttattttttttaaaaaaacttaatgtagataacatatctcaggttttgctcttactataattttcaactacgatgtcatcatcttccatgaatattacgttactgataaaattattatattgactatgtatatattaaggtctgagtacgtgttgatagtatgaataacagtaacccatgttaatagtatgaataacagtaacccatgcaacacatgttgatagtatgaataacaataaccgacgcatggagtgatgaggccgtagacatggattgcaatttcggatgaaaaatttcggttttgctagtggggtccggcaaaagtcaatgccggtcaaaaatttggacaaaaaatttttaaaaaaatttgctaataaggccctcactacccccacaaccctaaccctaacccattttttccccgacagcgccgctgagagacgaaaaccttaacctccggcgccaaatcctcctacgtgacgctgccacctccacacctcaatcacggtggcgctcgtcctacaggtggccgcggtggctcagctgctccctcgtagagtccacgtcatcagcgcattagccatccctgcccctcgggctcctggcggcggtgctcctcctgtagagggtggcattcagttgctcctggatccggtaacttggcgagagggttgtcgacgacgaggaggcagcggtatgtatcttggaatttcttgcctctccatccccattcttactgattcggtgtctcaactctcaattttcgacttcgccactgtctgattagttactctgctcttgtcctgttcttgaagtagtgtgcactgtgggcatgggagaagaaggtcctgcatatgctggcagtaggagatgcaggggtcatggttgccctggtccatcagccgccgccgcagctattagtgttggaatataaagtgaattgcctacctttcctcatcagcttaagcttttgggttaaactagtcagtgcatgcaacccacttctattccacgctagaggcttgagggggcctcgcgtgagggggagtgttggaatataaagtgaattgcccgcattttcctcatcagcttaagcttttgggttgaactggtcagtgcatgcaactcaataattggagctgatttcagcaggggaatgggaaggggagcagcagcagttgttggaagacgagcggaagatggaaggggaaggggatcagcagcagcagctgttggaagtggaacggagggcggcaatcctgagactggtattgggcgagggagaaacatagccccaccaggaggtaaatactttagtcattggacaattaatgagtatttggcaattattgattgatcgaatgttcaattatccttctgttgattgcaaaatgatttgtccccgaattttcggaattttcggctatatttcggatttttcggacaaaattttcaaatttaattcaaaaaatttcggatgaaaatttttgaaatttctgaaattttgtcgattgcagttatttcgcctcccctggcaaaatacacactttcgaaactgcaaaccctggccgtagatgcattgtcagcgcccacgtacatatccaccatcttcaccaatattcatcatgcatgcaaaacgtgaagcgaatatgaagagacaaccacaagcagcttaatcggaggtgttctgttgacctaggcctgcggaggtaattaactgggagactttcgagacctcagaaaccagaggaccacttcttcaagttcagatctatccaacgacaagctatagagtgcacatacatacatacatacatacatattaccttgggaatttgtatttatgaaccttgagattaatgaagcacatgttccctatgttttttgtttattttatgtacttagttatactggcaccccacacatatcgttgttatttttctgtgctaaacatttgtatattgtgtcattttagggtatgacttatgcaagcgtaagtgactaaacaaacacgaaaatcaggtaaaatagcaacacacaaaaaggagcctagctgaccattttccaccacacacaaaagcccagtcaccatgacatatatatccgaccggggcccttgtctagctttcttctgcgttaggttgttcctctttggcctcttccataggagatgttgcggaattcatcttggccctcttcatgatcagtgtttccactaaactttccaagcgttcatcagcatgtctcttccggttgtagcgcagcatgatgctatcacgatcgactggttcctcgtcgatctcgtcgagcagtggaccgatttcaccgttcctcggcatgagtttatcggccacgtctgccggagtggtgttggtctcgctcagcagtccctcaatttcactgaatagtgagtgctcggtgatgtttaggtagttcttggcgagcatcttgaaggcctcgaaccggcagtaggacatctcgatgtccatatccatccttccacgccgggtcagcgccgggtcgaggtggtcaacgtggttcgttgtaaacacgaagattcgttcactgccgcacgccgaccacagcccgtcgatgaagttgagcagccctgacagtgtcactttacttttgtcgtgattcttgtcggacagccctatcaccacatgtttgtcgtcgccgttggctgccttcttgcccttgcggttggttgtgagctcgacctcaatcgcatcgatgtcctcgataacgatgatggatttgtcggtcgtatcaaggaagagcttccgcaagtcggcattgtttaggacggatattaagtcgaggtcgtagacgtcgtagtcgaggaagttggccatagccccgatcatggtggtcttgcccgtgcccggtggcccgtgtagaaggtatccccgcttccacgccttgccgaccttggagtggtactccttccccttctggaatgctctgagatcgtccatgatctcaaccttcttggcaggttccatggcgagcaagtcgaatgtcgacgggggattgtacgggacattgctccacatgctcttaccgtatttgacgtggttggtgaacaatagct

SEQ ID NO: 26307 - DNA, 21419 bp, Oryza sativa
  unsure (1)..(21419): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggccaaaataagtgaaactatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctcccaccatgtgcgtggacggccgccgcttctccctggtgggtgagagatccgccgtcgttcacaagggcgcggcgcactggctgtttattgatcgtgtatctagcgcaacccaagatgacatactgtacaaactcaccgcggcggtggacacctcagaaatctccttgacaaggctcccctttgtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtagcacggcattgtcattttgatatggtttgacctttactggtttccactgtaacatcccttcactggaaaaacaaattctcttgatcttacagttcacaactacgcaggtggcatttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctaagcttaatataatgctataacaccttgtgtacctctgattatttcccaatgcaatcatcaactctacatgtggacctcacgtcctcacccaacatttagctcaagtactttactgttcatttcttaaccacctgagacagaagatattcatctctgattgcatgcatctttgacacagcatctgctaacaacattcgatctttggcttgttgctttgagcaggatatgccaagtctaaggacagaaaccaagcagtcttgaacaatacttcgtgttatgcttgcatctgttatatctttattttttgcttcttcatgtagccagattgttcgatcagctatatctaggactcggccaggaaatgctgctgatgcaaatttgtgcagatccaccgaatccttgaacatgtcatcagtagggctccttccggtaaatatctcaagcaataatatgcctaagctgtaaatatcacctagtctggagactgcagaaccttctccgtactctgcaatattttcaatttcagttaatatttaagtatacctctaaatgacataaatttccaattcggaatggcccaagttgatcccccacccattagggtggagggagactaggaagtgggaataaaggcagaatgcaatatttggaactacctggtggaatataaccaatggaacctctgattccaactatgctgtctgaatgttgcagtgctttaactatactttcagggaggattcttgatatgccgaaatctccaaccttagcgctcatgtcttctgcaagaagaatattacttggtttcaggtcgcaatggatgatcggtggctgacaatggttgtgaagataatccagtgcatccaagatatcaactgcaatgccgagtctctgcgaaaggctcagtgtgttgctagaagtgggattgcctgacacgggatgaagccaaccatctaagcttccattgggcatgtactcaaaaactaatgccttgaactcgtgaccctgtggattgatacttgagcaacaggtgatgatctttataagacaacgatgtcgtactcttctcaaagcctcacattcaacctcaaaactcttggcagatcctgattgtcgaaggttgaacacttttacagccacaattgcaccttcatcttctaaagtacatctatagacggaaccataacttcctttgccaagcaaattagcttctgaaaattcattacttcctctggctaatgcataatatgaaactctatgatagtgttcatcagtacctgggattgttgctcgactattttgtctccgtttaagcttcctgcagaactgaattagaacagtagctgaaactaacagcaagattgatcctgttattggcagggcgattttaagagacttatgccaccgtttgttgtttttgcttgcatcaataatgggacatggagccaagtgaagctgaggtattccaccacacaagttgtcgttccctgcaaccgatgcgtacgtaaggttcttgaaaactccctcatctggtacttctccttgcaaattattgaatgacacatctaatttccacaacattgtcaaattttgcagagttgctgggatgggtcctgaaaaattgttctgtgctagaaatagttgttgcagattgccaatcctaccaatggtatcggggatcctaccagataacttattcatggttaggttcaggatgttgagccctttcaggttggtcaaagattgaggtatgccgccttcaaatgagtttttatctagcagtagcgattccagcacctgacaatttcctatactgtcaggtatttgaccagacaactggtttcccgacagtatcaactggtttaggttagccaaggtagcaacttctattggaaggggtccagagagagaattgtatgacaagtccaagtaccaagagagtgaaggaagctccaagatttcctttgggattgacccattaagacggttggtcgataagtccagaacaaataacgtttttagcttcccaaggcttgcagggattggcccttccaaattggtgtagtatgcgtagagcctattcaaatttgtaagatttccaattgatgatggtatgaggcctgacaagctggtgttgtacagggcaacttcaaccaaatttgatagcttcccgatgctcgctggaatcactccagataaggaagtgaaccccagatccagcgtgtccaagccaatcaaattgccaatgtcctcaggtatgctcccagagatgctattattatctaagtagagcttatggagtgtggtcgacaagttgacaacagagtttggaagttgcccgctgaaagagttgtctgagataacaagctgttgcagctgactgcagttggttagtgaagtgataaattcccaacccttcctgttatttgcctcaagtcggttgccatacaagtataatcgccgaagagatttcaaccttcccacagtaggaggcacaaatccactgaatctattaccataaaggagcacaattgtgagtgatgaaagattgaagagagaagaaggtattactccactgaattggttatccgccaatccaaagtattgtatgccagggaacttgtcaccgatgttggcaggaatgcttccttgtagcatgttgtcatttgctgcaagcaccgtcagtgttgacaggttccacagagaggacggaaatatgccggagagactgttctgctgaaaactaaattcacgtagagctgcagctttgccgaggtccagcgggatcaggccctccaggttgttgttgtccatgtacagatactgaagcaatgacaggttcgctagcgatgccggaattggcccagtgaagctgttgttttgcagctgcagcttctggagttgtgtcaatgtgttgcccagctccaccgggatgcggccgccaagctggttaaaggcgaggcccagattcttcatgctgatgcaggaactcagattggcagggagctcaccggaaaacgagttgcctccaatgtccaggatctctagacgccggaggcggccaaggctcgggggaatttctccatacagctcgtttgagctcaagtttaggctctgcaagaagctgaggttcccgatgaccggagggagcccgccggcgagattgccggagggcagcgtcagcgccgccacccgcgccggcgtccgacggtcgcacgtgacgccctcccagctgcagaaactggtgctgctgttccaggaggcgagcgcacttgagctgctccccctgaacgctgccttgaaggcaagcaacgtggcctcatcgctgctgctgctgctgccaccaccagcgacggctgcaacgatcggcgtcaggatgaggacgagggataattcaagcctcaggctcatcatgatcgtcatgggacgtattgtgtttcttgattggtttgtgagagtggtagtgctatatcttagtaccaatggctgtccgtattatatggagagtatagatggtctttgaagcaaatttggagatgatgacagtttgttgattgcattcttttaattccttttttccatttctggaacacttcgtttgactttataatatagtactccctttgtttgtttgttctaaataccttccgttcaggatatgtatctggacaaccatatctagatgcatatcttacatccattatttatggacggaatagtacttgtcctgatacatcattcatactactaatattgctttggtcacttgtttttttttccctaaaaaattacaaatatttttaaaaaaatcatcattaccagtttaccacgagctgcttttgctcatcttagcattaacatttagttaataaaactactactgtcaaagctaaaacagtgctaaatcaagctaaaacagtgctaaatcaacaagaccgttctaaatcaacaaaggtcttggaccgaagtggcgaaagcaatggcgaaggagaccatgctttggaagtcggcttattaagggatccccgctgtttcgtctttacgaggtcgtggtagccaaatttagcacgagatattcctctagtttttcataatgtcctttatcggtccctgcttgttttccttttatccttataaataacttttatttctcttaatgaaaaaaatacgccccttgcgtattaaaaaaaatccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtaggcgtacgccgaaggaaagctcaaactctaaaaattcgcccaccgacgcgcgccggaaaccgccttaactcctcccgttcccgctcacatttttcggcatcccaccaacccgtcgaccccggcatccaacgtcgtacatccctccacgtcatcgatccgcgccgcgtgctttccaccaatcaggttgcacatcccctcctctacaaaatcatctccccccgtctcctcctttccccacgccgcaatctcgcaaatcccaccgcttccctttcctctcctctccccgagaagaagagggcggcatccatggcgcccaaggcggagaagaagccggcggcgaagaagcccgcggaggaggagcccgcggcggagaaggccgagaaggccccggcggggaagaagcccaaggcggagaagcgcctccccgccggcaagggcgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgatatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggccgttaccaagttcacttcctcctaggctgtacgcctgcatctagtcctagtagtaatagtagtttttatatgtttatgtggtatattgtttaagtgatatccaagattggaaatggatgttaaattgttggtttggtagtcattggctgtaagaagaatggctttgggttgcttttgggaaacacttgcttcacggatcgggcataagtaaccatgcttttataacatgcgaatgtgtgctttctcttgtgccatcattgataagaatttaccttgtgccagtgttggtgatgccttcgtttaatgttgtggaattacatggttgctagtattttgtctcgtaaatttcttttcatgtcattggaatttgatttctgcagcatgtacattggtgttaggtactgctcttttgcgtgtgcctcttttgcgtgtgcctcatgtattgtttagagattttagaagcacacactttgggacaataccaaattgtttttagcctgacaagaaatttagtttcgtgctgtctgcatttgaaacaaaaagtttgtacacattgtttggtgcactagtacatgatataatctgtcctccattgctgttttattctgagattagaacttcgacaagtaagtttttcttcagcttttgtcaggtactgattttcaaagaaatatagcgacaaggaaatggtaactgaaacatcacattacaattattgatttttaagattatgttgtgcccgcatgttttctcattccgttctgaatttctgagtgctgctagcttatgagctaactgttaggtatgcatcttataccaaagttttcagtcaggctattgctctattcaagatatgcattgccttaaggcatatgtgttaagattagaccaaactcttgttgattctacttattgtaataatgtgtcttgtcctttgattcactctccagttaggtgattctccctccagcgaagttggaggtgaataagttacatccaaggttctacgtggaatattgtcctgaatttcggttgggcttgttccataatacattcgctgtcaaataactctaatttttatgacagcataaggattaatatggatgtatcataatttttactcatggaataatttcagttgctattatgaatttgcagtggttggaataacatgcccatattttgagagcaaatcccttggttctatctggttattggtttgagcacttgttcttttcttttcagacaacatgaattattattgatttggtattcagtgttagatctatttagatgcaacctatgttgatgctatgtttatgtgggtgggaatcgtggaactttgttttcttatggttgcaagggtatccctatcaggtaggactgtaggagtagttggttatattttttttattatggatcatggatgcgtagaagtttctgttggaagttgctaccatggtttcgtgtgtaagaagccatatggtcagctcttcagtattatttgatcagcatgattacattgacattctgtatacgtctttgcaatgacatgcatctgagctttatttgataaatataaatcatgcagccttgtattccaacgattatttctagtacaattaattgacactacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgggaataaatacaaaaataaaacttttaactacctggtgcaatatagccaatggagcctctgattccaattgagctttttgaattttgaagagttttagttgtgctgtttgggaggatttttgatatacctaaatctccaacttttgcactcttgtcttctgcaagaagaatattacttggtttcaggtcacaatggacgattggtggctgacagtggttgtgaagataatccagtgcatccaagatatcaacagcaatgctgagtctctgcggaaggctgagtgtattgctagtgagattgcttgacttgggatgatttcagccatccaagctaccattgggcatgaactcaaacaccagtgccttgaactcttgaccctgttggtcaatactcgaacaacaagtgatgatctttatgagacaacgatggcgtactcttctcaaagcctcacattcagcctcaaagctccttgaagatcctgacatttgaaggttgaacattttcacagccgtggttacacttgcaccctcatcttctaaagcacatctattaacagaaccataatcttcctttgccaagcaggttagcctctgagaattcattacttcctcttgataatgcatggtacgaagctctgatattgttcatcaataattagggatgtcgctcggctattttgtcttcatttgagcttccggtggagtaaacaatagaagcacaacaactgaaactaataccaagactgctcccgttgttgttagagccagtgtaagagacttaggccaccgattctttttctttcttacatcaaggattgggcatggagccaagtgaagctgaggcattccgctgcacaacttgtcatccccagcaattgatgcataagtcaagttcctgaaaacaccccattgagcatgtttccgatgttagaaggaatggtgccattgaacatgtttatatccaccgtgagcatgatcagtgatgacagattatacagcgacaccgggagtttgccggagaggtagtttctgttgaagagaagataccttaaacctgcgatgctgccgatgcctggcgggatcatcccctccaggtggttgccgttgatggcaatgcctgaagcggcgacaggttggctagcgacgcaagaattgaccctatgaaggtgttgttcgccagcgcgagcgtgggagccgtgtcagcgtgttgccaagctcaccgggaatgcggtcgccgagctggttgtattggaggtacacggttgtcaatctgacgcaggtggtgaggttggtggggaactcgccggagaaggcgttgtggtccatgtcgagcacccggagtcgccggagccggctgacgctctgggggatctcgctgtggagatcgttggagctcaggttgagccgccggaggaaggtgaggtttccgatggctggtgagagcgtgccggcgagatcgctggacggcaggtccagcgccaccacggacgtcggcctccgccggtgactgcacgtgacgccctcccagctgcagaagctgttggcgctgctgttccatgaccatgaagcggcgctgccaacctgccggagctagccaccagcgcagccgccgctgcgtgtgatagagatcctaacctgcagaggtcatcaggctacggaggaccagagcggggggctggagatccaccccactgtgtgcaccgccatctcctcctattcttcattggtgatttctgcaggaccagcaccacaaccatcgtgtaatcaaatagcgcatccacccaaaccaaataaatcaaggtacaagcctgctctgattccagtgcatttgattaacactaacgtttctgtttgcaatgctgaaccaagcaacatctatgttagttgatcctatgtctgtgtgggagcctgagaactttggtgcctcatagctgcatcggtatctatatcagatagatggaaattttgctagtaaatatggttcatggttgcataggaatgtgttgaaatctgctagtaccatatatggtttcatgtgtttttctgaagtaaaaactacagcagttcaatattatttaacaaaccgattacattctctgtgtacatatcgagaaatttgatcaaattcctcgtatgtattttacaacggctaactgggtccttgttatggctttcaatagaagccgggtcttttgaccttctctaaaaaaaaaaatctgggaccttgtttacctccgattattccaggcaaaatgattgacactacatatgtatattatctagcatttagctctagtgctctattgctcgttgcccaaccacccgggacttgaaatattcatctctgatcgcatggatctttgacacggcatctgctaacaccattcgctctctgggttgttgctttgagcaggatatgccgagcccaaagagagacaccaaactctgttgaataattcctcttgtcatgcttgcatctgtagcatctgtataatttgtttcatgcagccagattgtttgatcagctatttccagggctctgtcaggaaaagcagcggtagcaaattcgtgcagattaagcgaatccttgaacatgtcatcagtagggcttgttcccgtaaacatctcaagcaatattatgcctaagctgtaaatgtcacctagtttggaggcagcagaaccttcaccgtactctgcaatatttgcaacacacacagttaaactttaagtgtaccttcaagacaaaaaaaaatacgaatacccctaattctacttctatctattagaagaggagggaaatgaaggaaataaggacagaattacaattttttttagctacctggagcaatatagccaatagaacctctgattccaattgagctttttgaatttagatgaattttagttatgcttttggggaggatttttgatatgccaaaatctccaaccttagcattcatgtcttctgcaaggagaatattgcttggcttcatatcacaatggatgattgatggctgacagtggttatggagataatccattgcttcaaagatatcaataacaatgttgagtctctgtgaaaagctgagtgtgttgctaggactgcatttgctcgatttgggatgaatccaaccatccaagctaccattaggcatgaactccaaaaccagtgccttgaactcctgaccctgtggatcaatactcgagcaacaagtgatgatctttatgaggcagcggtggcgtactcttctcaaagcctcacattcagcctcaaagctctttgaagatcctaattgttgaaggtcgaacacttttacggccactagtgcatcctcattgtctaaagtacatctataaacagaaccatatcttcctttgccgagcaggttggcttctgaaaaatcattacttcctcttgacaatgcataatatgaaaccctttgatactgttcctcaataaccagtgatgttgcttgtctgttttgtcttcgtttgagcttcctgttgtgtaacagaataagaacaataactgaaaccaacaccaacattgcacctgttgttggcagggctattgcaagagactttagatgctggttcttgttcttgcttacatcaagaatgggacatggaggcaagtgaagctggggtattccaccgcacaagttatcattccccacaaccgatgaaaaggtcaggtttctgaaaacacctttaactggtacttccccttgcaaattgttgaacgacacatctaattgcttcaatagtgtaaaattttgtagggctgctggtattggtcctgaaaaattgttatgtgctagacacaggtattgcagattgccaatgttactaatggcattggggatcctaccagataacttgttcacggttaggtttagtacgttgagccctttcagattggtcaaagattgaggcatgtctcctccgaatgagttattatctagcaagaggaattccaacacttcacaatttcctatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaatggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgc

SEQ ID NO: 26308 - DNA, 1895 bp, Oryza sativa
tatatatatatatatatatatatatatatatatatatatatatatatatatatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggtccctcgtgagcttcgaaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagattttttgttgaaatgcagttgaatttagattgttttaggtatataacatgcccgttcgaatatctttaattgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcgtgagaagaaatgtgaagcgtcgttccattcatgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagatgggttttgaggggctgctgcatatgcccctcataacaaaccatcgtgacttcagctactggcttttgtcacgggtatccccaacacgttcggctatcgaactagaaagtggtgaggttttgccactgtctcctgaggatgttaagaaggtgcttgggattccttgcgtaggggaggagctgcaagcacccaatgttgagtttgtttctcatgtcaagaggttaattgctgaaagaatgaaagttgctagttttaaggacgttaacaaggaggtattggaggatgtattagataaacaccatagagggcaaatgtcaaaggctgagaaagaaagtttcaaaacagcattcctaatgcttgttatgatgaaatttcttgcgccacaatcaaatatggacaataaatgtccaagatatttttctgcactacttgaccccaatgaaatagcaaagttcaattggtctgggtatgtgttgaacgagatattggacgcagcggcaactgttcaaaagaagcacgctgat

SEQ ID NO: 26309 - DNA, 1683 bp, Oryza sativa
gttataattatataatgatagtgagtacactaataaaatttttcatgcaaaggtccattatttggataacgtggactttggaggtgatctaaacttggagcataatatatttcctcgaattgcattatatgatcgtgatacaataaaggaaagatatcagctggacatcagcgaaaggaactattaccaggcaacacagtttggaaaattaaaggtactttacaaaaaaataattcatagtttatattgttctaacccttcacatgtctgatatacttgcactttatatcgatccagctacggcccaaaaatgaagtctgctacaaaagaacgtgcgaaagaacatctgtcactgacagcgggggaaatgaaaatgttcagattgagtctcaggtaagttattaaaaaaatttctaccaaacatgtttatttagtaaatatctagagatataaacttttaatatcaacatgcaacacagcatgctgctgaattaatacagaaggcccaagaattgaaaagtttttggatttcctgcattggcaaccttgataaggcaacagagagtctagttaaggtgacagaagcttcgaagaacatgcccagcgtgaccataccaatcagcgatgaagttgatgtttctaaaggttatacatgcacaactgtcaacgatgatgctgagaatggaatagaggtcaaccaaacaccatctttaggaaatgatgtagaagatgtgagtgcagctgctgccaattgtacaccgatggttcatactcacaacttgaaagaagaatcaatcgacttgaatcgcactgttccacacaggacttatactggtctggacttcgatcctccatcatttgatctaaatattgactactcaccatcaaataacacaggttattttcctacacgtatatgtttgctgcctgattttcatgtttcacatagtaagtacccttattgttcctttttttttccatggctggttgtgcatgctgacagtgaggcgagagaatcatggagtaagttgtcattcaaagttcaggtagacaaagatgaagaagattacaaatgtgtttgcaagttgtttgagcacatgggcatactgtgttgccacgttatcaaggtacgccagctttattttggtccttgtacttacatttttttacctctagagcatgcctctttcttcttaaattgttttacccatctaccataaatttgggtaagcgtatatgttgataagttaattcttgattcgattcatattctgtcagctttaatccagtgtatacatctgtagaaaaccatagttaccctaaaaaaaattagttttgatgtataagcagtttagtttatcatttccgtttttcattgttcatgtaggtaatgacacacataggctgcagaagcatcccagataagtacattctaagaagatggagtattagtgccagagaaggatctggcagcaaccttgagagcttcaggaatgacaaagatgctgcctcttccaggacacaccgccacacactgctctaccatgcatgtatagacttgtccaaacaaggtgacatatcggttgatgctttccaccttgctatgaaacatataactgacgcactggatgagattaaactagtggccggtaccaacgaatctcccatggggtacactgatcc

SEQ ID NO: 26310 - DNA, 2157 bp, Oryza sativa
agtattctgaaatttatacttatattgccagtagctatggacaagatgaacactggtgcctggagcgataagatcgatcagtcgctgcagaagtatgatcacccacgctgccgttggcacatattatttggtacgaagtcagaactacacaacttatatcatgcacgcacagcaagtgattttgaagatacttggacggccctagtcaatgagtatggtcttcaagaggagaatgcatatctccaaaaggcgcagatgttaatagacgatgaaacgaagcccaatgattcacaggtaatttattttaatatatttttggttcacgttcagctccagttctggatttgtcactcctgctcttaacattttccacttgtttttttttcgtaggagatagatacagaccgtaaagatgtcaagagggaggtggaggctcctaagttgatcatttctcgtcatagtgatgataaattctcatcctagtgatgagaaatgtgactcgcccaccgtctgaatagcaaacatgaggcaacatgcaagtaccagccgaaaatcaactctctgatggtgtgatatggttgccagccatcggtcaaataagcagccattcggtgtttttacatttatgaatcacaatcgtactgtaataataaactagttacatctatatttatagatcgtttttactttaattagcatatgtttcatttatattatgctaaactcctatgatatgtggatgagccaattcaccgatattttgtttcctttcagacttcacttaagagatctactctttcaattcagcatattaaacttctaaaagcgcatctaaaacactgtggaaagaaattgaatttaatctaaatcggcacatatggaaaaacatggtggaaataataatacacagtacacacatttaaattttagatatacttaaaatccatggtacaaaaatatacttggatttatttatattaaattttaattttagatatacttaaaatccatggtacaaaaatatacttggatttatttatattaaattttacatccggacgtaacgacttaaaatatacttgcttccaaatttaattaggaaataatgtactgtcagcctaggtaggcgagttttaaattctaataatctacagtacacagatttgaaatatagatatacttagaaaccatggtatttctatttacaacaatataagatgacaatcaattaacatataccgtgtacacaaattgtaaatttatatacgcttggattcataatataattaaattaacgtaatttaaaactttgtatacttaacaagttagctaagtatatagaaaaaataacccgtgtatacatagccattacattacataaatgagtaaacattttctgaatctggaaattgcaaaacgcactaatttagctaggtgtacataagcataccatatacttagcctccatatatacttatattccaattacatcgtccatggtgtacttagggtacctcggtttccttatataattattttcaaaataacagcaggataacatttccatatatactacatcgtagaagtatacttagattttcatataccctaataaaccgcattatatttgttgccaaataaaccgcaaatccatgattatggtgacaaatatttagaaaccaaataacggccgtgaactgttgatggaaaggtattaaatacgctaaattaatactcctaaatattttgcatgcatgcacacgctgtcaattaccaaacctaggtattaaagacgttactaaatattttgcatgcatgcacacgctgtcaatttccaaatcaaatgtacttaacgggtgaacccgttaatcaaatatacatgtaccgatcaactagatgagaatgtgatccaacggcagatgtcagtggtgcccgggcaccatggagtcctatctgggcgtcctatatatatatatatatatatatattccatcaaatgcaagtggtcagtcaagtgccagcatatgccgtcccgtgagaatcattgccgacagacaagatgtagcgtgcattgcagtgattgtggcgacaaagaaaggggttcacggggacgatgagtaagacatggtggcaaaataaggtccggaatgcaggaat

SEQ ID NO: 26311 - DNA, 11296 bp, Oryza sativa
ttgccaatggtgaagattttttaaaaaatagagtaaactaaattcaaatttgagggtaaaataaaaaatagtttacaaattgaaaaaaggaagacaatattgggccttaagtatcctacatattctttcaattattctcaatttctagttttctacacatattcaaccgtattttttattttttccctatttatttttcatttacatgatttcaactatacagaccgcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctccaattattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttgtgactgcttaacttgacagtggccactgcactggaaccgaatccgtctaggggtcggtcaagaacacaagctacaacaaacttgtgcagatccattgaatccctgaaaatgtcattcgggtgaacatctcaagcaataatatacctaagctgtaagtatcacccaccttcgtgactacagaaccttccccgtactctgcaacatttgtagccaaaattagtatttaaccctaccctcaacatgtaaaaaatgaagcaccctcagtctgataggaaggggagagattaagggaataattgcccggacacctctcggtttgaccgccgcccattgtctggtctgaccggccactcagtgctgcactgttcactgacagaaaatattaattactatattttcaataaacactcgcatttaataattgctcatcacaaaaattgaccatcacatgattctagaggtgtgactccatctaatttgggaaaaaaagaaatagaggttcatgcgactggttcaattgctttatgctgtgataatgctattgacaaacaacaggtgttataccattttagcgattcaccgtggaaggccggacggttgatgaggtcatacgctaagacattaacatgtttgtatagactttagagcaaaaagaaatagtagtagctcgattagcccagaaacaagtaaacaggccactctcgtgggcctcgaatcgggaatagcccagtttccaagcctgcgacttttactgggccatgagctaaactctacgaaagaaagcccaactgcccaaccatgaaaactcgtaatccccgcgcgcgcgacggaaaccgcctactcctcccgttcccgcgtacactttccgcgccgaaacgcatctcagccgtccataggaaaacaacaccaatcgtgcgccacatgctcctccacgtcatcgatccgcggcgcaccccctccgccaatcagcgcccacctctcccctcctttaataccatcgccgccgcctccccttcaactccacaactcgcaaccgaattcccccaaattttcgtctcccctttcccttccccgagaagaagagagcggcatccatggcgcccaaggcggagaagaagccggcggcgaagaagcccgcggaggaggagcccgcggcggagaaggccgagaaggccctggcggggaagaagcccaaggcggagaagcgtctccccgccggcaaggccgagaagagcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgccggggagtccgccaagctcgcgcgctacaacaagaagcccaccatcacctcacgggagatccagacctccgtccgcctcgtcctccccggcgagctcgccaagcacgccgtctccgagggcaccaaggctgtgaccaagttcacctccgcttagattccatctattggtagtatttagttctgtctactatctggtagtggtagaaatggatgtcttattagtgtgtagttggcggttgtggcgctgcttttggtaaactgttgcttatttatctgagatattaacgatgctcttctagacttctatgtgcttcctgttttgtgattgctcgatttcttgtttgtggtgttcattctgtttgagattactacgatactgtgaaattttctggaacaaaattgatgttctggtatgcatacgtagcaactgaggacatggcaactcacttcaggaataatgctgctcctggcttgtttggtgttctacacttttactcatgcgttttatgtgtggacacaaacacaattgcttgaattggatagattcttgctgtttgctagttggtactagtggaagttggcgcttttgtactttgaactaacaatgtaaggtgaattttgggaaggaaccagtacagtaggagctctaccatttcaatcaagcaggaagaaggaaacaatgaaattaagcacgaaggaaacaattaggtgaattttacattaaattgtatgattctgatactctggcaaagaaatatagctctcagaagtgagaacaattgctaactgaaacactacatgtgactaaagttatttcaggattatttccaatgagcttggctattgtagctgttttcggtgtctcagtggaggcttttccttctgttctagtaatacctatgcaagctaattggcaaacatgaggtatacatctcttagtgcatgcatctctactgctacatctcttattgatgctcgctcttgaggctgttgctttgtgcaggatatgcctaacatgaagacagaaacgagacactcctggattctgctctgtataatgttatcccgtggttctacatgcagccagattgttgagtctgctatctccgaagttatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagcggcgaccttcacagcttgttttgcaactcgagggaagaggattgggagtttacacgagagaattgatggtgagattaagatgagaattttgatttttaatcaccagatttcaccctcctatacaatgcaatacatctactagatgcaatcgcggaggcctttgcacgtacgtacgtgcacacacccatggcggacaacgacatcatggcggcattgccggaggacgtcctcctccaggtcctctcccgcgtgggcaacgtcaagagcctcttcatgctggccgcaacatgccgccgcttcaccgatcgcgccttcctccgcgacctctggggcggccagcgcgccggcgacctcctcggcttcttcttccaccggcaacgcaactcggcctcgacattcggcttcctgccggcgccgccgcttcgcccccatcccctccagctacgacggcgagcccctgacggcgcgccgcggcatcctcctgatgcggctttccccctccaacgactggtcagaggcgaccagccacctcctcggcctcttcaaccctatcaccagcgagcaccacgttctcccgcatctgaagggcccctccaaccttggttccttcgccgtcaccagctgcgccatcatcttctccgacgacctcgccgggaagcagcagccgccatcttcaggccgcttcatgttctcgcagctgctcgtcaccaccaagcacaagagcatcaagaccgtgtacctccactcgtactccgccacgcgcagcagctgggccgcgcccgccgtgttcctggatctccgccgcttctccctggtgggcgagggatcatcgtcatccgccgtcgtccaccgcggcgcggcgcactggctgtgcaccgaccacgtcgcgagcgccacccgagacgactacctgtacaagagctcagcgtggaggtgggcggcacagccacggccacgccgcgcgtctccatgacgaagctccccgtcctcgacggcggcacgccgacgccgctgctctgcgtcggcggagacggcgagctcaccatcgtctgcgtgttcatcatgcacgtcagagtctggaagcagcagcgacgcggcgatggcgatggcgacggtgcggcggcgtggcgccgcgacgtgatttggatgccaacggaggtgtccaactaccccaaaagttacacgatggcgcatggattgggacgcaggggatcggtggccatgatgtacagtagcaccggcgctgtgttcgtcctcgacctcgacaagaaggtgatggagaaggccatggactgcttgctgcccctgcgaatggaccattcactggatcggccgcctgtgccgtacgagatggacttggtggagttctttctgctccagcttggtggtctatggctctatgcagcagaggtgatctacaggataatcaattaattaattgattgattgattacacatgtttatggccccgcgaaaattactcatgttatgcagtagaaaaacgagggttaattgtagaataggggtatgtgcgggaaaaaaaagtaagttttgatttaaggacaacagcatattattatcattgataaattcttcaagtgttattaaggtttggtaattggtgtcaccttttttttttccttttttttttgactgtctgatcctttgttcagcaatttttgttcattaacaatatggcattgtgcattatccaccctgatttatggtctggtcgtttgctcgttgcttacgcacaacctgatgaggtgagcgtgaccgtccgccggaaatgcgggattttataaggctcacgcagaatatgaaagttggccatgtcgaagggtataggaggaagaggtttcatttttctccctcacccatcttcctcgattctaaagatatggctagagtgaggtttagtgtcggttgttagaattgggttatgatcttttggacaaccttggctgtagtttcttcgttggcttagcgacggccgatctagtgatagttttctcttgggtttgtgtgttggtgggtgggtggtggttattttttcttcgtttttctagttacgatatcccagggttataattttataatttttttctactttattaagggcctatttggttctctaccctaccaattaattggtagtgctaaaatctagacaacttttagcactaccaattttttggtagggtaaagttagctagtctatgtttggtttaataccaatataaagctaaaatttagtatgagagtgaagaagattttagaatatagccaaattgagcgtaggcgctatcaattgtttggcttcaatctaaactagcacgtttactattaaaaaattttggtagggtctcaatccaaaacagccctaatattgaacttcgcagctcgatatttggtgatggcggtaggtatttagcgcgaaacccattaagccactggcccatctacgcgtcgtctccagaaacggcccaattttcatttcctaggcccaacatccagccatgtttcggcatgcttcgtcgaaccccccaccccccaaccacccccacccacacacactccccactacgctacgattcatattcagaaaagactttctcatctactagatgcaatcgcgggagatcatctaacgcctttgcacgtacgtacgtgcgcacacccatggcggacgacggcggcatcatcgcggcattgccggaggacgtcctcctccaggtcctctcccgcgtggccagcgtcaagagcctcttcatgctcgccgccacatgccgccgctggctgcgccgcttcaccgaccgcgccttcctcctcgacctctggggcggccagcgcgccggcgacctcctcggcttcttcttccacctgcagcgcatcaaggtctcgacattcggcttcctgccggtgccgagctcgccgctccgccccctcgcctcctccggctcctccaactccgtccagccactggcggcgcgccgcggcgtcctcctgatgcggcttcccatcacccgcctcctcttcctctccaaccccgtcaccggcgagcgccacgtggtcccgcgcctggaggagtactctgaccttggtccctacaaggtcaccagctacgccatcgtcgtctccgacgacctcgctgggaagccgcagcagccggcatcgtcaggccgcttcacgttctcgcagctgctcgtcaccaccaagcacgcgaacagcatcaccatgtacgtcaactcgtactccgccgccggcggctgggccgcgcccgccgagttcctggatctcctccgcttctcgctggcgggcagatcgacgccatccgccgtcgttcaccgcggcgcggcgcactggctgtgcaccgacgacgtcgcgagcgccacccgaggcgaccgcctgtacaagctcagcgtggaggtgggcgtgccggccgcagccacgccgcgcgtctccatgacgaatctccccgtccgcgccggcggcgcgacggccacgctgctctgcgtcggcggggacggcgagctcaccatcgcctgcgtgttccccatgcacgtcagaatctggaagcagcagcgacgcggcgatggcgacgacgatgcggcggcgtggcgccgcgacgtgatgtggatgacattgccggcgccttacccatactgcgtgccgctgatgcatggcttggacatgggatcggtggccatgatgtacaggagcagcggcgccgtgttcgtcgtcgacctcgacaagaaggtgatcgacagggccatggactgcttcctgcccctgcgaattggccgcgagatggatctgccgcctgtgccgtacgagatggacttggtggagttctttctgctccagcttggtggcctatgtggaggagggtctacatctacaggatgattacacatgttatgcagtggtaaaataatgagtaatataagcaccagcatatgaattgaaatgcatggaccatatgcaggaaagtttttgattgataaattcttcaagtgttgttatggtttggtaattggtaaaacagctcgaaacctgttctttccgtcccacaaaaacgtggcgcaatctcataatctgattttcatgtgtgattacaggtatgatttgaattttcattttgtacgaaaaggatgaacagtcaaaaatctttctgacagttctccacatagtagtattgccgtattggttgtaatgtacacatcggcagttactgaacgttctattagcttacattacatatagccatatgaactgacgcaaataaagactgactgatatgaaccacgaaggaaaatgctacatcttcagcgtctcagcttttgtttctcggaattctggcaagtcgccatcggcagctgagctgttaaaacattttccccagcaagcatatcttattcttgtacactcttcaggcctagttactcactgttgcttcaaatcgctgctaatttgtttcgtctcctcttccatgtccactgaaagagagccagaaaacatcaggtaagcgtcgtctctgatcgcatgcatcttcagggctgcatcttgtattggcattcgctctttgggttgatgctttgagcaggacaagccgaggccaatgactgaaatcaaacactcttgcattctgcttcttgtgatgctatcctcggcgtctacatgcacccagagcgtcggatcggctatctccaggattctgtcaggatgagcagcctctgagaaactgtgcaggtccaaggaatctctgaacatatcgtctgttgggctcattcctgtaaacatctcaagcagcaatatgcccagactataaacatcgccaagagttgagaccgcagagccttccccatactctacaaatattttggagttcattagattcaccggaatgttaaatttgtgtaagaactaggaggtaaaaagcaaagaaacaaagcataacaattcagttacctggagcaacatagccaatggaacctcttattccgattgtgttgcttgaattttgctgtgttttgctcgcgctttcagttaggattcttgatatgccgaaatctccaactcgggcactcatgtcttctgcaagaaggatgttgcttggcttgagatcacaatgaacgatcggcggctggcagtggatatgaagatattccagagcatccacaatatcaacagcaatgtccagcctttgagttaggctcaaagtattgtcagcaatgggcatatcagattttggatgaagccaaccatttaagctgccattgggcataaactcaaaaactagtgccttgaaatcttgaccttggttatttatgcttgaacagcaagtgatgatctttaggagacaacggtggcgcacacttctcagtgcgtcgcattctgccagaaaacttctagtagatccagaccgttcaaggttaaacacctttacagcgacaacaatttcctcatcaaacaaagtgcatttatagactacaccatagcttccttttccaagcaaactgttctgtgaaaatcccttggttccatttgacaattcctggtaagaaactctttcaaattgttcctccacaactggggttagggactggcccttcttcctatgtacaggctttctacgacgaattaacataataatcaccataactagagctaagaacaagaccacagctattgatgccagagctattttaagagaccttaaccaccctttgcttctctttctaacagcatgcatggagcatggaggtaagttaagatgagatattcccccacaaagctcactgtttccagctaaagacaagtaagataagttcttaaaaataccttcttttggcacttcaccttgcagatcattgaaggatagatccagcattgataacgatgtcaaattctgcagcactgctgggataggcccagacaagttgttatacgctagatacaactcttgcaggttgtggatgctaccaagggcatcaggaatcacaccagaaaacttgttcatggttaggttaagtacacggagccccttaatgtcccccagaaacacaggtatagttccttggaacgagttactgtccaataaaagtacagtgagcactatgcaattttttatactacttggtatctggccagacaattggtttcctgacagaatcaactcgttgaggctagtcaaactcccaacttcagaaggaaggggtccagagagggagttgtatgataaattcaagtactgtgaaatggaaggcagctccaatatttcctttggaatcgaaccattgaagtgatttcttgataaatcaagaacattcaggcttttcagcttaccaagattcgctgggattggtccttccaagttgttgccttgcatgaatagcttcatcagattggtaaggtttcctacagaagacggtacatggccagacaagctattgttattcaggtatagcgtagtcaagttttccagcttcccaatgctctctggaattacacctgatatgtcagtactaaacaggtataatgatcttagaccaaccaaattaccgaaatcagaggggatgcttccagaaatcctactgccacccaagtaaagtttttggagagtcttcgagaggtttgcgatcgaaatagggaactgcccagtgaaattgttgttactgagaactaaaatctctagcttactgcagtttgtcaatgactcaacaaattcccacccctttatgtcccctgcttcaagcatattaacacctagttgcagattctgcagagcattcaacctccctagattatgtggcacaaacccactaaatccgttcattgatagctgcagactcgtgaggttagtgagattggagaacgaggagggaatttccccgctgaactggttgttgaacactgcgaaagactgtaaatgaggaaacttttcatcgatatcagtagcaatgcttccatccagcttgttgtttcctgcatcaaaccccattagcgacgacagattgtacagggaagacgggagtgcaccactcaggttgttggagcagatgtcgaggaagtaaaggcgcggcatgttgctgccgaattcaggaggtattgtgccctcgagactgttcatcctgaggctgaggtatcccagggacgtcagattggccagtgaagctggccaatggccgacgaagctgttgttgtcgaggcctagcacctggagctgtgtcagcgtgttgccgagctccgaaggtatgtgcccggcgagcttgttgctgccgagggccaggtattccaagctggtgcaggatgtcagattgctggggacctcgccggagaaggtgttgaagcttaggtcgagttccctgaggcggtgcagctgaccgaggctcgcggggatgccaccgtgcagccagttgtaactcaggtcaagtttccgcaaggaatgcaggaatt

SEQ ID NO: 26312 - DNA, 14312 bp, Oryza sativa
tgccaccaccgttgcccaccgccacggccttgaaagcgagcaacgctgcggcgtcttctccgtctgctcctcgcactgccatgaagtgcaagaagatggacatgaagacggacagcagcagcagcaggaagctagcaagagccatcgccatggtggttgcaaacttgcaaggtacacaagtggagtgacaagcagtgccccagagcaccgtattttaaccccacgacgccatgatcccagagtgccattggcgagacggcgaggacaccgagtcaaaatcttgacttgtttagcggtctccgcgctcacagggagagagacaggagtggtaagataccatgtcgacttggagcagtgcatgttacctttttgactgttcccgccattcctttccacatcatttcccaactagatacttactgtaacatagtactggaaggatatggaaagcttggacgcatccaagctctcgtcgctgtcgccctcggccctcacacatgacttagctcgctccaattatgtcctcaccccttctctgttcgaccaaattcctgataatttcttcctgactgattccaacagagaatccattaggttggcagtccagagtgttaccttgtacagttgtacggccacccttttccacgcttgtatgcggagttccagacacacgaggaaaggtaaaagtcttgtggtgatccaggattagattcagcttgtgtagagcttccgtgaaagcatggacaactacagttgacgagcacaaaaacgaacaacaccgagcctcctgggaacaacgagaaatcgagaattacagcaggcacggccatgtctttccacatatgtacaaacttgaaaaggtccgtggcgtggaaaatttatggagattaaccaattggatgctcaccttagtcaaagggccagggacagtaagctcctcggaggagttctgtcgaacaggtaacgggcgcagactgagaactccgagtctctggagaattgttgtggctacagcgacgggagtctcgaagaagaaaaagtatacaggattgggcatcgtacgcgtcggagctgagcacggcttccagtgacggcgcattccggcggcggcggcgaggcggtgcccggaggtgagcacgagaccccggcggaagcgcgcgcgtgagcgatctgtccaacagtgaatggaccttgcggtggattagcattttggtgggcccacaataccagaaggaggcccacaagaaggttagcgcgcagcccatgatttgcaacgggctacaaccaagagagatacatttgggcccgtgtaaaggcccaaactattcgaggcaagcacgagatatggcccattatctgacaggctgagcaacaaagttgctcacttgctccccgtcgccgccgcttcaccgaacacttctcctctccgtcgtcctccatctccatcgccggtgaacgagttgacgcgatcttctgctcaggcgaagaacgtttatctgtctagccggtcaaggggaacgcagcttttcctgccgttttcctcacgcgatcgaccgcgctggcacgcagcagcgagatcatatcggtgatatgatatccaagtccagatccagtgactcaggctgtgtttagatccaaattttggatccaaacttcagtccttttctatcacatcaacctatcatacacacataacttttcagtcacattatcttcaatttcaaccaaaatccaaactttgcgctgaaataaacacagcctcatctaccatcctttcctccgaactgtcgtgttcctaatagtaatgtgtccataatagtgggtgtgtttagttcacactaaaattgaaagtttggttgaaattgaaatgatgtgacggaaacattggaaggttgtgtgtgtaggaaagctttgatgtgatggaaaagttagaagttttaaaaaaaactttggaactaaacacggcgaaaatttcttattagtccatttcaccagcaaattattgagcttcgttggttgggattgggaaattattgagcttcgcttgttgggattgggtagggaagaatgccattttcttctcttttttatggccttttgaatcgcaggattgaaaaaacggaggaataggaaaaacacaagattttgataggaatgaaagtgtaaaacagaggattgcaaaacacaggaaaaatataggaatgaccgtttgattagaccgcaagagcaggaatcagacgagagagatagactcaaggaaagttttccaagaggtcaaagtggatgttaactttcctacatttttgctctagaattgtaggaatagaaaagtttcctacgtttttccttttcttattccgacgaatcaacgacatgaatagtgtaggatttcaattcctttatttttcctccaattcaaagggggccttattttcgattacacgacagtggcacagtgcacatcggccaaatacgcctcctagcataagctcaaaaaaaaaaaaggaaagacaatggccctttcttaactcgctaaaatcctaatgagaacatattttcatgtgcataatattcataaacatcaggatttaggggtttggttggcatacccacattgtcaaaacttgccatacttcatttagctaacatatgcttaacatgtggccaacaaaattgaagccacacttcagccataggaaagcaagcctaccacacttttacgtgccaatgacatatgacccacattatgataaatgaatcttgccataagtgtggcacaaaccaaacagatgcctaacttaatcaaatttggctaactttagttgtgatatggtgaggtaaatcagttgatgatttcctcagctcttttcgactgtgacaataagagcgtcccgtcatccttggtgcgaacgcaactaggcaaattttcagatgccaaattaatctcaccccccccccccccccccccaaaacacacacacacacacacaaaagaacctatcgaggtccagtactccagtctgaaaattggactatgaaaaagaagaaaaagatatactttacatgctatgtagagtaatagcatactttgaaaaagtcacctctcttagtagttgtgctgatgcttgatgacgccattaggtccgaattatttgctgctatgtagagtaatagattgtgctgcggcagatgtttgtaaattagcagtgtataatataccttccattgtttaggttcctgcacatcaaatgaacaaaatcctaaagagcagctacaatttgcacaatcatcagttaattcagtaacagtccaaaacgttatttcagttaattttttttcccttcaattttgaggtttaccagtttgactataaaacctgatgcaaacaaggtgacaagaaaggggggagtatgtcaggataccacatccatgtatcaagaaagatctaaaaataatgagaccaacgcatggatctctgttacttggatcaacataactgatggaacatctaattccaattgaactgattgcaaagttttgcttgtattttcagaaagaatttttgacacgctgaatccccaacatgtgtgctcatgtccactgaacaataatgttgcttggcttcagatcacagtggatgattggtagctgacagtggtggtaaagatactccagtgcatctgtggcgtcaacagtaatgccctgtctctgagctagacagagggtattgcctggagtcttgacacatttctgatgcaattacccaatttaccatgaggcatatacttaagactgctaggccagtgctgttgaatcattgaccttggaagtcaatgcttgagcaaaaagtgactatctttattaagtaacagcggcacaccctactcaatgcctcacattcagccatgaaactcctagaatatccaacaaattgacatcttcacagctgcataaacctgggctagctggacattcttaggctagatttggtcagcccataaacctaagcccccaactggagtataatctattgatgaactatttacgaacatggaatagtcttgaaattggatccaattttagattcttcctggtaagaggttcttctgtagcaggttcatctttcttcatacgtattgcttttaccaatagcttcgtccttggttctggtgtcatccctctcgactccatcgttctataataatgcaaagcctcatccagtttatcgtgggaatggagtccatgaaccattatagtaaatgatcgttgatccgggcctgatccattcctctccatttcatcccatactagctgaacccctttctcataatcccaactgacataaaggttcaatattaagttatatgtatcagagtccagtctgcaaccagacttctccattctctgcatcaatgaaataacatctttgggtttctctgtcgtcttcagaatgtaggagtatgtcatattgtttggagagacgcccttaacctccatgtcatccaaaagctcatagactttctccatccgattaatcttacagaagtgttttatcaaagtgttgtaggtagcaacatcggcctgacaaccacgatcattcatctcaccaaaaatctcaagtgcttctggaatccttttcttgaagcacaattgatcgatgatacaattacaaattgccacatcaggattgatccctttctcccacatgcttgtaaatagttttactgcagtactaagtttgccagattttgtaagcgaatttatgaatgtaccataggtgaacaggtcaggcttaagcttagacgcaattatctcattccaaacccttttagcgtctgccaagcttcccttgacacaccaaccattaagaatgatgttccagctctttatgacaggagggaactcatctttcttttggagaaagagggcctctgcttcctcaacatgcttgtaccgacagagagacatcaaaagtatctggaatccaaccaagtcaagctcaaacccataatccttcctcttgtagaacatatctatcgcctcctgcaccttgtgcgcgcctgcataccggtttaacaggacagcaaacatcctgtttgtgaccactgactggcggctctccacaggaatctcatcaaacagttgtctcatgagcctgaccttcttcatcctcccaagaatgtcaagcatctccgtgtaggcccttgacccatggttatactggggcagaccagctgcccatttgaagaaagatagtgcgactttccaattggacctctgcttctggagcacctttagcacaacatcctcatccatctcgtctgcaaattgattgagaacttcggcgagctcactgtcgccatctctagacttgaggattttaacgatttcgctgacatggacatccttggaaccatccaaagcggtagaatgacaaagccgtagagatccaacaacgcagtgaattgggagaatgctctggtgaaagcgtggatataagcctgccccgggaagctccactgaggcattctgacgaacagttggcgtgcaggaaccaaggaagccgagcctcctaataactacgcatgaacaaagtttaaattagtaccccgcacttaaattcagagaacgaaacctcgttccacttcagtatatgcattcaaattcagataatgaaacagtgcgcggtgtgatggactcatcaagagatgatgaaaaaaatcagaaggggccaagagaaaaagaaaaaaaaaagaagaaggggagtcggtgcaggtggtgcctaccgaagagcgtcctgctggacctgcaggcggcggagaggatggcggacgcccgcggcggcggcatcgtaccggagatgagcacgagagcggcggagggaacgggtaccagagcgctctctctctctctccggtcgatgactaaatgggctactaataactaagttaagcgaagctattgggccgacttgaaagcccactatgtgttgaatgggttgtggccgacgtgcgggcccgtcatgtaaggctgggcttgtgatggacacaagcgaggcccacaatgtgcgtgtccggcctacattgaggcccaaaatattcggagcaatcatacagtccggcccagatagcaacagatatagaggcctgatataacctgcaacagaagtacagaactaaccaaacagcttttaacgtttcagcatgctgcaaatctgaaccaaccaaaatacaaacttaaattagtaagagtacccccactttgaggaacttagcccctctcttctaaacacccccttagtcgtgatggaaagattgattaactcaacaatttatttgttatagaaaaaaacaattaatttcgcatttcaaagagcgtagcaggtagtagcagctaatcttgcattgaaataaattacactttttaaaattacatctatataattcagttttaagagcaggtgagctgagtggagcagctcgaagcctcgaatagtttgaaatatactgagcactccacttcacttgacgaactgagctgaagtgtcaccgctcacctgctctcccgccaaatcctctcaacccaaaagccattgagctgagctgcctccttgtatatatccatggatccacctcgatctctgccatggcgttcccctccctctccgtctccggcattctcgcgcgccacccggtgctcttctacgcggccacctggacggccgtcgccaccgccgcggtgtccgtggccgcgttcgcgccggagctcgccttcgtctgggctgtcacgccgggcgccgcgccgctggcgtcgtcgacggccggctgcccgggcggcatcgtcctgccgctcgacgggccgccgtgggacgccgcctgcgtgcccgccgcgctgttcggcagggtcaccctcgacgtgctcgtgccgcccgtgttcgccgccgcggtggtgtccaccgctctctggttcaccaaggccgtcggcgtgtgggaggacgacgacgacgaagacgacagcgacgaagctacaatggtgtgactgagtgatgctgtaattttgtgacacttagacgccatgcttgctatgcatattagaatcttggagttcttgatcttaaatattaatggctctgatcaatatcatcgtcaactaagagtgacaaagcaattgaattaggctgaactttattgaagtatgtagacagttgaagctggttataattccctgtttctgtaacagaatgaagaggaatttgtttcatttcaaatagttcttattgaaagaaggaaggaggaaaatgaattgataagaacaataggtgaagcggaaaaccgaaaaagagcaataagtccttttgtttacaagtcttctttatatagaaattcgacctattgctctggatccccgtttactaggaagatatgaatcgaaaggatcgaactacctactcattattcggaggtgaatcatagaacactaaaagctgtggtatcttatagaactatctatttgtataatgttctccagttggacaaatgttcagtgaaggtttacactgacagcaaaattgacagtctttcatggccaaggtcagtgagtggcaagattgacttgaattccattatttcaagctgcatgtgcttcggtagtttcattgtatactcttaacacctgatatggtgcctcaaaatgcagcctgttatgcaactaaaatcatgcatacaagctaagcaaattcatgggcaatagctgcacatatgtagaacaatatctagccaggcagaatttcacaactgctgaacaactcatgtatttggcaaatatattaacaagagtacacaggttgatctcattctcagccatgaccgaaggaaacattagaaaagggttcagaatacttcaggttcctaatactactgctgctacacatatttatcaatcatcacatactagtatgccattaaaccaaacagtatcagaacacttcttttttctgctgatgatcctgctttgggctctcattttgaagaagacttgatcagcttttcgctgaattcccagagttgcttcgccagcgcgtcattcctcgcaaatctgctagttttctccacattgcagtcagcaaagtattgtccggtcactcccttgagctgagggttcagtcctacatagcaagtggtagctgctccctgaaaaaagaaacatttgttaagtgtgttgtttcagatgaatttgaatttcaagacaattcaatttgtctttcagcattgctgcagagaattcggacagaaagaagaacagagaagatattgggttccaaacctggggtacgctcttccacaagatgtaggtggcaaattgaagcacccctgcaagtgaaaacaaagtgtttttttcagaacattaaggaaaggaaacagcattctcttttcaatcgaagcctgaaggtccatagcaaaaactctagaacaatgactcagaaagagagaacttgcatatacgtactcataaggaaaaaggagtgcctcatcaaattggtcatgatcaatccaggatgaacacagttaatagtgatgttcgctccttcttcctgtttcatcaatggcacagatcaaacatgtattggtgaattagtgatggaaaatagacaaaattaaatgtgttttatagaaaaatgggaaatgcatagagttttcagctctgttaatctgaataaagacatcacaaataaaggtgagaatgagggaagaaaataccttcagccgtctagagagctctttcgcgtgaagtatgtttgccagcttagattgtccataagccatcttgtcatcgtatctgccaatacaaaattcttatttcaatctctaatccacataaattttccaacagaaaaacaacatgaaaacactcagcacatacgttttctcatcgttgagtttatcaaactcaattcccttcggatatgtatggaggtgagcaaccgatgacaagttcacaatacgaccttcaatacctgtggacttcgcggttgctttcatattatcaagaaggaggttggtcaacagaaagtgacctgattgagcataacacatcagacagatatcagtatcatccaagcactttttgcatgtttaaagtaaatagttgatagtggtagagagtgaataccaagatgattggtcgcgaactgcatctcaacaccatcttcagacaatccaaacggacagaacatcacaccggcattatttctgcatgacggaaaaaaaaagaatatatgagaccccttaattaactgaaatttaagcagaaccaaaggatctttgcatgttaaaaaaaggcaagtgtgctaagagtttgaagggagttacatcaggatgttcagaggaaggttcatcgagttgaactgatctgcaaaagctctaacagacttaagggagctgaggtcaagcttcagaacatcgatgtgagcttttgggttttcctcaatgattttcttcctcactacagatgcagcctctgtgttccttgctgcgatgatgacatgggctcctctcatcgcaaagactcgcgaggtctccagaccaatgccactcgctcctcctgtaagacaacagaatttacagatttccgtaaatttgcgaggatagatgtttatgaacagtttgcagtaactagctactgtgagtctgacacaacatgaaatttactcacaagaatacaagattgatgtttggtgaaaactgaattctatgacagattggttatggatgcactagaagactatgattaatgcttttatgagcaagtttaattgacaagacctaacacagaaaaagttactattatataatgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgcccttccgatgaattgattttccttcacacttctgtatatcaatctatgtttttgtttttttagtattatctaaaatacctgattgaattatgaattctctgtagtcaagaaagttccagaaatctaaaccacaaccacaagattgagcaggaaacagacaaactttcatcaaaacataataaactcttctggtccacaaaaaagctacttatgcataaatttctcatatacaattttttgaagagcgtagtattattttgatattatattaatcataacacaaaaggtggctgctttcataatcccaactctaagccacccttaccaccatccaaaacacacccaaaaaggaaaagagagaacaatttgagagagagagagagagagagagagagagagatgcagagactgcctatggtgagttggtgacgggtagagaattggagattattcacacgagtttctcacaaatctaacaaaaacatggcaagaaactaaccaaaaccattaaaaataaactgcattgatgttttcaagaacaggtttttgctggccacaacaacacattgcagagaaataaattccaagattcggaggtacggaagcaggcagctctgtctcttacctgtgacgatgacggtgaggccggtggcgtcgacgccggcggtgacctgctccgccgtggacccggagccgaacccgctcgcgccggccttcccggtgatgagcgacaagatgcccatctcaaaccacgccgccaagaaacccccaaactcacgatccaacactgcaccccccaaccccaaaacccaaacaagaacacgcaaagaagctcagccaccgcaacgcaactgaattcgacccccccccccccccccccaacaagaagtcgccgaaaagaacacgccaagaagcactcaccctcgccggacagatcgacgagttgttcaatgcgcgggcgcgggaggcgggagcgaggcggaaggggaggaggaggtggttatttatggttgggggcgccggtgcagagttggtcgcggagttagaatcgatgcaggaaggattaggaagaagacgagacagaaaggaatttggaatcgtcacagaaagaatcgaatcgacctggattcatccaaattttaagagaattttatacgtttgggttttgtaatttactgctagtccggtatatgaatatgaatatctcaaaaatgtccaaatgctacaccaaattggttcacaaagaggtctggttggtgtgtagcagcgcttcgtattcgattaaaattcaggggaagtaatttgctgtagattatgaactacgtagcgtgtcactgtcccgttgggtcccgttgtatacatgatgcattgatgcagtgctcctaatcacttcctgatttgccatctgtcactcgtataatctcgtactccctctgtctcagctatgatttttcgtgtccaactttaatcgtttatcccatttaatttttttttaaaaacaaaaacataagttatacataaagtactatttatgttttatcatctcataacaataaaaatactaattacaaaaaaaaataaataagacggacgatcaaagttgagcacagaaacttatagttgcacttaaaatgggacggagggagtatgttactgccagtgctagcaaccgtggcatactcgactctgtttgggacagttctagatttaagatttttctttaactaagtattcataactctagaaatctatacatctaaaattatgattatattgataatatttagatgaattgttgtttgtattttatgagaaatataaaattttaaatctcactatagtttatcttacaaactctaaatttagcaagtatctagaatcaacaccttgcttgcctgtgtttatatgagaggtttgattttctttctttttactagtattttacaaattaggctttaattattttacagcccatagttggtccgatgtgttactggaaattattttggtcactcgtctgcggtagcaaatggggccggcctactttgtataaccattggtccattgttgtctgatcatctgatgatgctgcatttgttgaagattaggtcgatgatgaccgaccggccggccggcatgaacgaacttgagatctcaattcatcatcctctgccaatttcgctaatctctttagttaatgtattaacccaaaagaattaagcttaattgataggagtagttaatatcttttgatctgtgtgaaacagtgaaagagatatggggttaacattaaccaacatatagttaattttgactatacaaaaaaatatattatactgagtagtgagcactgacacaaatcactccattgtgcaatataatactgacacatcttttttaaatggactgacacacaaacccctccaagataatagctcgagtcagctcgtgtgtaaattaccgaggtaattaaaaaaaaggctatgcataatgcatgcagattaaaaaaaagttactgaccattacaggattttgtggtacattattgaaggagcatgcaggaccagattatttgctgtaacagcaaggaatctgatggccatgctggtcctgatcacacagtgacattagattccatctcatttctacaatcttttgccccttttttttcccatttcatcatggagagttttcttcagatttttcagtaaggtaccagtgatccagactgccagtggatgcatggttggaagggagccaagcatcatggcgcagcgcagacacgggctcacccggtagtccccatttcatgcccactggtcctgaaatgcttatggacgatggattagggacgaaattgagttgatatgtcaatttagttcctttcaaatatgtcaatttagaaaagctttcaaaaaaaatatcgatgaagaaagttctcgaagaaatcataatgctcagaagcttggaaaatgtgtccataataataataaattaataatccgtaggcagcacaccaaactgttctcatcctattgctatggttgtatttagttcctttcaaactttcaaaaattcttccatcagattaaatttttggacacatgcatagagcattaaatgtggacgaaaaaaaccaattgcacagtttgcatgtaaattgcgagacaaaacttttgagcctaattacgccatgatttgccaatgtagtgctacagtaaacatttgctaatgatggattaattatgcttaataaattcgtctcgcagtttacagacggaatctcgtttaatacttcaaatgtgtatctatatacttaaaaaaatttggcttaggaactaaacacagcctatgtgcatgttttttcaggttcagagtttcagatacgtacaaggtttagagtaggaaaatattcgtcatccccaaccctccatgtcatatagtttctatagcattaaatatattgtcacgtaagtaaaaatcttatgtgacaagagagttaacgaggataccatatctacacaagaactaagaataaaaacaaagggatatgtggataaaaagagagaggagagagatgattggatgggaatttaatttaaagacatcatccattaaatacatagtgtcataatatctatatataacatgaaaaatatataaactaatagatagtttttgggttgggatggcctcacgagctcctcgtgaatggcatggggcatgggcaaacctatacgtatctccttgaccttgccaagaaacatgaatgattcattgattcagtgctagattgagctaaatatataatgtgacatgatgccatgtgaggagcttcatcatctgccatctgatgcacgggtgttgcaagcgatgtgaggacttgtctggtaataatagctcttgaggtgtccgagttgttgcttgattgctggcttgctgctgctgctgctatttgggactgttcaagaatgtggttggagcaattcaatgatgaggcatttgctgttcttgtttgttgccaaaccctgtcaaagtgtcaataaccaacacacaaaccagaaacaggggctcacctaggttagatcctacttctacttttttttatgtcattcggctatctttattgatacgaaaatatagttacatcactcaccagcatgctcataataaagctaggggattcctaccactacagtttatgccaacggcttctcatcgtttgcctttgataagccgtgagaaaaataaacgaagcaaaaaaaattatatgtaaaacttttacataggtgttcttacggaatgcaggaatt

SEQ ID NO: 26313 - DNA, 321 bp, Oryza sativa
tgcagtttgtggtgatgcacaccaagggcgggtcggtgcgctggttcaaggtcgcaccggcggcggccacgcccgagtccgaacgctgatggccgtcgcaccgcccctggccgcgcacgcaccgcgccgcggcccgttgccctgggtgctggcactggtggccgggctggcgcaggccgcatcgctggcctggccctggggcgggcagccgctgtggtggctgcagatcctgtcgctggccttgtgggcgcatgtgctgctgggcgccggcggtacacgccgggccggcctgctgggctgggtgttcgccacggcgtggct

SEQ ID NO: 26314 - DNA, 2335 bp, Oryza sativa
attcctgcagcccaaattcacccagtgatcgttcttggatagatcattcgacaaaattgtgtcaatttctatgctggactgtggctgttcatccagatggcagcttactttagaccacaattccttgagggcatggtttcccacaggtttcggtctatcaaaagacgaaaaccgggagagcaaggacttggaaacagaatatttcttgtagatgtcgagcaacacttcatttgtcaagtcagacagaagtagctgatcagctgacatctcagtgaaatcaaatgcagcggcagcagcctcgtagtgttggcaatcctcttcttggagaactgtaatgttctgtgagcaccattcatcaaatagtacttcattgcggaagcttgatttcatgaatatattcttcacatagatcaacccatcttcattctttggatctgcttggagagagcttagttcatcagagtcactttcttgaacatttttgtgacccaggccagcagttgaaagttccatggaagtgctggtattgagatccatatcagctgaatcatcggtatcacttaaatggaggactcttggcttcaacgacgaatctgcaaaaggaaaaggaaaaaaaaactcaatttaaaattgaagctgaagcttgaaacaaaagctaattaaatgatttttttaatgattgaactgtattggactttttaatgtcccctgcaactcataaagtaaaaatacttgatctggctacctttatgtaaatttaattcagacacttacagtgacaggtcactgaagctccaaaatcaaaggctctaaactaaacatcgtattttttttcaaattatagaaaactaatgtatgtatgtaagttttctgctactaaacggaaatctcaccatccaggattgtatatttcactggactagcaggatcatctgggaaggtcatgtcaagaacagacattggactatcagtttcttgttcacagcttagatttatctcagcttcaatttcttgactgggacgaggaacacaaaaagtaccttctcttgacttcagaacatcggatgaatgaatttgtttgtcatctgaagttgttgtatgttcttctgaaatccttccgtcttctgaaactttagtagtatgcatacctgcttctgttgacaaattagtatggtcatcgtcacaagttgttccatgttcttctgggacatcaatttcttctgattttgaatgaacagtacacatattatcttcagttgatgagtgaacctgatcgtcatcacaagttgctacatgcccctgtgaaatatcaatcacttctgaaagtaaagggggagtacatatattagcttcagttgacacagaaacaccacactttttgtcaacgatgtactcttcgattaacacagtattttcagagccatcagcatccttatgaccagagatctcatccatagcagcatccacatctccatccacaataattctctctggaacatatggtgccaaggcatgttctgggatcacgagattttcagcagtcataaccaaactctgcaacccagtcatcacagcaggcgcatccaaagaatgatccctagtagattttgaacttgtcagcgtcctcttcgactggttgcttgaaatagaatccagcaagtgagaatatttctccaatgattcagtgagggaacgtgaacgccgaaaaccttggtttacaggtctttttgcagcagttacagtataagatttcaaaccatccctgtcatatgtggcggaggctgaccgggaaagtccttctttaattacatcttcagatgccttatgtccataagggaccttatgaagaactccatccattgaaatgctacggtggctcctttgtttcacatgaatgtcacctctctttagaagcgaagaacttgtatcattatcgcaaccatcctgggtgttgaatgtagcattttggatatttgtatctgtggaatttggcataatactttgtgaagaaccatcaccattggaagcagattcaccatcaagaacatactcattgctttccaggtaatgtattgaaagggtacggagtagcttcggtgcaacaggaagcatcttttctttatggccttcctttccatacagcttttttagaatcaaggagcccaaacttcccttaccagaactcttttttgaagacttgtttttctttgttgtctgtaataggagaaatgaaaacaacgtgataagccaactccaatatgaaataaatattgactatatgtgggggttttttttacgtaactatatgtggttttggaggagacaagtactacct

SEQ ID NO: 26315 - DNA, 2536 bp, Oryza sativa
cagagatcatcttagtggatcgcaggcggcgacggaagccaaagaactgaagaatgctccatcggcgcccatggagttccttcccataaaacgcggagtcctgatggtgcaacagctgggccatttggtgttagcccgtcaacaaaggtaggaggagtggttccttataagcaccacctttgcagaataaggaacaattcctcaacttttctttaaacctgtcatgaacagactgaccaccgattaacaacttagcgaataacacgcataatatcatttcaagtacaaataaattattgcctgaatagcaaactggaactctggaaaagtgcagccaaacaaatttaatacagaaaaaagatgttctccaaccaagtatccataaaatcggctagccaaaggcagatgttaatcatgaggaaacacataaaccataatcaatgaacaaagctaatagaaaacaagttgagaaggccctttgctgcctttcagacaaagaaacagaaatgatgctgacacaagcacctctttctgaaaacatgcagacaaacacccaccaacagcaactaaaccatttcttaagacaccaattaaaccatatatccatacatatccttgttagttagaatttcaattcctaatcaataattaggtgacaagaaaatgaaatcttcacaggggcaggcacttcagtgaagaaaaacactgattcccacggacaacgtatttaaaccgtgtggaaatgtttccacactgcgcaaaataaagaagacaaaggaagcttctaaggaaacatggtgaacaagcacagggaaatctcacatactataaagcaacagacattgttttcagtattttattgagaaaataagaaaagaaaatgaccatggacaggtaattaaaatttcaaattaaacagaatcacataggagaacctacgtagggcgtggggttcagataaatctttttggaaacaaactttacggattaatccgacgaaaaggaataaatccaaggccggatgaatccggaggaaactgcatgtacggattaacggaggaaagaaatcaatcaaggccggatggggcaaagagtgagattggcatcacaaaaccattcgcaaatcatcaaaacggacgtcgttaaacactcccttttactaatccaaacaaaacgatgaacaaaccatctccttttctcccccaaacaaaaaaaaaaagaaaaaaaaacaaagaaaccaaacagaaacgtatgcgagagaccacctgagatccgagatgaagcctcacaaaccctccagctccagcttatccaaaaaaaaaccgaaacataaaccgactcacgcctttccacaaacagattaaacgcacgccgctgccatcaagaacccacaaaaccggccgcaaagaaacctccttttatttctgcaaacgaaccttcgatttcagatgacgcctgcagccgacgcaacccagaaaaaaagggatttggtgtccgattcgagggtttggtggtgcttttgccgcaaggagggagttggtgaaatggaaagttggaggaaacgcgaattccccgaataagaacgggaggaggaagaggaaaggatcgcaagtgcgaggaatgggaaatttgagggggttttctgataaattccggtccgtagctgcctgcctgaatggcgggtgctggtagttgaaaacttccattctcttttggcagttatcagtttgatctcctctctttttcttttttcttttaataagaaaaaaagtatttttgttttatggtaagctggttatttttttcgagtacaagttggacgcgcacacgcagatacaccacacgcgtgtccacacacactcagagttgagtttgtggtttatctggttattattgtccatatgtaaaattaatagcacgcagattttcactgagcttttttggtattggaatatttcattaatggatgaagatatacatgtgtttgtatttttcttgcttaaaaatatttttttcttttctgatatgtttataaaaatacatgatttttttcttctttcattggcaaggttttaataaaatggctggaattgcatctctttcctatcgtgatcgagttgcagctgagaattcacatatgaatgaactggcaaaaggttacaggaaaagatgagatggctgtccttgtcagatattaagtgcaccagcaattttataaattatagaatcaatgcaaagtatggagacagtacatagaaccgcgttttcgtccagcatggtcattattgcctgaactttttaagtatttttggcttttgtttcgaaagcctccaaatcctccttaattctgtactcctttttgccagaccaacctcaaacacactgtgtgcttgtttgtattgtggtggaccctaggaaaaaaaagttggtatgaatttgaccactccatggatctcttttgtgtgtgtgaaattgtgaagttgtcctcttcatggatattttgtaagatctcagtgaatatttgagagaagaataa

SEQ ID NO: 26316 - DNA, 15944 bp, Oryza sativa
ctgactattttattcaaatggtgcagaaaaatctaccaaaacaagttggaattgaccggatgattctatctggaagcattgcaattgactggttaccagttgctagtactacctactgtgctctgcaacttgtggcttgtactagctgaccatgcaactacagatcatcggcgacaacaagacaccatattgatttagtttacttaatttttgaacaaaatagagcatacgaaagtgatggtcagcatgaactcttgtggtcaaaccggctactgggactgtaggtcttcgtacatttcatatgaaacatacggcctctttaaaatatttgcaggtcactgaacgaatctcggatgagatcgtagtacttgattggccgagctccagctcacagttcgattacacaacttcatttcgacaaaaatgaggtcagaacatgattttgagaaggaattgtttgagttgttactatgaacttggattctgctgctcattattctttggccaaattacagtagtcatagtctcatggagactaacggtcagagtaaaacaaaatgcggtcagtctttttgcaagaaaaaaaaaggtgatctgcaagaagtccacataggagaattttgtacaggattccttaggcccagtttggaacatgggattttttaggaatttgcttaggattagatccaaacactcatgtttcatcaccacatattttacagttacatgtgttttcaattccgtaatttttccactttacgctctttcttgttcctatgtttttcctgttcatgtgttctccgttcctttgttccaaacatgtccttaaaaacacgtccagaacagtgataactgatgacaaactcacgagtaaagttcttggtacaaaatatgcatgtgagtatgtgactgtcacccagggaagcaagaaaaaggaaacagcaccaatgtacaccacgaagctagtatatactttgtaatcaaatcgacgacttctggtaaggtttttcagaggacaacaggcaacaatgtcaagcatgaaaatggcaggcttcagctgagaaggacagaataggacagcaattccaggcgtcaaaatgaaattatgatcgcattactactgcttggacaaatggacaagaagtcaataagctgatatcagatgaaacttgtattgtatttaaccattacaacagggccaatgcaaactcaaagagaagttcaacaatagctaagagggattccattgtggactagatattttagatcatagaatagaagtggtacactgaaggcttcaacttccgaacactgagaccagaccaaagattcaatcccatgtggccatcgtgctgacaccaactccttacaggaatggtggaagaatcacccatcgccgaggatacttcggcctcccttccttgccatcgaacaactgcaaaataagaaatatcagtaaatctgtgcaatgataacattgttcagcacttcagcgcaggagaaaaaagaaaccgtgcttgccttctttagacggcggtgctttccaagtgcccagttggtcatgatactcgctgccacaacaaggaagatgtaacctgccacagtctgtgtggcaatgttgaacccaagccattggtagatctcagtggtatagtttgcgcatgtcactatgttgaacaggaagccacgaggaatctgatagccaccgttaccactcggacttctgaggttcctcagcaggatatggcaataaaagtttgcaatttggcagagaatcccaaatccaaacccaatcttcatctgcaattcactcacaggggtgtaaagcgggtggttgcagtagtaagcaatgtaagctccaaaggtccagtagtaggcacagttcctgaagacatttgatacaggagaagtcgcgtggctgaagcggtgaacaaagaacgtctccatgatcctcttgaagtagtggaaacaccaatagtacatggcgtaagtctggacaggatgcatgacccgctctccctcgtatccgaaatatttgtagacaggcaagtaatagaacatggggtagataagaagaggacccaagtattcaaagaagaacagcgtgctgtagaagacctgtgggcctaaatccttaaagaccactgtcagggatccagaacccttttcgcagtattctgataggctggcctttgcactaaggacaactggctttcctgattttccaggttggatagggagggtgagccgctgcctagcagggtaatacttcttagctgcatggtgtaaaaccaagaggttagcaactcatagaacacattgaaagcatgcattctaagagaagcaaggtataataaaatagtttttttttaaacatcccgctagcccattcatgattcacccaaagtaatcaaactgagttttctgtatatgtaagatcaaagattatgatctacattagcaactaatgctgcaatctttcagttagaataagattagtttgcatttgcaatcttgcactggtcagtaatcactagatgtacttggattccacactttggttcatctattacggtgcatgtttggtgtactaacatgcacttgagggcagtgataggaaataaaactacttaggaagattttaaacagtacttataaccatatatcatgatgtatcttctcgctctactacatctctaccacattgcaggacctcttctttactcttgagggtccaacatgaataataaattccttgtgaacatcacctcaggataacattatggcaacttaatagactaacatgcaaatgcgccagtctggcacaagcaagaagatggtgcttataattgtgacaataaataccataatgacatagaatagaggttcttgatagccagcttagctaaagtttgataaattcaagcagtaaattacgttgtctgtcattgataatgctacatcagcataggttgtgagttaaaacggacactaggtggtgacttaagagtgactgacaggagcacacaaaatgacaggggaattagcttcctgattcaaggctcaaaaaggaagaaccatcagcagacagggctgaaatagaaatggttttacagaaataagacaactagttgctcgaatcagcatgaccccttcatcagggtaaggcacagcaccaaatatcatgaaacactcaagataggctttatcacaagcaaatttgaacatgatacagaaaacaaatgcagcagtaaaaacacttccatttcttcaacaatagcatattatactcaatgcttgtgccgtacatatgacagagacagtcttagtaaaaagtgtgaacttttagtattacatttgttgtttatttcagtaaaccatgtgtgcatatttcaaattaggcagttttcaacataacgaatattagctggctacagtatatcaactaactatcgccctttgtttatgaaagattggaagctattttcaacatacaggtcttcctaaaatcattttggcatacagtcaatagtatattgccaagttagttcaaccacgtttcctgtttccatcattccatgtaatctatcctttttaagatttctttcactctgcaaaggtaaacgaatattaaaaagtgcacacacaaagcttgtgagcgagtagaggttgatagccaactccatcctacctaagcagatcctaacaacctgtaggctgcagcaaccaaaagaatccttgccagtactggcaaagtggcaagctctagtcaaccaatcaaaatgaaccaagggcgaacacaattattatatcgatgtactgttttcatgttccaagcactaggttcggtacgaacataatattcagtcagttgtttaccttttcagcttataaatactagcctaaatatcaattattatctgcaactcccaaaccaacatggtccatgtactgatatacaccataaatcagacttctctgatggctaacactcgcaagtttgagtcaaagcatcaacagtaccccggggtgaaacgctcttggattaatggaagtgcagaaaatcctttctttaactctcttttaatgaattaaataagtgcaacagtgattactcctgatgaccatactaattaactcccaaaatgtcagatttggacatactggccaaactcaatcgacgcttccaaaatttagaactgtaggatgtattaaaaaaggcagtcgtagtctaactacataaaaaaacatatttgccttaaaaaggcctttagcttgaattgaatgcaaacccactcatatgcatatattcctatctttttcaacatgtaaatacgaccaaacccttccaaagaatgagaagataacgaagtgcaggagagccactacaagtactactcctttaacacatcaacaaacacaaccataaaacgggaaattttgacgggatcattgcacttactcttggcatagatggcatcctgcagatccgcgaccttagcctgcaaaagaaaagaaaacaagaacccacgaatcaaacctcaacctcaaacctttccacgagatcttaaccccccccccccacccaagaaccaaaactccaaaccctcccccctacaaggctgcaacaccaaaacccataatccgcaccaaatttctcaatcaagaacctgacgagctcaaaaaaaaaaaacggaacgaatggagacgacataccgagtccttgagctcgacgccgcccctgaccacctcccggccgctccgggacacgacggacaccttcatcccgccgcccaccgcgagagagagagagagagctcgcgctgcggccgccgctgctgctgctgctgctcgtgcggtggagacgaggtggggatcggggagtggccggaggaggtgtatttgatcccgcgggggcaagaaggtgtggggcccacgggccgctgggccgttggacccaccggagttatgcgacgtatccggccctcttgattgtatggacccggtccatggacccccaaaagtaaaattcagtgtgcaaaaacacaccgtttgatcaccgattgctttcggttttgtcgaaatttggggttttgcgtatctagatcgtgctagtcatgactgagatttgcgtaaatctcttgttttctttaacagatttggatatcttcctgatcacaatagcatgatcgttcgtttagtctaaattgattgttcaatcacaagttcacaactaggcatatattcttccacatggatacatgtgctgaccaaaatgtgcaaagagtgtggcacgcattcctgaagcacacgctctttgtaccatcggtgagactctgtaattacctcctccacgcctagttcacactaaagtttgaaaatttggttgaaattggtacgatgtgatagaaaagttatgtgtatgaaagatttgatgtgatgacaagttgaaagtttgtaaaaaaaaaactttggaactaagcaagacctaaaaaagaacaacataaaagcaggaacttcgtgcaggaaatgctactaggaattaggaattaggatcaccattcttatcataatacaccatcatttgtgttgatcatctgcttaagaacttgcaataacactctgaaagcagtggttactagtaattgatagggccagtcatgtcagtaaaaaaacttgaggtggtgtatggacatggttcttcagagaaagatgtcggtacgatgcatggaggctgcgtcagggaaggagttaaggattgcagttgggaggtaggtcgcccaacgggcaccaacgccgcctgcaaaatcttccgtgctgtctgaaactctgaatctgtgatgcaaaaaattccctgaatagcgagacatttttttcttgtgaattgtgagatttcggaatgccagcaatggccgatccatcacgatcagttcggatcaagaatccatcaatggagactgttaccagtaggaaggtggagtacataactatcagcattcagcagatgctcgtgtggaaaattcagggttcattttacctgcatcataaataacaataattcatgtttatttgagatagttaaaattgatggattaaataaatagtttgatctttttatggctctcctacaaaatcaatcagatatttaacaagttattatgcgaaaatttatatattattttccacgaacacattgttgagaagctggtctagaataagaagagggtaagacgaaaattagtcattctcgtatgcttatttgattgttagccaactattggctccaattcatttatagctaatctaatagccaattaatataatagttagctataaaaatatactacatcattaatattcagtcctacctctcattcacatataacgtcttagagtccgtgttgcagctggctacaaatatgtaacccgctttcttctctctcttctcttttcttctcgatatgaggttatagatggcttatagcatgctattgtacctgctctaatgtgcaatgcatctccatgaatatttgtttgtatttaagtccttgtgtaatgctcaactcctgccaacaaatcttacaaagttttacatcaaggaccttggagtaaaacaatatattatatatacacccttgggcccacctgtcaacctctcaccctatattaagtaaggaaaaaaaaacctcctcttccctccacccgtccgcatcccaaattcccagcaccagcagcgcccgccgccgccgccgccgtcgccgtgccgagctctcctcctccgccagatccgcactagcggctcggttattctctccggcacgagagacgagggttccccggcgagcgagcgagggccggcgatggcggagccggagcagccggagttcgcgcgcgagcggcacgtgctgtttctggaggctatggcgtcggagctccccgcggactacgcctcgcaggaggtcaaccacctcaccctcgcctacttcgccgtcgccggcctatctctccttcgtgagctcgacagtgtaagatccccgctctccgcctgatctgccctagcggttatcctctcgatccgtttcctgaattacgcgtaaattcgtttttttttagttatttgttgaactctagtctagactagatgtgcccgtgtgcaaagcttggatctttactttaccttgtgtggtcgctttgcttgcatttagtggaagcaaagttgcatctgtaggaataaaatcaatcagcagatttggtgcacttatggtaccatgaagtattttgaaacctcaaggatggctattggtagtatattcagagataaattagttgctgtatccataatgggagttgcaattgatctttattgtgacaaacacagggatccaaagtttgtggatagcagaatgccaagtgtggaagggtcttttcaatttttttttttttggaattcctgtaaagaacaactactagctgcaaggtttaagcactttagcccataagtggtcactgaccagtaaccagtctactcaaagcagttagagattattgcggttaggcaatttgcatctgtccggcaactagatcacaatatcacataactacattcgctttcgatttctagccaaactaagaggaaaggggcccatgtgatgtttctgtagcaacgaattggtccacgtcccttaattcggtctaaattccattcgtctttgtcttgtccatgggcagttgccttaatgctctgcacagttaggagccgcctagttggttatgatttaagttcatcatacttgatgccttgctcatgtaaacaacaaaaacatgatagcctcctgatatctccattctcaaattactagtaacttctaaaaaaacttatagcctcatgcaaatatttttttaccagtcttatcatgaaaattgtacctgtatgtattatgtattaaaacaagtaaccatgcctggttgctagctgaaatatttattgtgggaatttaagttcactttgtgccttgactgagttgactcttcaggaagaagtaatatactgagttgactgagtagtaatttgatgagttgtgtacttgtttgcccttttatactttctttaggttaacaaggatcaaatagccaaatggattttgtcttttcaagtacatcctaagacagacaatgaattagataatggtgagttttcctcagtacttatgtaataaagctctcaagatagctaattcatatttttcagatgcaatatattcattatatgacaatttatatgtttttaggacaattttatggattctgtggctctagaacaactcagtttccctcaactaacatgaaggtagatgtggctaattctcaagtcaacccttttttttttcacacatatcaatttgtcatttaatttttacattctgacagtttgaaatatgaattcatgcccttcctcaggacccttgccacaatggtagtcatcttgcaagcacttattctgcccttgctatcctgaagattgtaggttatgatttagcaaacattgataacaaggttcttttgtcctcaatgagaaacctccaacagccagatggaaggtatgcattttagttttggtctccatgctaattattcttgtaattatcctccaaaaatatctatgcatttacatctgctacctgtgtttagttttaactgtaccaccaaaagagtttcagccaactcacattctgtcttaagatttcataataccccatagttggcccacctccttgattattttttgtatgtgttgattgctacctttccatttgcatatgttttctctgcatgaatttagtcatgccatgtcgttcgacaaacttgatattggtaaatacctcctttctggtatatctctgtattgttggtcagtcttcaagcttgttcaatcagaatgttaattaatgtgctgtgatcctaactgcatgcatgtgatagaggtgtttgtgcatgtgcaatgcaatcttgcttgcctgtgagcatttcattgatttcactaagatggcttccatggttccattctgcaaacaactaaactccacgcaccgcttaaatgcattatcttattggccaacttgagaagcattttttttttagcttcatgcctactcatattggtgcggaaacagacctacgctttgtatactgtgcaggtgggttgcactgtcatttatatttagtatgctttcaattttatctttgtttgaaataacttgacacacttgtgttgtcttctcagctgcaatctgctcgatgctaaaagattggacaggaatggacaaggaaaaggccaagcaatacattcttagttgccaggttggcttacaacaattcctgatgcacttggttttgagacaccagtgttttgcaccatgctatttaaaatccttaattcttgtttctaccacatgcagtcatacgatggtggctttggcttggttcctggttcagaatctcatggtacagcttcttttaacctttgatgtgcttcttgtcctactgagtttgtcatttcatgtggcagttttcttcagagtttcagaatgcaataattcagctaaatttttgttttatttttttggagtcggttatgggtactcattgtttgtctttgtgttagtgagtcaggtggagggacattctgtgctgttgcagctttgtgcctgatgggtttcattcaagttgatttggcatcaaatttacaagaaccatcatcaattgatgtacgcttgctcctggagtggtgtcttcaggttaaattctgctcaaccatatatatctgctattaccatcaaaatctgccctttgatgtgatttataggactaacatatatttccaaaactggacagacactatatgcagtacaccaacccgttttaaatgtttctaatttagtagatatatgcatcaaccattcaattttcatttattcatgatggagaagtgcagcttgctcaatgacaccacaccatccagttgtttttaaaatctcccttatgtagagtaaaaaaaatgtgaatcataaacggatttagttagaaatgattaataaggactaggacgactttactagtagggaatcttaactgttttcactattatcatatagagacaagcggcagacggaggttttcaaggaagaaggaacaaatccagtgacacatgctatgcattttggtaaatacaccattcagagttatatatactaattgcctgacaatcaaatagcaaacttgggtaatctgtcttgctgccaatcaacactctgcaggattggaggtgtcctaaagatcatcggtgcataccgcttcattgatcatggtgctttgcgaagttttttgctctattgccaatcacctgtaatgacttcctctctaatcagcttaatttctcacattgatcaagttgcatctttactgatcatgtatgcccttgtttaccattgcaacagtatggaggttttacaaagtttttgtacgatcaattcccggatatctaccattcttactatggacttgccgctctttccttgctggaagaggaagggctggagccactctgcaccgaactggggatcctctctgctgcattgtagcttggaattgattgttcatcttctgtattcagtcaagttatggtgttctttaaagtccattcttgtaatctaatacaacatacagctgaaaagaatgcaagtaatctatagagttcgtttgtttgtttgggtaggcaggtcatgcaacattgtcttggataatatgattgtgaagtacagaggagcattctgtaaaggctatttcattttcagttagtcgaactaactgatattctgatagacagttgagttggctgagcagttctatcacttggaaagctattgaaaacaactcatgtaacagctgaacaaaattatcatctttattctgtttcttgatgtgcttcctatgtatcactgattaattctggtagttgtagatgctgatatacacacacagacacacaatttcttttcttttgacaggccatcaggttaacagcataatacttgtgattgagaacagagagagaaatgagagatttttttttactgaacctgcgtgtctgaactcttctgaagataaaattgaaagttgcagtactgaactgaatttgcagcagatcacatggatgatattggcgggagagccggctcagtcagctgcagctgccataactgccaccgccacccccacatccactccgattcattgcgaattcagtttgatcagtggttggtcggttggccagcctcccatccaccggaattctcaaatcggagcaagcagcctactgattgcgattgcatcctctgatctgatctgctgatgcgaatgcgagcagtaatcaacagcgtagtagattcagtccacgcgcccattaaagccaagccactgtccttgtccatctttgtccaggcctcgcgttcctcggttcctcctcctccttgctagctgctgctgagtgctcggcgatgacgggcgtcgggtcggcggtgcggcggctctacctctccgtctacaactgggccgtcttcttcggatggtactccgccgcctcgcgccgccgccgcctgctggtgtttggatctctcgttttcttggcttgatttgggggggtttcttggatcttgcagggcgcaggtgctgtactacgcggtcacgacgctgctggagagcggccatgaggccgtctacgccgccgtcgagcggccgctgcagttcgcgcagaccgccgccttcttggaggtctggtttttctgctagtctgtgcgctctgacttatttctgaattttaatcgagtaaaactgtactccctccgtccaaaaaaaaaaaagacatacctgggtttccgtgtccaacgttcgactgtgtcagtcttatatgaaattttttataattagtatttttattgttgttcgataataaaacatgattaatacttatgcgtgacttattttttaaatttttttcataatttttttaaataagacggacggtcaaacgttggacacgaaaatccagggtttgtctttttttttttaatggagggagtaggttttagctcgagcttgtataatttgggcagctctgacttcattttgaattttccgtctacccaattagggttgctacctgttgagcaatggcacagagggaaaaaaaaattaatccccttttgcgttctaaaaatcaaccaaacatttagcctgagagaaatattaccagtgttatagcaaaatatactgcaattaattcaacttcattgttatgtttctgctgcctgatggtggggatcctctcccccgataattctgctaaaaagaaaagaaaaatttctgctgccctagcagtactttgtgttatattccttgtagttccctagataaggaagcatttatattctttgcacggagcggctgaacgagtccgcggtgaacatagaatgaacgaacattccatgtttatttcatttctttgtttttttcgccgggatggcgaagaatgccgaccgatgtatatttcatttctttgcaaattgtgttttgtgaggtactgagcatttttgtgtttgtttggcgatggcgttgctggtggctcagattcttcatgggcttgtaggtaagaagttgttcttctcttctacttatgttattttcactatcctggtcatcatttggaattgtacggttcctatctatagcgtgcagcacgcaaactccatggaaatagagtaatagactttctcgttagaaagcatgccaaagacatatttcaatttacaggaagtgtcctgttagattagagaaacaattgtaccttataattcacttttatgacacttctcatttttatcacctgtataacatgctgactttgttttaaaggtttggtgaggtctccagtctctgcaactcttccacaaattggatcaaggttgtttcttacctggggcatcctgtggagctttccagaggtatcatcgactatcactaataagtgttgacatgctacgttcatgctacttctcctaagcatttactgtttcgccgagacattgaaacatgacataattttgggtttaaagcattgtctaaatagaaaatacggatcatataatttgatttttatatgagggctggacactaggtagtttgtctgttttatgtctggttgtggatcaagtaaataatggtgatgattgtacaagttactaaatggcataactactggtactgatatgcaaatgcagtgtctttacttttgcatccctagttttctgttagttgtatgcttgtagtgtagcttaacacatggtttcatgacatatatattgattgatccctttgtacatttgtcttgcagacacattcacatatccttgttacttccttggtcataagctggtccatcactgaggtatattttgaagactcacttcttaaagagacacgacattttccaaattataattttgatttctcctgggctaagcttattcacaccaatatttaaaatattgtgcatttgatagcataacgtgatggaaatatttgtggttccttgtagatcattagatattccttctttggcatgaaggagacattcggatttgccccttcctggctcttatggctgaggttagtaaagaagatacatcattatttagcataaatttagagagaatgcttttctttttctttcataacttcttttcttaaacctggtgctgattttgtacaggtatagcacctttatggtattgtatcctactggtatcagcagtgaggtcggtttaatctacattgccttgccttacatgaaggtaacaagaatgaacttcagaaatgaagatctccatgttgttcaggctcattgcataatgcgtaatgcgtatttaactgctcctttcctgtgactgctatgcaggcaacagagaaatattgccttaggatgcccaacaaatggaacttctcctttgatttctcctatgcatccattctttctctcgccgtctacgtgcccggtatcccctcctgccttgcagtcgtcctttattcagtgattgaaattatttttataattgcaattgttgtttcttagtaactgggatttgataggttctgacaagaacactgcgttgcaggatcgcctcacatgttcacctacatgcttgcccaacggaagaaggcattggcaaaggctaaggctgcataatggtgatgctcaagagctttcttgaatttgtcacttgtggcttaaggatctgcctaaatagctcacatttgctactcttttagtagaagtctgtagatgaggacatgttggaaagaactactattacactgcccatcatttgttgtaactgtagtcttctaccaagaattctagattttacctggttaaattattgaatgattgatccaaaatttaccagcttgtttcaaattgcactctttttgcgtttgctgttagcctgttatgctgtatgttgcacactttgcactgcgtgctatagagaattggcatatttgcatatttactggtttgcaattatgagtcccattgtttcacttatgcttataaataaattgattttgtgattttctcttcacagcttattttacaacatttgcttttgaatcactaagagcacgaatataaaagtttttatgcataattatttttaaattgctaataagcggttcgagtaaacataaacataaaggcaaacgataaggccgtatgatttgaagtagttagctaaatttcttttgaaaaaaaaggagccaaatttcaaccttacaaaaaccatcgaaaacgctatgaaaaatcccccaaaaaataatttcatgcgcagttgattaacccgccgccgcacacgcctcccccgtactatccgacgcttctcttcagtaatctgtagtccatggccatgtcgtcctcgagcaggtcgtggcgctgctgtggctttgaatccatctgatgggatccgaggcgcagcgagtggcgtggatgggggcagttcgggatcggggacgcgacgccgacgcggatctgggtaagtcccctgcagcgaatctcgcaaaatctgcgtgcgaaaatgtggctgatggcatggatcatgcgcggattcagttggtctcgggtagtttcccggtgtgttcagattcagatcatgcgcagatattacccctgttacatcagctgccttgtttccagttcgttgaggcaatttgtggcactaactcaacacatgagcttgttgaaacagtattatcaattggaattcggagagttgctgatctctccctctccctgttcctcgtagctacattcttgctatccacgatggctgattgctattggttgttgatgttaactggacctcgatgcatacattacatgtttttgagatgcgtcagtcatgctctttgaggaatctatacacgtgttacctgttcttaggaataaagtaaagatacttcttttctgaagcctgataaaaaaaacatgacctttgaatcaagcttgtgatctcttggataacaaactctttctaccacctagttatgatttattaatatgacatggcttacatttacacaggtgaagatgaaaagagaaaaaagggaaaatgaagcagctgatgtatctgtcttcttcccttctttgttgtggcgaaatgtgttgatcacatggatgaattggttgggtggcggacagttgcagtagcaatgactgtcactttgtgctgccaactatttatttatccgatttgatcccccgatctgatgcttattaatcaattggaacagtggttagccttattcccttaatcccatccatgtctgaggaagctgct

SEQ ID NO: 26317 - DNA, 6251 bp, Oryza sativa
tttcattccacatggagattgagaggtgctaaacttttttgtgttttgctgcttggctggtgatggtattgctggtagtgcagattcttcattccattctaggtacgaagtcccccccccccttttttctttgtaaaaaaaaaagagaagaagtcattttcttcttcctaatatgttctttttgttatccttgtcaactgtgaattgtagttacctgctaggtatggctgtcttgttcaaactttatgttaacagactttctggctaaccctcaatctggaatgtagaaaatactaatgtagttcctgttagattgaactatttcctacaacaatattgcttatcactgtattatgaattgttgaaaaggattggtgaggtctccagtgtcttctactcttccacaaattactggaaggttgttcattacctggggcatcttgtggagctttcctgaggtaatatcagaccttactcaagttatttgatagtttttgtcttgaaaataagttttggattagaaaacacttgctaaaatgaaaaaaaaaagtatgttaggtaatgtttctgctattagaactaattttatactttcatttatgatcataatgactctgagtaagcactggacaaacctaagttgcagaaattgcacgagtaattgatgccattacatcgtgaaggataagatagttctcttccgttctgcaccccaagttttctattttctgtatttaaacttctaatcaagtaaccattgtttgtagacaatattggtgagttactgtgtgcatttgttttgcagacgcattctcatattcttgttacccccttgatcataagctggtccatcaccgaggtatgtgttgcccccaaaactagtcaccaaattactcgcttggtagaccatgaatttcagatgcaattttattataagatgataaacaacaattcttctttttgaaatgacagtagttaaacaacaactctgcttcttgaaatgacggtagttattgaagttgttgccttagtcgaacatagattatgatttttttttcttcatttcagagcataacttcgtggaaaatttactataattccttgcaggtcatcagatattccttctttggcataaaggaatcatttggatttacaccttcctggctcttatggcttaggttggttctagttgtaaacatatcacaatatgtattagcataagcttcgaaaaattgctcattatcttattagtaaattatcttaaaaaaaattgcttcactgttttcatactgatttcttcgcaggtacagcacctttatagtatgctatcctgttggtatggttagtgaggttggcctaatctatattgccttccctttcatgaaggtaacctgaataacttagaaaggaagagctctacctccatttgataagtgacaacaatcttgtttaaatgctcttttgttttggatgatcaatgtcaggcatctgagaaatactgcattgggatgcccaacaaatggaatttctccttcgactacttctatttctctacttttttgatggctttgtacgttccaggtagtattccatgcaattgtacttcatttattaattgatgctacgatcatgtactaggtttttttcaataggattttctgaaaggaaactaagtaagatttgatggcatactaccttgtttcatttcatgaatgcagtatttccatacttgttgcgccatatggttgcccagcggaagaaagccttgtcaaaggcaaaaaccacataactactcaagagttattttttgctgggtcggccaaaggttagccgaccaatttcattaagattttgggggaaaatacagtaaaatgttacaacggcattacaatgccacggtagccagggaaggaccccaaccaaccaagaacgagaaatgaaagcagggctaaaccccgcggacagtcatggcgattactcgcgaaatttgatttctgatttctgatcacaaccatggctcaggatgctaccatttctggaacaaagaagcaaaggttactagaatggaaatgctaaaatacaattatacaaggattatcttttcccttggtaaattagaatgtatgcaagtaccattctcatggcttgctaatggtgtgttgtaccaaatatgggcgtttccatctgtaaataaaattgtactccatagtccatatggatgctgaaaaatgatatttagatgttctgcttttcaaggatgaagaaggctactgtcaccatttgatttaccatattggatgtgatgaaatggggccagatcaatgaatggagacaactgcatccgatcattcttgattattattttttagatgagtcattcttgatttcttccttactcttatccatcgatccatccaactgctgaaatgtgtatcattttcacagattgtctaagccatatagtactagttggctgttgaatgataatggccttccgatgtatagcagcagaagcaaaggaggatcatatatgttgtctgaagattcatccccactcttaatgaaattggtcggccagcctttggccgacctggcaaaaaaacaaattgtctgaagaactgtagatctgttcttggagcattttggcccctgtgctctcacaataaagaagtatgcagacaatgtcatttagtatatttttatcgtaaatgttcctctagttgtgcactcaaaatactaggtgaaatcattagacaaatcatttttttaaaaagaaaatagtataatacaaaaagaaaaattgctcaagtgaccggcagcatcaggcctaaaatatcaccatagcgagattttcttccgtccttctttctggtaccggtcttcatccagctgttgattgctgaggggtacgatgggcatgaggcgctttcgcgtgtggtccgctatccatctctatctcgctatcccttctctatcccgtgcgctaacccttctgcatctcacgctaggtggggccgccgcacgacacgggagaaaaactcaaggaggagggcgaccccatccaccgcaccggttgcaggcacgcagcaaggccgaccccatctgcaatcatctcggaagcactgccgctgcatgagtcgtcaccgtggtcgtaggtgtcatcgccgcaaagggaaaaacaacaggggaagacgtcggggtcgagactcaaggctaatagatgcggcgcagccaaaaaatggatgccgccgccgccgtcgtattttccgccacgcgccgccgtcgggaacaagcctagggttttgctactctgcggcccttccccaactcgactaaaccttcctccgatccaaacatccttgcaaacgcgaaaatacgattatacccttccaccgttgctaactagagctacccaccccacgaccaagctaggacctcgaggtaccatgcaatcgtgaccattcgatcgggcatcaccaacggacaggattttagtacctcacagtactagtaccttgcggtacaaaaagaaggaccgaagcaatgctcttaaaagaagattaacttatgttacatcatgcctagccacaatggtcaacaattaccttagattacaaaaggtaaattagagagtgtcatcctcgctctagcttttacctagagcctagcctcctcgcgaatagccacgatgagcaatgtccagtccttgcctttccggttgaaaactctattgttaccagcatattgctcgtgtattgtaatggaattttaattaaagaaaattatcattaacatgttattaccatctcttaatttgtttaatttgttgtacatatttattactcacatatggactttttttaagctcacaatattttttttccttcccacaaaaaataaagagttgatgggagtagtcgatatgtgaccctctaaccccacatgtcatttatttttcttaaaaaaagttagagttggtagtggggtggtggcagaaccaccaccatcactattcctttttataaggagtatagatgctcctttcataacattcaagctagaagcgactaggatgaccaacatgtcgtatcctctcgggaaacaatcttctcccttgtggcgaaccatcccaagtcgaatgttggcttgttgggctgtgttatatcttctgagttgcacacctgcattgagtgctataaaatgacatatttactggtttgcaattaaggtgaactaaaattcttgtgaaaaaaacaagagcctcaatcctaaaaaaaaatcatccaaacggctatgagaaacccccaaacaacagtgcacggcacagaatcaccagtctgatcttgttgtctccataaaaaaaaattaaaaatatacatttttttcacttgattttatggaaatatacatgtttaaaatgaattagcagaaatataccattatcacagtggggtggtgcgaatttgccacgagttcacgtgatgagtgtgcaaactcgtaacgtgtttgtgatgtcatcacgagttcgtgcggtgagtacgcaaccttgtaggattaattcacttatcattatttttgtttaattaccattattagcaattaattaacaattattccatcaattaattcaccagaccgcattctctttttttttgctattattttcaaacatgtatatttattatgtaaaactggtgtgaaaaaaaagtatatatatatttttaaaaaaattggcggtttccatggccggcgaccgccaccacatctcctgctcctctcatgaagcaggtcgaggggcctcccatcggatctgggtaagcccgcgtctcgaatcttgcagaatctgcgtgcaacatgcgggtgatatgcacacaaatcttgcgttgatcttagttgaagatctcttcgttctcagtgtgttcttttgggtggtcagatcatgcacaaatttatatgtcctgaattcctgatggtgtggtagtagtgcgatttgactgcacgtcgactggtggatggatgagatattgagattatcctggtcaaagccattagccatgaatccatcatgttaaaagccaagcaccatctcgaagtcttcttcctcctccatctctcgcagctctgcaatggcagcggatggttcaatggtgcggaggctctacctctctatctacaattgggtcgccttcatcggatggtcagttcaactgcctactgtttgttgagtttctggatggatatcgattttttattttgagtttcatatattgatatagcaggagaaaaatacaaatctatagtcaggaaagaaaaacaaccacaccacgcgtctacaataacacactgccgcgagagtgaaaacattgccctctagcatctttgtttgctggccatttcatgggctggacagccagggtgttgttttttatcggggttctgaatttgatttggatcaatgcagggctcaggtgttgtgctacatgaccttggcattgctggataagggacatgaggccgtctatgctgccatcgagcgacctctgctgttcacgcagactgctgccatcttggaggtcctggtttttcctagttctttacctttatttatcagggagaattggagattgagaggtgtgctaaaatttttttgtgttctgttgtttgcctgatgatgttgttgctggtggtacagattcttcattccattgtaggtgagaaatctttttttcttttccttcgttgaaaagagacttgttttttcccccttctctgaatgttgttttttgtcatctttgccaactgagaagtgtagtttcctgcttggtatgtctgtcctgtgcaaactttatggaaacaggcttccaacccttaatctggattgtagagcatactgatatgttcaatgcctagatgacaaaacttcaacatgggctaccgcattctattattattatttttaaaattgtactacaaaagaaagggactaaaaaggatttctgattgagcctaaaaggctaattaccatctggtagctcttcattgttaggcggcctaaggtttactaccttgatgttgtgttttagttgttcatgctgaattagatcgtggtagatggtaagttctggtatgtgcacgataaaagatatgctgtaattttggtgaatgtgtctactttcacatttgtgcagtataatatgtagctcagcttacctctagcctccttttcaatcatttgagatcattatgataca

SEQ ID NO: 26318 - DNA, 9602 bp, Oryza sativa
cctggactagaaagcacttcttaaaataataaaacatactatcttttcaggttataagactttctagcactgcccacatgtgtctagattcattaacatctatatgaatgtgggcaatatgtctagattcattaacatctatatgaatgtgggcaatgctagaaagttttataatatgaaaagggggaagtagatgttaggtgatgttgcagctattagaaatatccatactttcatttatgatcataatcctctgagtaagcattggacaaaccaaagcggcagaaatggcataagtaataaagctgatgcaactacatcgtggaaaaggataaaacagtgctctttccttctgcgtcctactttcctacttcctatattttaacttctataatcaagtaattgttttgtttatgaacaatatcggtgaatcactgtccacatatgttttgcagacacagtcttatatttttgttacctccttgctcatatgctggtgcatcattgaggtatatgttactccctaaaacttttcaccaaattactcgcttggaagacgatgagtttcagatgaaattttattataagatgataaggaataattctgcttcttgaaatgacagtagttgttgaagttcctgaaagaaaatcccaagcttttggaagttcctgtgttgagcttagttgaacaagtattatgaaattttcttcacttcagagaatgaagtgaattactgattccttgcaggttaccagatattctttctatggcatgaaggagtcatttggatttacaccttcctggctcttatggcttaggttggttctggttgtaaacaaaccatactaatatgtagcataaacttcaaatgaaactcattatctgatcattgaattctcttaaaagtaattcttattattttcgtactgatttcttcgcaggtacagcaccttcatagcatgctttcctgttggtgtggttagtgagatttgcctagcctacactgttcttcctttcatgaaggtaactttgaataacttagaaaggaagagctccggttgcatttgataacaatcttgttcaaatgctcttttcttttgcatgagcaatatcaggcgtctgagaaatactgccttaggatgcccaacaaatggaatttctccttcaactacttctatgccaatgtctttttcatggctttttatgtcccaggtagtattttatttcctgcaattgtacttcatttagtaattgatgatataatcaagtatcttttttttttaaaaaaaaactaggatttgacggcacactgccttgctgtttcatttcatgaatgcagtggttccatacttgtttcaccatatgatcgcccagcggaagaaggccttgtcaaaggcaaaaaccacataactcttacagtgatagataaatttggggaatttactgtgtactattgacttagggtcaaggactacatataatgtatacaagagatgaaaagacacatataccctttaacacccccactcaaatgcaatgtgtatacaacaatacatttggaaggtacaactaaactaaaaccaaaatataagcttaaagatattgtcgaagcatgtaagtcttgatgattaagtaggaaagatgcatcccctcctcaatgaagtggacctcgaggctttcacaaactgttcttcagcccttggtaccatgaagccttcacaaattgttcttcggctcttcaaagatttggagtaggttgagacaatccagctccggtgggagctgctgttgttgttggtgatgatataaaagactcatacacttagacaaattgaagatatgaaattgacttggatagatttgacggataacagaagacttgaactgaactgaaggacagatatatactatagcagcaacaacctttttctccaaacagcaagcaaaagcaacaagtaggagatggcagcaaaagtggtaggcgaagatgacctcacacttagaggctgtagcgcccgttccgtcgtggcgcctagcggaaaaattatctcttaaaaaccctaattgcgaaattgtttccttgcttgttgtctagtgtccatgccatctcagatctcaaatccccgatctatcgtcgagttcaatcccgaatccaaatccttccaaatcaaatccctccacaaaagtctattttgcctcccccggggtcgatgggccgaatctctctcggcccacctcccccctccctcccggcgctctctctctctctctccctctctctctccctcctcctccgctctgcccgcgcgcgtgcgcgtgaccgctcgcgccgagcgcgctcccttcccctcgctctgcccgcgcgtgcgcgagcgccccctccccctcgctctccttgtgcccatccctggcgagctgcccgcccgcgaacccggcccccgcgcgccgttgttcgcgcacgcgcccgcgtggtcgtcgcccgcgtcgcgcctgcgccgtctgcgccgcccggccccgctgccctgccgcgcctgcagccgctcggccccgcagccagcgcgcgtgcccgagccgcgccactcaaaccgccgcgtctcccgttgcaagccgcgcgcgcgtgccgtggtggccgaccgcttggtcgccgccgtcgtcagcgcctgcccgcgcctgtcgcccgtgtcgccgctccgctccacaccgccccgccgtcatcgccgtcgtcatcgcctcagccccgccactccgcgcgcaagccgccaagggacggaggcagagccctcctccctctgccgcgacgcccccgctcccctcctccttttcccaaagcggcaaggaggcaagccccctttctctccctcattttcccctttttcctcccgccggcgtcatcctccctccgccctgtcgccgatttggacgcgagcgccgagcgccagctcgcgccttgaccgcccaaagtcggtttccaaaccgacattgccgccctttaaagccccgggcgccctccctctcttcttctctcgttgtcccatcgcctccactccattgttgccgcccctctgtttcgccgtcgccgttcgtcgttgcgcgcgtcggaggagccggcacgagcgaggacgcggaaggggactccgggcgctcgtctccttcctcttccccggcccgaggccggagagattactcccgagccgtcggcctctcgtcacagcgcccctcctcatctcggtagtgcctcccttcgttctccctcctcgctccatctctcccccttagttttcggtagtagcacgagtagcctccccgtagcaagccggcgccgccccgaccattgccgccgctcgccgtgtgctcgccgccgtcgccgcccgtgctccgtagcacccgctcgtcgccggcctcgctcggcgtagctccgctcaatccgacgctagcaacggattcccgtagccgcgtagatgctctcaccaccgggaattggcccctcgtgacctcgtcgccgttttccccttttgctctccgccggttaccgccgccgcaatccgccgccgacggactccctccggcgaatccaagccgttggctcgctccctctcattctccctcgtcatcccggtgtacgccccgtcacccctcatcgtcgcaagacgccccggagaaaccgccgccgcccgccgtccattcgcggccggcgccttcgtcttcctcccgccagcccgcgtggcagccacgtaggcgccacgtcggcgccagctcggccaaaatcgggtcgggccgaccccggtcagcccctcccatgcgcgcgttccaccgcgagccgtgaggctgcgcgtgggcccgccgcatccattccaccgcgaaccacgcgcgtgcaccacatcccttccccgcccacgcgcgtgcgccgcgtgctcgctccgcacggtgaaccgtgtcaccgacaagcggctcccacctgggaccacgcgtggtgagcccggtccaccggccctctccctcctcccctcccccgcgcgcgcgcttgggccgccttgggccggtccgctccatttcccttgggccgcgccctagccgcccgaggaaaagtctattttccctccctcttttcttttcttttcttttttttcaaaaaggatttaattaaatccttttcctttagaccaaaaatccaataatcttagaaattcaatatcttcccaaccgtaaatccgtttgactccgttcaacttccaaaattcatcaaatctcgagatctatctaatggcatgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttacttgaaaaatattatgcattgataggatcgcacttaatctgttgtcccgtctgcaaggcagattggcggacctacctaatttgttgcatttgatccttccttgttaattgttatgtcatgtccccttgtaaccatctagttgcgtctcgatattcgtgcatcctgtgcaagtatcgacggacgcctccaaacttaaaatctgaataacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaagggagccttgatgccgagagacatgtggattcgccggggtggtgtcggggaggacccctgggcttcctggcacagtatggtctgggacctaacctgttggtctgggacccctctcgtcggcatatgataaacctgtgttggctttggaaatgccttgtcatgaaagcttggaggtctcccgacgtggctaatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtcttgtttgactcttgcttgtgaaattgctgttgtggaaaggggttcgatgtttgaaagatctgcagctgatgggatcagctaggcccgggtggccgtttgaaagttgttggcccgggtggccgtttgaaaagttgttggccgggtgccaaccttgtttcaattctaaagactgatacattgcacatactccgaccggacgagacgcactgtctcatccgtgtcgtttgagaagcactcacttagttgttttcagaaaagagttcaaataaaatcaattgcaaaaacaacagcctttccttgaaacctatattaaacacttatttcccatggcttgctgagtactcccgtactcacccttgctctatataaataatccctcccccagttgctgaagaagatgaagcggaacctgctaatgaggagttcttccaggagcaagccgactacgatgagttttagggtttctgcctagttcccaagtcgcgcctgtgttgtttggtccaagtcctggcttccgtttcccttttgtaatgcagttgtgagctcgggatctgtccgcagcccaacatgactgtacctctactctataataaagagacctctattgctgtgatgatccgtcttcctgtgataccagcactgtttcctgggactggtatcgattaacaggttaatttggagcgtcacgggctagttccggtcggtactagttcggggcgtgacagaggccttggggaccaactatggtgatggccatgaccaatcactggcttggtaagacggtcttgcaaccaatgactgaggagcacatgagacggcgctagaggcactgccaccagcactggtactagaaggaccagcagcagtgatatccaagaaaacaggagcactagccgtcgcacgaggacgggggaccgctgcacgcctagctcgataatcagccaacttctctggatgaagatagaagcaatcatcggaaatatgtccaaccttcttgcaatgagagcaaatacgatcacttttggcgatggaactgaattcagggatcccgcccataggagctccaacacgctgaggtgctgccatgacattgtgagtaaccacaggagtaggagtagtgtccaaggaacaaagacgtgtctcctcagcgattagatctgcaagagcctccgccatagtaggacgtgtaggacgtccaagcaactgaactcgaatggactcaaattgagaggaaagtctcatgacaaattgatacactagattttcttgatcatgcttctctctcgccttgcattgtgcacaacctgaagcaccttttggagtctgtgcctcaagctgtccagacaaccgagtaaaggcattataaaattcttcaatggactgatcttgttgttgtaagttgtgcaaattctgcagcaaggaaaaacgcaaagctccgctttcttgagtgtacctctgtttgaggtagtcccacatctctttagcggttgagtgatccctgaaactcatccgaataggcacctctacactcatgaatatgaatcccataacacgatcatctgctgttttccacgccttaattttagttgcatccgttttctcatcaggaggatcatctgtgaggtgagatgcttgaccaatcgacctcaaaagcatacgagctgaaagttcccattcttgataattttgaccatttagcttaatgtccgtggagagcaaagctccacctccaagaaaggggtcggatgttgccatcaagaccagcagaagaaaatttgacaaattgactggacagagacttgcttgcaagacttgatgtattgtctcctgaattagcaccagcagcacacagcggcagcagtagtggaagagcagcaacaacggctgagcggaggaaccgcgtgacgagcggctgcaatgagcgatacactcacgcgtgatggacgaatcacactgacttgctgtgaatcccgctgctgatccggatgaggaggacgtgaagaagatttgcccgatagggagccgccgccggcaagccggagcgccggcggacgacggggatcgagggctagggtgtcacacccagaaattctcgaaccagaatttctaagctgaatgtgcattaaatccctatccaggaccagccagggtacataaacgacaattgttgacatacagacccacgtcttacaaaaatataaaagattacaaatgcagcgggaaagataaaagcgagctaaaccgggaagcttgacttcagcagcgggcaactccactccacaggcaaaccttgacggcagcgacgaaaccaacctctctgagacggctccaactgagaagaacttcaactctggtatgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataactgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaagatttcacccccacccctcaaaaggcagtgggcggtcccctcttgcgccgcggtgaatccggcagctggacaaccgaacacctcggccgacccaactccatcacgcctaccctcgccaccggtgcctaggaaagggtcgagctatacttcagatcaagcagttacctactcccgcttgtggtaagcacggtaagtctcccagggtttcccgtgaaccggtccttaactgccatgggtgcgaccagcaaaaccatacactcacagcccgccattcagaatattttaattaactgacacccttgcggtggcaccaatctaaagttatgccaatagtcagagtctatgtaataatgtgatccccatttgtgtcctagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaaccacggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggggggggggcggcgccgacaggcggggcccacgggtcagcggctcaaaggggagaggaagggggcgccggcatgtgggccccacgggcagtggctcaaggtggccggtctaccgtggaccgggaccacgcgggtggtccacggccggtccacgggaccgacggtccagatcggccgggaggccgatcggacggcacagcggcggctaggcacggctcggctcggcttcaaaaccggccggccggccatggcaaccggcggcgacgcgcacggtcgccggcgacggcaatcggcggcgcgggaagcgacggcggacggggtacaggacggcggcatcgaccgaaggcgatggcgagcgcgtggagagaggcggcgcaaacgagagagaggggaagagggaggaggaggggatcctcaccggcgagtatggcggccggagcggaggatgaaggtggcggcgacgacctggcgatgaggaggggcggacgggcggcggcggcacctacggagggagttgagaaggattaggagtagagagagtgaccacggcggccaccattgttggccggagacgaaggagaatggatagctcaccggtgtgcgaggagaaccgggctccggtggggtttagcggaaaccgagcggcggacgaggtggctcacgcggcggcaatgctaatgg

SEQ ID NO: 26319 - DNA, 2132 bp, Oryza sativa
acatggccgggaatccccctcgatttggccggtgacgtgggggagagagagagagtgggggggattcaaatcgaatcccgcccatttgcgggcgcgcgtgcgggcgggaatggcggggagggcggcgacgtggggacgcggagtgggggcgcggcgtggagcggagaaggcggcggcgcggacggtttcggcggcggttgccgtcgtggggcgggcggctggaggaaggggacgacacctgtcagcgtcccggagagaggggaaagggaaacgggccggcccaaaggaaggaggctgaacgcgggagggagtgggccgacggcccaatagagaaaaaagaaggaaaagaaaaagaaaaagaagaaaggatttttcctgggatttaaaattgcactttggtgatttttaattggttaaaattatttccaaggctctgaaaattccactaaaaatcttattaatgcattggagcatggggaactcaagaaaaattccaccacgctatttccgattattaattgcatttattaactagggatttagctctaggttaattaagataatttcttcgggcaatttatttaaccaatttttaaagcaagaaaaggggggaaacttcagggtgtgacatagggttcagcccatgagctctgataccagtgatagataaatttggggaatttgctgtgtactattgacttagggtcaaggaccacatataatgtatacaagagatgaaaagacacatataccctttaacaataactactcaagagctatggaatctgatttcttatcgaagctacggctcaggttgctaccatttcctgaataaagaagtaaaggttactactagaatggaaatgctaaaatacacggattatcttttcccttggtaaaaaagaatgacttgctaatggtgtgttgtaccaaacataagcttttttttttcccatctgaaggaaaaatatgtactcccggccggagaaaaaaaattgtactactctatatcaatgccgaaaaatgatgtttagatgttcggcttttcaaggatgaagaagaagtgtcaccatttgatttacattgatgtgcagtaactgtcagtgaaaggagccaattgcgtctgatcattcttgatttcttcctactcttatccatggacccatccgattgctcaaatgtgtaaagccttttttttttttttttttttttttttttttgcagattgttaagccatagttggctgttgaatgagaatggccttccaatgtatagacagggtttaccttttcgtttttaaagtgaaaattgttcctcgctagtttactgaaaaccgatccaaaattggtaaaaatcaatgactttcggtcaacacggtacggctgatgtcgatagcagataagggcagtgaagcatatcttttgtttgaaaaactgttggagcattgtgccccctatgctctcataagtaatactaataaagtatttcctccgtctttaaatatattaatctaatagtactacattagacacaactattgttaatgggtctactctagtaccgtgatgctcaattttaggatggaaggagtatgcaaacaatgccacttttatttttatcatagcatacatgttctatttgtgcactcaaaatacccggtgaagtaattttcttaaaagaacacctttttgaaaagaaaataataaatactccgtacaaaagaaacctagggcctgttcacttagatgctattttcaaccttaccaaattttagtaaagttacaaaaaaaaaatggttacatttagtttgctaccaaattttggtaactacataagaaatcctgccaaaattttggtaagttgccaaaattttagcaacaatgccaaattttggtaaggttttttttgacatcaaagtaaacaagcccctaattaccctacctatcgtcagcattaggcccaaatacggcagtagcattcctggcccatacagaatttaggcccataacttgggcttccagtcgcacgcggcccacagcccatattggtgtggagtcaaatttgtcatctgtgccgcacatctgtgatcgaacgtctcgtggagcccattgtcggtattactgacaggtggg

SEQ ID NO: 26320 - DNA, 3816 bp, Oryza sativa
aggtaatatcaggaccttactcccaagttattagatagtttctatcttcaaaacaagttctggattagaaagcacttcttaaaatgacaaaacatactatatgttaggtaatgtttcagctattagaacatatcccatactttcgtaatgactctgagtaggcattggtcaaaccaaagcggcagaaattgcataagtaatgaagctgatgcaatcacattgtggagaaggataaaatagtgtcctttccttccgcagcatcctagtttcctatttcctgtattttaacttctcatcaagtaattgttttgtttataaacaatatcggtgaatcactgtccacatgttttgcagatacacactcatatttttgttacctccttgctcataagctggtgcatcactgaggtatgttactccctaaaacttttgaccaaattactcacttggaagaccatgaattttggatgcaattttattataattctgcttcttaaaatgatagtagttgttttcctgaaagaaaatgccaagctttgaaagttcctgttttgagcttagctgaacaaagattatgaaaatttcttcactacagagcatgactttgtagaaaaaaaaacttattccttgcaggttaccagatattctttcaatggcatgaaggagtcatttggatttacaccttcctggctcttatggcttaggttggttctagctgtaaacagatcataatatgtagcgcaaacttcaaatgaaactcattatctgtgaattctcttaaaaataagtacttattattttcatactgatttctttgcaggtacagcaccttcatagtatgctttcctattggtatggttagtgaggttggcctagtctacattgttgttcctttcatgaaggtaatttgaataacttagtagaaaggaagagctccgcctccatttgataacaatcttgtttagaaactattttcttttggatgagcaatatcaggcatctgagaaatactgccttaggatgcccaacaaatggaatttctccatcaaatacttctatgcctctgtctttttcatggctttgtatgccccaggtagtatttcccttcaattatacttcatttagtaattgattatataacctagtagtttttcttaaagaaagttagctgtaggattttctgaaaggaaatcaagtaggatttgctaactcactgtcagtgccttgttgtttcatttggatgagtgcagtatacccgcacttgttccactatttgatcgtccagcggaagaaggccttggcaaaatcaaaaaccacataactactcaagagctatctaatctggtttctgctcgcagctacagctcaggttgctaccacttcttgaacaaagaagtaaaaatgtattagaatggaaatgccgaactacacagactatcttttcccttggtaaataaaaatggacatgagtactattttcatgatttgttaatggtgtgttgtaccaaactttggcttttccatatgtaaataaaattgcactccatatcgatgccaaaaaatgatgtgtagattttctgcttttcaaggatgaagaaggttgctatcaccatttgattcatattggtgccctgtaactgtttctggatattatttcatgaaagtaggggtggatcagtgaaaggagccaattgcatctgacattgtcacactgatatcgtggatcatccaaatgctgaaatgtttaagcctttacagattgtcaaagaaacactacctctgtttcaggttataagactttctagcattacccacatttacatagatgttaataaatctaaacacacatatatctctctctctctctctatatatatatatatataagcaatgctagaaagtcttataatatgaaacggacgaagtagttggttgttgtcaaactaggatttgacggcacactgccttgctgtttcatttcgtgaatgcagtggttccatacttgtttcaccatatgatatgatcgcgcagcggaagaaggccttgtcaaaggcaaaaaccacataactactcaagagctatggaatctgatttcttatcgaagctacggctcaggttgctaccatttcctgaataaagaagtaaaggttactactagaatggaaatgctaaaatacacggattatcttttcccttggtaaagaaaagaatgacttgctaatggtgtgttgtaccaaacataagcatttttcctatctgaagaaaaaaattgtactccatatcaatgccgaaaaatgatgcttagatgatgccaaaaaattgtactccatgtacaggtgaagaagaacagggaaaaaacgaagctgaatgagaaagagaagttgtatacttgtaatcacgtgctatcttttcgctgttgcaatgaaatttcctgatcacatattcacatgaatcatatcggcagtttggcgagcagttgcagtgggaataggctgtgtttgttcacactgaaattggaagtttgattgaaattgggacgatgtgtcatgtgacggaaaagttagaagtttatgtgtgtagaaaagttttgatgtgatggaaaagttgaaagtttggaaaaaaaaactttggaactaaacagggcctaagttcaaccgtgcgctgctcaaccatctgtccagttcaatctccattgaatgccaaatcaattggtactgtggctacaaattgattgctacaatcccgatccgagcgagtcattccctagatgttgaaatcgatctccactgcaatgccaaatcaattttctgatcacatattcacatgaatcatattggcagtttggcgagcagttgcagtggcaataagttcaactcgtgcgctgctcaaccatctgtccagttaaatctccactgaatgccaaatcaatttgaactgtggctacaaattgattgctacaatcccaatccgagcaagtcactaccaagatgttgaattctatctccactgcaatgccaaatcaatttggacagtgactaacttgactccaatcccgatccgagctagtcactatcaagatgctgatagtatttaagagcttctgatgcgtgtacatcaattggctgaggaatctgggattctagtcaactgttaaagcctcaattggttcacgttaaagctaagctcattttggcgtgttgtggtaaacttatttggcatacgagagcgccgtcaaagttaagttttttatgtagttggcggagaaaggccgttgtctgacggctgacaacctgagtaagcgcggatgattgcaccagcgagtttgctcactttgcatgagcagcgatgaggactgtgagcatctttttgtttcctgccctatgatcaagggttgggctggaattggcttccaactgccggctgaaacgcggcaaggacttcggaccagctacaagggcgctttcgacactctggtgttgcttgtctgctggatagttttgaaggagggaaacgcacatgttttccataatcagagccaagctctagctcagctcccaactacaacttatctagagccggagctgtgccaaacagtccagattctctatttttaggagcggagttggcagagctgctccacaaaattgtactatgggggtggagctgggtttttgctgctttacaactctactccaccccaaaagacccactaccctttaaaatttcagtgtatttacaccaaaatgccattgaactaccccttcctagttcctaccccatctcctcccgttctctctcctcatcctccttcctcgg

SEQ ID NO: 26321 - DNA, 10468 bp, Oryza sativa
caagcagcggcggcggtgcgcgggctgagaagcgggggcggcgacggggcgcgggctgagcagcggcggcggcggctgcgcgcgagcggtggcgcagggtcggcggcgcgcggccggcgcgcgtgctgtggcggcggcggcgcgcggccggcgcgcgtgctgtggcggcggcggcgcgcggccggcgcgcgtgctgtggcggcggcggcgcgcggtcggcacgcgtgcggggtcggcggcagcggcgaccggcgagcagaccgccgacggtgggacaggcggcggcatcggtggagcatgggctgagcagcagctgcgacgcctaccaggtgttcggtaaaatgacaacaagggatgtggtggagtggagctaaccaatctagccagacactttctattccattggagttgagagttggagtttggagtcctaccaaacaaggtctaagttgaagccattttttaacacttaacacatgaattagataaacagtattagcagttcgatgttggggagttgttaatgtgaactgttcttcagaagtagtacatgtctatgtatgttaccacttacgatggttgttgatgttaactggacctcgattcatacatgctattgagctgcttctttatactttttccttttcgaacatatctatacatgtttttatctgttcttgagaatatagtaaaggaacttcttttccgaggactgattaaaagaacatgaccttatatacaccttatggaaagaaataatcaaggcaaaccaggtaaacttgtcaactcacggtattggaccagtctggttcgcggtttgtgcatacaccttatggaaagcacgcaacagcagggttttcgacaagcttcacacttcgctacacctcttgctgcagcaaatacagagctccctcgaactatggactcatcgagctaaaggaattaccaagtctaagattgagtcttggtgtcaactcctacaattagatccttaatatgtaaatgccacttgtaatttttgtaatttattttctcctcctttctatttgttctttttcttttttaactttgtaccacctcatttctatagatgaaatggctataaagtagagccagctctaccttcttccgtcaaaaagaaagaacatgacctttgaatcaagcttgttaacgaacttttcctgccacctagttatgagtataatatggcttacatttacaccggtgaaaatgaaaatgagaaaagaaaaggcacaatgagaaacaacagatgatatcctatctttctatatatatatatatatatagagttagtacccactaagaaacatttactcctataaagaaagacatgcaagtagccacatcatcaataattttaagctattggatcgcattagtatagagttatcaaccgttggatcaagaagctagctactcatccatctaatttaatcattgattattcatccattcacctccctttagctcataatcgcgcgtgacattgttatccagtgtgcacatccaaatcctcaaagataatactactctttttcaaaaaaaaaatacaactccaattattatataagatgtgagctttgttttgttataaacaattggataacatacaataattagatatcattaatccaaactcatttttgaaacatgcttgagatgaagcagataagtgctacacaaccttattgtgacgatatccaaattgtacatgaaaataactttcatatatcataacaatacacaatgatgtttcaaaaaataaaacatgaattgtattgttataacagaagctatataaaaagccgcattataatctattttgtatatacacagagttacatctaatcatttaaagcattgatttgtgcggggtgccaactagtatttattatgttctgttcttgtttgttgtgacgaaggccctatttggctaatgggatagggaaataatttcccacccactaaaagacatctttaaatcttaaccattcattctccctcttctatttaatactaacccttcattcatttctcaatctcaatcccaccccacatttcccattatccaaacacacccgaaatgttttgatcacatggacgaaattggcggggtagctggcagttttagtagcattaactgccaactgtccgctgctaatctgatttgatccaaattatgtggttattaatcaaatcccatagccccataaatacataatccccaaccggtaagatgctcaaacttgtatcttggtgcttctgatgttgcgatagtgtgatgcttgtacatcttggaggagtagagtatcccggtcaaagccatcagccatctcgacgttttcttccatctcgcatatttcctgcaatggcagggaatgcgtcaggggtgcggaggctctacctctctctctacaactggattgtcttcatcggatggtaacttgttgacgccatgtttagttccaaaatatttttttaaactttcagtttttctatcacatcaaaactttcctacacaaacaaacttttaattttttcgtcacatcgttccaatttcaaccaaactttcaattttgatgtgaactaaacacagcctgacttatgcatgaatatcgatctcacttctactccatccgttagttttgactttttttagtcaaacatttttaagtttgatcaagcttagagaaaaatatagtaacattttcaacacaaaacaaacatactattaaaatatattcaatattgtatttaatgaaactaatttagtgtgatagatgttactaaatttttatataaacttggtcaaatctaaaaaaaagtttgactagaaaaaaaagataaaataacggagggagtaacatctttgtttgctggccaattcttttggattgtacagggtgttgttttgatcaaggctctttgatttggatcatgcagggttcaggtgtcgtggttcatgatattggcattgctgaagaacggatatgaggccgtgtatgctgccgtagagcagcatctgctgttcgcgcagactgctgcaatcatggaggtttgtttctttttttctcttgttgcctttattgtagtaaaactgtaaatttgaatgcagttgtacaaccattttgtttcattgctcatggagattgagaggtgctaaactttttatgttctgctgtttgcctggtgatggtgatgctggtagcgcagattcttcattccattgtaggtgagatatactttgtctctttataaagaaaataagtcttattttctttccaatacgttgtattttcaacaaggggtaccacattaaatttcattttgaaccttttactgcaaaaagaagggattaaaaatgatacgtgattgagcctaaaagcctaataagaatctgggggctcttcatggtggaaattgttagtcatgcaaacacattaggcctaagggctaccttgatattgtttcttagtttttcatactgaattagatcgtggtagatggtagtttctggtgtgtgcacaacaaaagatatgctgttcagaatatacatttatcaaaactacagcatatctgaaactgaaagtatatacatttttcatactgaattagatagtggtagatggtaatttctggtatctgcacaacgtagggtatgcgcacaataaaattctatactttcacatttgtgcagtgtaatatgtatcctctagcctctttttcattcacttgaaatcattatgataccaacaatagcctggaaacattacatatccatctcagagcagcgtcaaaaaaattgacagtacaacgcccgcgtcactcgccctagggcgacacgggcggcgacaccgcgcgcgccgccacaaacttctcctcctcccctccgcctcgccgccgcccgagcagccgccggcaaagccgtgcggcggcaaggatggcggcggcggggccttctccctctctcgagaagcgcggctggggcaccggcgggacccgagcgaagcggacggcggcgacagtgtccggcgccatctgggccaaatgcggcggatccggctccgccggaggtggatctggccctgtcgcggccagatcgggaggggcatgccgctcctggcaggaggcggcgtgggaggcggcgaccgcgaccgttggtgggggggacgacggatccggccactctggcggcagatccagtccccccggatggctgcggccggcaggcggaggtggccgacgccgaggaggtttgcggcggaaggcagtggcgacggcgaccgacggagaagcgagggcggcgacggcgaccgacggagtcgagagggcggcaacagcagccgacggagacgcgtaggcggcggcagcggctggtcggcgggaccggcgacggcgtgcatggcgcgacgcgcgcgagatccggtgatgctggaggcggggtgggagatggtggcagggcacggtggcggtgctggcggcggggtgggggctggtggcggggctgagtggtggcggcggtggagcttggtggtgatggcggcggcggagcccaagctgcggtgggcagccaacgccgcgcgacagctgggcgtctggcttcccccgggcaagatccgatcccctccaccggatttggggcgagagcatcgtgcttcggtggacgttctagtgccgcgtcattttggacggcgggtgcactgtggcggaggggtcaacagcacggtgcggagggtggcatggcgccggtgtaacggtctggtggtccgaggtgacatggacaacggattcgtggcggagccggcggttactctgtcagggggagccgcggtcctctcgacgtgcaccttcctagacatatgtcctcttgcgacggcgactttgtcggcaaaagttggccacgtcgtgcgggctagtgtgggggagagggcatccattcttctctctcaccctctccccatccaacccaactgcgtggatggagccggtgtgtgtcgaggttcgagcttccccatggcgattgactggcggcgtggtgccggtgcggtggccatgcgtcgaaggttttcgctggtggtggctgcggagcgtgtaggagttcagttcttgggagagacaaattttgggcgaaagctctgccttcgagccggcaacaacgacgcctgtgggtgccgttttttcctcttggggtgttgccgcttttcttgtctctcccaattactttcttcaggtgaaaaccttgtcctggccctccgggacaggcgacagcggcacttttggtgtcgtacccttcttgaaggtgtcgtctcgaagaccttcagttttgctcatgcagtgggttttgttgtagacgcgcggtgtggttgtattttctttttttgtctgtggtcttctaggactatagattgtatttttctcctgctttatcaatacatgaaactcgcactgtcttgtgtggctcgtttcaaaaacaatagcctggaatttaaataaatcaagagaagtttcagttttgagaaaatcgtcttgttaacttcttcctaaagagagaaaggaagtgtcctgttagactcaattatttcccccaaaaaaattattgcttattactgtatctgagttgttaaaaaggtttggtgaggtctccagtgccttctactgttctacaagttactggaaggttgttcatgatctggggcatcttgtggagcttccctgaggtaatatcaggaccttactccaagttataagaaggtttatatcttaaaaacaagttctggattagaaagcacttcttagaatgacaaaacattgatgttaggtaatgttgcagctataagagcatatcccatactttcatttatggtcataatggctctagtaggcattggataaaccgaagctgctgaaattgcttaagtaatgaagctgttgcaattaattacatcatggataaggacaaaatagtgctcttttcttctgcatcctagtttcctattccatgtattttatcttctaatcaatcagaggattgttttgtttataaacaatatcggtgaatcactgtccacatgttttgcagacacactctcatatccttgttacctccttgatcatatgctggtgcatcactgaggtatacgctactccctaaaacctttcaccaaattactcacttggaagatcatgaatttcggatgcaattttattatagttctgcttcttgaaatgacagtagttgttgaaattcttgaaagaaaattcctggtcgcgtcagctgcctcctgtgcagctgtcccttcccccgacagaggagagagtttgggagacaaagaccctgtttagatgggactaaaacttgttagtcctatcacatcagatgtttggacactaattataaatatttaacgtagactattaataaaaacctattctataaccctagactaattcgcgagacgaatctattgagcctaattaatccataattagcctatgtgatgctacagtaaacatacgctaattatggattaattagggcagccacaatgtggctataagaagaggccataaggttttatagtgaccatatacattgtgaaacaaagccataaggcattaaatgcaaaagaaagctttaagcttatggcttgaccacaagcaataaaataatagggtaaaatgaatgtgaggatgaaaaatttgcatggctgataaaagaagtactagaatagtacattgtgggacccatcttaaagtttactcttacttcaaacattgtggtaataaccataagaatagtgggacccaccttaatgctacttatgattataaacattggagatgcccttaggcttaaaaaatttgtcacgcgaattagctctcatttatgtaattagttttataagtagtctatatttaatacttcaaattcatccgatatgacagggactagtttagtccctgatccaaacaccaccaaaatccttgtctcttccctcaactcagtcaccgatgttgatgcggtggcctcttctgtggggcccctgttcagatcacaaccgtcttctgattcgcttcaaagcccctgcaaagctagcccctgtcgagatgcttcttttgagctgtgctggcaggcggagcatgtgcccccatccggtgcacatgttccgatgtgggatgaggctacgcgctgggatggcgtcgaggctagggatggcaatcgggcgtgacgggcacgggtagtgcctacccatacccatgcccgtgagattatttgtgcccgtgggtatacccattactacatgacgggtaaggatggttgcctattcccattgcccgcgggcgccttatgcccgcgggcgtgcctgtttacccgccacaacaaaagcagtggaacaaaaagtctacaagcttctaagttcgaatcgaacttaaaacatcaaatattctccgcctcggtgtcgggtctctcctctggcggcgatagagtaaggggagagaaataataaggggaataaaagggaaaccgtagaaaacaaagaacgtggcttatatattctagtggattttgctcctagcctacatgtaagttagatttcgcgggtaaacgggcaaagcgggcatgggtagtgattacctatacccatgcccatttacccatcgggcataacttttgacccaataagatacccacgggtataaaatggagaacaaacccaaccctaatagggtttttacccacaggtaaacgggcaaatgggcacaattgccatccctagtcgaggctaaggcttccaagggagatgcggtctgggccgggccagatcgcctttctccagtggttgtgcctagcccagtcaggcccagttcaccagtccaggatgatttgggctcgggacagcccaacaccctactggaccaagcggctgaggcctctgaaccagcccagcatgaagtggtcgttccttcctttgggccagcggttggaggcggcctgctcggatgacaagtcgcactggagccggcccagcatggtggtgttcacgtgccaaccaccgaggcgccccctgatcaagtcgctgcgacgccaaccccgccgggctctccgcaaccggatccattgatcaccttctctaggcgcaccaagattagaaggcgatccctgccccacttctcccgccgctgccaacgccgcctgcatcggtcatgcctgctacccccttcacgcctcgccggagtgagcggcaggtggttcaagcactccatggagctccaacaatattaatgtcaaggtgccaggtggttttggcgaaaaagcttgaggttgatgcagacgatgtaccgcctcttcctccacagccgaccaataatgcactccagcagtatacggagatctttgacaatgagctcagtatcgaccatctcttagacatcagcttgccggggcccgcaggccagctagcgcgctgatggcgccggcgtccgtggtgcaggccgcttgagagcttcgttgtcaggtcgcatcaatcgcgtcccatgacgagtttcaacttcaacttccttgtctggaatgtgcatgggtttaaacgaccgcgcacaccgggatgctgttcggtcggtgattgtagatgctcgttgttcggtcgtgtgtctgaacttgatgctacacaattaattcctaagtgctaatctatcagactttctctatttgcgtgggacagctcggtcgtcagttgtgacagccccacgatgggagaattctcccttactgcacatctttcttttattgatggtagctcgcactctatttccttactggtaactcgaggccgacaaactgcggttcctactagagttacgatcaatccgaagcagccattcgggaccgtgggtggtggtcggagactttaacctgatttaccaagatcaggacaagagcaatgcaaacttaaacaggcgtttgatgggtcattttcgcagggccatcaatgatctatctctccatgagcttcacccgaatggtcgctccttcacctggtcgaatggttggttgaacccaacgctggaacgccttgacagggtgttctacacaaccgactaggaggatgtatttccccaatgcttccttaaagctctcccgtccacggtctcggatcattgcccgctttttctatccaccttccctttcgcaccctagaggaggtcggttccactttgagagtttttggtgcacgcttgaaggattaaattccatgaggttatacaagatgcctggtcattgccttgccacattgccgacccgatcagcaggcttgacagcaagctgagaacaacggccaaaaaactaaggagttggagcgacaaaaaggtcggaaatatgaaattgcaaatggaaatggcaagagaactgattggcagatttgatagagtagaggaatgtttgccctgtccccttcggagagatactttcacaagagcttaaagttgaaataccttgcgctggcctccttggagcgaacgatggcccgtcagcactctcggatttcgtggctgcaggaaggtgatgccaacatgtacacgcttctttcaccagcatgcgacgtcccatcgacggcgcaacttcatccaacaactagaacacaacggtcaggtagcaacctcacctgacgagaaggccgtgctggttcttgcatttgctcgactcctctccttcaagatcctttgctctcatccttgattttctagtcgagagggggaaacctctaccccagttggaagccccgttctcagatgaggaagtgtgggttgctgtaaaagatacatcgcgtgacaaagcgccggggccggatggtttcacaggacaattctaccaaacctgctagttgatcatctgcgaggatgttatggcagcgttgcagcagctccatcgcatggacgggtccagttttggaaaggtgaacacggctctcctcacgttgttgcctaaaacacaagacgccaggaaattgaaggattttcaccccatcagtctggtgcatagcgttgcgaaactatttacgaagatcctctcccgccggctagcccccattctgaactccttggtcgcacagaaccagagctcgttcatcaaaaaacggtgcatccatgacaatttcatgcttgttcgccaatctgcaaagaagcttcatcagagaaaacagtcggcgcttcttcttgttggttgtctggagtccaggcagctaatagctatggtggtggacgttgggggcaattggacatcctgagtgtctgtcagtaaatgaactctcatttcaccaatggctatgcagcagccgaatgatcattcgagagccattgcgtcggggttttgacacggtggtcacgctagtggcatggacgatttggaaagaatgcaacggccgggttttcaatcagcaacaaaggacct

SEQ ID NO: 26322 - DNA, 5876 bp, Oryza sativa
ttccttgcaggttaccagatattctttccatggcatgaaggagtcatttggatttacaccttcctggctcttttggcttaggttggttctagtcgtaaacaaatcataatatgtagcataaacttcaaatgaaactcgttatctgatcagcgaattctcttaaaaatatgttgctgttacttccgtactgatttctttgcaggtacagcaccttcatagtatgctttcctgttggtatggtttgtgaggttgtcctaatctacattgctcttcctttcatggagatgaaggtaacttgaataacttagaaaggaagatcaacgcctccatttcataatgaatcttgtttaaatgctcttttcttttgcatgagcaatatcaggctcaacaatatcaggcatctgagaaatccgacaaatggagtttctccttcaactacttctatgccaatctctttttcatggcttcgtttgccacaggtagtatttccatgggattgtacttcatttagtaatcgatgctataacctagtttttttttttaagaaaaggtagttgtaggaattttataaaggaaaacaagtaggatttgttaacacactgcagtgttgtttcatttggatgagtgcagtatatccagtcttgtttcgctacttgatcgccctgcggaagaaggccttggcaaaagcaaaaccacataactactgaagagctatctaatctgatttctgctcgcagctacagctcaggttgctaccgtttcttcagcaaataagtaaaagtgtattagaatggaaatgccgaaatacatggactatcttttcccttggtaaataaaaatgtacacgagtaccattttcatgatttgctaattaatggtgtgttgtaccaaactttggcttttccatatgtaaataaaattgcactccgtatcgatgccaaaaaatgatgtgtagattttctgcttttcaaggatgaagaaggttactatcaccatttgattcatgttggtgccctgtaactgtttctgaatattatttcatgaaagtaggggtggatcaatgaaaggagccaattgcatctgacattgtcacattgatatcgtgaatcatccaaatgctaaaatgtttaagcctttgcagattgtcaaagatatagttggttgttgcatgagattggccttccgatgtatagcagcaaaagcaatgaagcatcatatcttgtctgaagaatgtagatctgttattgggacacaatagatctgttatcggggcattgtgccccctgttctctcacaataaagaagtatgcaaataatgccccttatgtttttatataatacgagtatgcagatggccctgttcttttctgcttaacacttaaacggataaatggatgaatgtgcatgcttcccgaacttctaaatggcgggttcagctttttgaacttctaaattgtgggcctagctttttgaacttgtatattcgaaatgacaggggtaaaaaaaaattgttcatacacctaatagcctaaaaattagcttgtatagtataacacactaataattataatatatactagcgtatataacataaaatttgataagattgaagacaccatgttgttgttctatttgaatgactgcaggatttccatggcctgatgttctgatgttctgctatattgtggcccaaaggaagaaggccttctcaaaagcaaaaattgcataatatgctcatgagctttgtagatccgattatccattatctagtgttgtttctggatgcagctaatggcttgctaatagtatgttgtaccaatgactagcttctccgttcctaacataaaatgtactggtcttgtacttaaactctgggtgatcttttatatttcgatgttgtgcttgtcaagaacccagaaggatactagtaccgtcatttgctttaggtcgatgtgtagttactgttctcatctgaaaaaggatgacatgaagtgagaggaagatcagttgaaagggagccaataagccaattgcatctctccatacctagattttgccctctgcagttggtaagctgtgcctttcttccacctctccctttcatcagtccatccagttgctgaaaagttgccaaagtgatgcttttctttttcgcctggtgtacttttctctcatcagctccgtgttgcctttccagattgtcctcgccatctagttagtggcaccataattacattgatgccacatgctttctcaactggcagtatgtgtgcatcatcctaacagctattatcactatacttatcttctgttctgtttacactttacgcgtgacatgctgactggtgaattatactggagtattttgtttatttgtttgtttgttttaccttttctttgtttgagtctctaagtgttatcaccatttgtgtgatattttgattgattcatggtatcttctgttatctttttaaactgtctaattgtctatttttgtgcttgacaaaaatcctatgtaactaagtatgtatgcagtcgctaaacaaatgtgaaatggagatagagaagaactcaaatttaaacagtggagacggatcgatcagctgagagccaaaagcctcaagcgaaaacgaaaaaaaaaaaaaaaccttcctgaagctttactcccgttgtttgaaaacagtcttctctctaaaccaggacttcctctcggatagccctttaaacttgtgctgccgtgtagtttttgtgctcgaagatcctggtgttcctttctttctaaatcacccggcaaacaagcatatacaacaagtttaaggcgtccctgtagcccgttcgaagaactagccagacttatctccaccactctgtcagcccctcggtcccttcttccgacaatggaaacggcacctccaaccatcctcttagcattagagaagaattgaatttttagaagaatatctagaatatatactacctctatccccctaatataagggatattcactattttcttgtaacgtttaactactcgtcttattaaaaaaaattatacaaatataaaaaatgaaaaggtgtgcttaaagtactttggataaaaaaataaatcacaaataaaataaataataatttcaattttttttaaataagatgaatagtcaaacaggcaaaatgtcaaaatctcttatattaaggaacggagagtatatgtgtgaagtagtaagagaccaatatctatcgttttttgcttcattgcatgtacggctaaacctttgaaatgggaaaacaaaagggatctgattgaccacttgacgagggaatcttctcttgaataattgcaacctgtcttaagaaaaaaaaaagaaagaaaagaatactagtaataattgcaaccttggccgttccaaacggcaagtagtcgtcggataatttggcttcttgctttggtcgcatttcatcgtaatttcctaatgctccatgcttagaataatctttctagtcgatgctcaatacgttgttgcaaacgaccctttggaaacgtaatgatctgtttattatttattatttactcgagttctattccaatgttagcctagaaactggcggcagatctagctaagtggcgattttaaaatagtgtgagtttgtacaaattaatactatggttttgtctattgttaactcaattgtgggtctaaatgagtgcggttttgtgggttgagtgagtccatagcaccggattgtaaaacttggcttttgaatggagtgattttacaggacttgtgtatgatttgagctaaatcctataaaaatattataaaattcatgtgttttaaagatcctctcaagataattgcaccaaccaattgtttttttaaagaaagttcattagaaggagagcttctggcacctgaatttgctcaccaaccaagctaaatcgtgggtctccattgtagcctaaacgtcaagaaaaataatgtggagtaaaccaaaccccccaatgctcccctcctcccaaaaaagtttccaaacaaacaaatattatctcaagcaaggtttacctctctgattgagcgtcggatccaaatcctaacggtattacggtttccgacaaatttcaagtaatttgggtcgaatccactatttcaaacttgaattctcgaaagaccattttggcatttcaattagtatcttctttcgttcaacgttgaaacatcaaaatttcacgaattttgatcggttttcgtcgaaaacataagtacacctacatacaaaccccttcccaagggaagctaaaattacggggcttttaattatttgccacttttagatttagcaattaactatttgccacacctatctcaatgacatgtgggtccacatgtgtctataacatgtggttacagtggcaaatagttcatctaaaagtggcatatactttctccatcctaaaatgtttgacgccgtacttttttaaaaatgtttgaccgttcgtcttatttaaaaaaattaagtaattattaattatttttctatcatttgatttattgttaaatgtacttttatgtatacatatagttttacacatttcacaaaagtttttaagtaagacgaacggccaaacggccaaacatgtttaaaaaagtcaacggcgtcgaacatttagagatttagggaagaagggagtagttcagaccctgtatagatggcactaaaacttttaagtcctatcacatcggatatttggacactaattataaatattaaacgtagactattaataaaacacatccataatcttggactaattcgcgagacgaatctattgagcctaattaatccatgattagcttatgtgatgctacattaaacaatctctaattatggattaattaggcttaaaatatttgtctcacgaattagctttcatttatataattagttttgtaagtaatctatatttaatactttaaattagtgtctaaatatagggactaaagttaactccctggatccaatacactaccccaatatctctaaaattactggacacggttgcattctgcgacccgcaaacgacttttggatccgtaacccgttgacacccgcgacccctgttttcgcttttctttgggccctcctctctcctctctctcttcctccattgttcccctcctccccttctctcccctctcctcctcgcttccggcgagaagctccggcgaggcgaagcctccagaaccttcaggagagctcctcaccgaagggacaaggggccttctagaaccttgctgcttcctcccccaaaggttagatcagagcaagggcagctgctctttcttctttctttcttcctcgtttgtcttcgtttccaccttccagcgaggattctttgtgtgtttaatgggattttcgaggtgtggtacggcttgattggagaaaatattgttgttttcgtgacgaaatttagtgaggtattgtggggaaatcgagtggcctttttagcgaaaggaagtgtttttttttacttgatctgtatttcgaggtatgtgtgcatcaacatgctgttaatttggtagtaagtctgataaattgcttttctttttttttgtctctggatttttctaggcttgcagcgctggattggctccgaagatcttaattttgctccaaaggaaggatcccccatcgcaaatcttgatctgtgggtggatttggtgggttgaaaactccatcttttatggggcaaggctatgcgaaatccttgatgctcccatggagttctcctcccatggggcaagaggtgaagaggcagtagatagaggaggagcaagaggtggaagcgaagagaagtaggtgagaataggaaggacgaa

SEQ ID NO: 26323 - DNA, 3614 bp, Oryza sativa
cacccgcctctccatggatcccgccgggtcgcacgcggcttcgggtgactcctccggtggcggtggaggtggcggcagcaccggtgccggtggtggtggtggtggtggcggtggtgacagggaattgttcatcattccgcggcgtgaatctgcgcatccaggaccaccggacattaacctgcccctttctgcagacccctcaccaccaccgccgccgcatccgccgtcgtggggtatcgaccagttcgacatgcttgatgtcggtctcggcacgcagacttatgagtctgaggttgcgctcacgcttccaaagttgactggcaatggcaacactgcggttggcgtcggtgcgaggaagtgtgccaagaggggggacagcatttggggtgcatggttcttcttcaatcactacttcaaacctgcacttgtggaaaagccgaagggcaaggtgacacgggactcttctgggagcgtttcgggctttgagaagtctgatcttcgccttgatgtcttcctggtgcagcatgacatggagaacatgtacatgtgggtttttaaggaacggcctgacaatgccctcgggaagatgcagctccggagcttcatgaatgggcattccaagcatggtgagccatcctttccattcagtgcagataagggctttgcaaggtcacaccgcatgcaacgaaagcactatcgagggctgtccaacccacaatgccttcatgggatagagattgtgagttcaccaaatctgtcagctgttcctgaagctgaaatgaaaaggtgggcggaacttacaggaagagaacttaatttctcaattcctcctgaagcaagtgactttgaatcatggaggaatcttccaagcactgatttcgaacttgataggccactgccactgtcatcaaagattacacatggctctcacagtcacaaaaaggcactgaatggttcaggtcttaacctttctacgccaccatcatcagacgatgggatggacctttcaccaaaatgcgccaagcgacggaaggacttctttgctcatggtgcagatgaggattgcgtgatggcaaataattcttgttctgacagagagcaagagatagaagttcacacaggtgagccgtcatggatgcatgagttcactggtgtagcaaaacatgcaagtggacctgttacggctgccaagacaatatatgaggacgatgaaggctacttaatcatggtgagcatgctcttctctgatcctcacagtgtcaaggtctcttggaggaacacattgacacatggcattgtgaagatatcgtgtgtgagcactgctcgaatgccctttgttaagagacatgacaggacattcaagttgactgatcctttccctgagcactgccctcctggagaatttgtgagagagatacctttggctacaaggattccagaagatgcaaagctcgaagcgtattatgacgagactggcactggactggaaatcatggtccccaagcaccgagttggacccgaagagcatgaagtccaggtttgcatgaggcccccacaccttggtgaaaacgatcttcttttatcatagaacagaaaacagtttagtctttagatcttcctgtgtcatgccatgatatgcaggaaagtaacaagtgatgccatggatattttgctgctaaacatttagctgaaattcctttctcagtagtgttggtgatttaggcaaaaaagttaccactttgttgattctcccctgtactttttacactagcaccactatattggagatcttgatttctatggaacatggcaaagttaaaattctgtatatatatctgatgatcaagttcaacggttcattactccataataatgtcgacagctacttacgactagaagttcggaactgtgttgtcaatttcagcaattgtttgtaatcgctgtcttaatcatttcaatgtgctgtactacaatactactggctggatcgctttcaactgaaaccaaaaactcgatcccattgctgtactaacttcatgatcgatatgctcctatgcgaattccgtttggtgaacccgtttgctgaatcctgaattgaagtgatcaaaatttctgttttttttttttttgctacagtaaattgcacctttcctggatgctatggtgaagcaaagatctttttttcacctggactgtagcaaatgatattttcgggcttgcgtgtggccagcaatgagccatgctaccgtggcctgcttctcacgagttctgtagtttgtgtagccatggagaaaggagcgtaatgtgcttgagaccgatggttgtgtgtggtcgtgaaacaatcacagcttctgttctgaaagtctgaaccccagtgatgtttgtttcattgtttgtcgtgtgcttttctttctttctgacgaatggtgaataatttttcactgatacaatgttcgcgaattcttcagatagtcccttgaccacactcgattttcttcaggcaaacaatctcttctcacccgggccgatcattcagaaaccaggctgttactagcagacattgaccatctgttaccgtgctgtcaaagtagtactattaccggtgcggtctttgttcaatgctgcacaattcagtttgtatttcacattctgaaagtttgaaacacaaaatattcacaagaatcagggaaacagttcacgtgtttcaaacggggccttacatttggtcgatctatacccaattgtcaaaatgggtttagaaaaaaaatgataataacgttcagaaaactgatatgtagggtatgattgtaatgaaattacgattgcatcgttgaatctgaatatagtgcatgtttaaagaaaaaatatgccaaaaaggttggttgcgaaatactcggggtttctttgaaatacattttttttttcaaatggtttctgcatagatcagtgtaattcctgtatacgaaggtccttcaaaatttatttttgtccccaaggaggcttttcactaaaatcgaactgaagtgaacagaagtgtagacattaggattcatgttttcgataaaaaccaattgaaaaccgcaaaaattcgaggttttgatagtgttatgactgaaatttagaatggttcaaatctgaaacagtcaatttgaccaaaattaaacgaaaagttataaaaaaattgacaaaaaccgttatatccacatggatcaggatccggtgcttaggcgaaaaccatcttacaaatttttcgaggtttcgacacggaacggaaacgttattcgtgtcaaaacctcgaaaaatcattactacctattctaaaatattagaatataaaattggatgggacgttttcaagtataatgtatcataatagactctatattataatagaaaatattacatacagttttagtttcatttaggacagagggagtattacgtacactgtagtagtgagccgctttgatgaagtggcgaagtggagttgtgcaccgagtccacagcaaaagagcgcggaaaggaggaagaagataaagcatcccccacctccgcctcttcccctccaacgactacctcttcttcctcctctcgcaccaccaccactcaccacc

SEQ ID NO: 26324 - DNA, 23401 bp, Oryza sativa
  unsure (1)..(23401): unsure at all n locations
caacccggcatggttatttttaagtaacttatatctagttatgaccaggcgtgcattgtttagcattttcctatccacaggttttgatatgaaatgttacaattcaagaactgttaggattttattgcatagcattcatcggctccggaatgctgatactatgtgagtatcaccatacaggtgctgaaggatggcctgtcagctgttcatgtgccgtactcttatggattcgccatcattcttctcactgttattgtgaaggctgcaacattacctttaacgaaacaacaggtaaatgataaaatctggtctattttttaattaatgagtaacatggatatggtgggttgagagttgtgctgtttttcctctctttttttaggtcgaatcaactctggctatgcagaatttacagccacagatcaaagcaattcaacagagatatgcaggaaatcaggtttgttttgtttatcttttacgcacgccatggatattaaagtaggaacactgaggtttgtttctggatatatgttttgcatattttaacgatagaaggtagaactatcttcccaaaaaatgttcttatttcactgttgtgttttatattttcaagcacatatctttgggcatttctgatctatcactcctacataactcttattaggaaaggatacagcttgagactgctcggttatacaagcaagctggagtcaaccctctggcaggtcgcttacttctccattctttagcctattaactttgatagttgaattgttccattgcatcttttttgtatgagtttgttatttattagttgatcatattttctatttctcgacataatgcatctattgccatcatgtgcttgcaaaaccaattgttggctttttaaagttttaagtgagattgcttttgtgatatagtgttttgatattatggtttctcttccaggatgttttccaactttggcaacaatacctgtctggattggcctctaccaagccctttcaaatgtagcaaacgaggtaaaactcaaatcctgcttcctaatatttgcttcattaagaggattttgttctaagtggcttatatttctctgaagggattactgacagaaggatttttctggattccatctttgggaggccctacaacaattgctgctcggcaaagtggtgctggcatttcttggctcttgccttttgtggtaataaaattgatcacacgttaacatatatcaacaatttcattgctgatctaggaaaatcaggtttatagtgcacttgagcgaatttaacctcattttccccccttatttgactttgacatacccgtcaagttagattagtgtcacgtttctgcccatagtcatttaagcaatcaagcaacaagaagcttagctatttgcacctcgcattttgttgcctattatttagaactctggttgaaataaatggcgtggcataccaatttatagtcctgtagagacatgatagtaaaacagcatattactcatgtacttgcataatattgagatggtaaatcatacttacaacttaaatgaattgtgcaggatggccatcctccattaggctggcatgacacgatatgttatcttgtgttgcctgtgctacttgttgcttctcagtttgtctctatggaaatcatgaagccaccccaggtgagcagacgagcggtgctctaaattactatatcatctgtcatattgccactatacaagctatgagtggctggcaatttgatcctttttttctgcagactgatgatccatcgcagaagaacacactgcttgttttgaaatttcttccatttatgatagggtggttctctttgtcagtgccgtcagggttgtccatttattggtatgtgcatttgctattagttgtatgagtgtttcagtcatgttccatgctatagtgctatgcctcatagagattgtgggactcctccactgctcattaacttcttgcaattgatcaaatccaatatgtgtattgactccatgtttgctatcaggttcacaaataatatcctcagcacagcccagcaagtttggttacggaaactgggaggagcaaagcctgttgtcaatcaggggggtagtgggataattactgcaggacgagcaaaacgtacgagtgctcaaccagcccaacctggtgaaaggtgcttttgaacctcacatggcttttaaccctattatattctggttttgatttttacaaaaatatcttgaatagatttaaacagctgaaagaagaggagagcaagagaaaaggcaacaaagcgcttgctgcaggagattcagatctttcagcctcaacatcagaggatgaagagtcggatgatgagactactgaagaggtactcaatctttttttaccattcatttgtcctgctggagcactgtgtagtagacagttcaagctagtcatcttagaaaatcactattccccttaaaatagtccgtgtgaatcataacaaatttcaattactgatgtaaaacggacagcagggaggacctgaggaaagatacaattccagtagcaacaagaaacttccaaattactccggaaagaagggcaaaagatcaaagaggaagcgcatggttcagtaggtgtgacagaacctgattggatttcatttttgtcattactggtaagtactatgaacacacaaacacctttttataaagaagctcactagcttatttgaattctggagttcatgttttttaagtggcaaaaaagaaaggtttatactctatcttatcatatgtccttgatcaattggtgttaatgtcatgtacatttacaaatacaggttaattcagttggccagtacggttgtgtagttgatctcggacacaattttgatgatcagttgggaaggctaatcttcaggtgcaggacagacacgaaacattccagtggtacaggtgttttgctggcacacagcaagatgaaaatagttcagtacactacaataggtttgagaggataggcatggcttgagtatgtgctacaacataagagtagtaccaaattattcttgtgctactctgcaatgtgggtaccaaactcacgcagaattngcataattcatgctctacatgcatttatttccctcttgtaacctaataacattctttgcggagtatattgcagaagttagaacaatccagtcgcctagaaaaggtgaggaaaaaaaaatacattgctgaacttacgtctactttaaatctttgagccaatttctgtgattctgagcaattatactaataaggccaaatcctaataattcgatgaagaggtgtttggtttggttggagacaatatatcattagctcaactgcagcttgtcgaatctgctggctacaattattgtgcctgagatgtctgtgccatactttgtttgcacttttcacatttgaggcaaactttgtgtgcacgattgatcaattccacaccgttgctttggcacgcattttttttaattttgacaacaggcaactttcattaatcattacccagcttggtaacaagcccaaaacgaacatagtctgatacagaaaggaacaaacaaaaactagaagtttggcacgcaattttcacgcagaatttgagttctgtgtcgcaaatccttcgtgtaacctacgtatatatgcagaaggaaaaaaaagttacaaaaaccatggtgtcgttcactggaaatctgctctggatttttcacattttggtccttttaaaaaacttatttcgcaaatagacccctgaaaaaacttatcccagaaatggtccttttttgggcgccagagtggctggcgccgtcatccaacgggacggcgccagagaggctggcgccgtcctcctgccaccgtggtgcacgcgaaccgacgtggcaggaggagggcgccagccatgctggcgccgccgcctccattcctgtttctctgtatggagttgcaacggtgtcatttttattttattttttcggatgttttttcacacttaggatcacgatacaaccaaccacaaaaaaaatttaaactcgaactaccacttaactaagtctgaaaatagctagcataccacttagtctactttgcaccttcactaaaattagaccataattcctttagtaaaaccctttgatcagcatgttaaacataatacactctaccactatatgaaattacttaatctaattcaaaatataaccacatgaaatgacatatataagttaaacagtacataaagatgcaattttttttatttttatttcatttttttgatatttttttcacacttaggagaacataggaaccaaccgtataaaaaataaactcaaacggacaaaatatgtgacttgtagaattttccaaaactctatcgaaacggacaaaatatgtcatctattaaaataggcgtaactttctcatacgaactcggaatcaggcaaataatatatgcacggacatctacagaaaatattacatccgattctccccgctttgccgggttcggcgatattaaaacctccaaattccgcttgtaagattgtgttttcgaggagaagtttttcggtagaactttggaaaattccacatgccacatatttcgtccgtttgagtttattttttacatggttgattcctgtgagttcctaagtgtgaaaaaaatatcaaaaaataaaaataaaaataaaaaagttgcacatctctcctttgcactggtttggagagagaggagaggagtggaaaaattctacaggtcacatattacgtccatttgagttcaatttttctatggttggtttttgtgtgtccctaagcgtgaaaaaaatatcaaacaaataaaacaaaaataaaaaatttcggccgggggggggggagccagctattctggcgcctaaaaaggaccatttttagaataagtttttttaggggtctatttgcgaaataagttttttaaaaggaccaaaatgtgaaaaatccagaaatctgcttgcaattcgcaaaaaccataaatactagtactacttacggagtactccgtactatgttagtaataactaacccataaattaaggaataacacatatcaaccgtttaattagaaaatgacagaaggtgcagcaaagagaagctgagacgcatggattaccaacaagtcatgcccctggaccggagtagttgacacttgacagcgacaaattgctgagacgcgattacaccgactctggtcgtctcactcgcctcgccaagttggttggtcgctccgctcaaatggcatgtctaattcgtagctaaaaattattatattgtgggatgaggtatatttatagctaaaagttgctatattttgtaatgggtagtatattttagcctttaatatttttttgcggagaactgtttgagatcaataaaagtttcatttattaaaaaatagggaaatgaaattaaaggctaaaatagtgatagccagacggagatccaaggtgcttatcagatattcagatgctgggttttctaagcataaataaacgtaataaatatcagtccgtcacaactctgaaagaatctgttttcctgattctgccaatggttgctgcaccatctcacacacaccacgccacaatattctttgcatctgcatattcttttctctgtttcttccttgcaacaaaaataatactagtagtacacatttgagaacttgatgttttgacactcaagcagattaatggtcagagttcaaatttttttttatccatagtccctccgttctaaaataaaccaatctgaacgtaaggtatgtccagattcactctaatgtgttagaattactcttgccatccaatcagtacagttgcgtcaagcattcaacttctgaatttccatctgataagtaattactactccagctttgagtcgttaaaaatatagtactagaaacaatccaagttagaacaagctctatagaatcattggccagctggacagacagtcactaaatataaatatccaagtgtctcaagcacacaagccacccaacaccacagtgcgacaagctctcgccaagtcgctatccaagaaatccctcccctctctgtcctaccttggaatccccaccaggatctccggctatccggcggcagctacccagccatggccgcgcgcggcggcctggagaaccccctcctcggcggcggcccggtttcttctcagggcagtcggcgccgccgcccgtggaccgcgctcgccatcgccgtggcgctgctcgccgtggcgtgcgtcgtgctgctgctcctgagctcggggggagcggagcaaggcggtgatcggagcagggtggtgtccggcggcggcggcgggggcgtggggctgagcccgcacgaggtggaggccggggtgggcgcggtggcggcggacgacgggaggtgctcggaggtgggcgccgcggcgctgcgcgccggcgggcacgcggcggacgcggccgtggcggcggcgctctgcctcggcgtggtgcacccgatgtcgagcggcgtcggcggcggcgcgttcatcgtcaccagggacgccgcctccggcgacgccgtcgccttcgacgcccgcgagaccgcgccggccgcggccacgccggtgagtacgttactcctcgtcaccaactagagcgccgcagtaaaaattaaaaaaaaaaagaaaaagcaaaactttttttactgcaatcctgagtgcatgacatgtggggcccacggcctagtgcgatgcgctggttgggtacaggtcactgtctggtgggccacgcttgcttacgcaaatgataggcacctgacgttcctctccaagtccaatcagcaatcctgttcttttccgaatggctttatattgcagtttgcacaaaaaccactgtacttatcttttttactcctgattaactatggttcactcggtatctaagctgaccctccctaatatttccgtattacaccacattgtttcattttgtttagcgaacggcatgtctcgtgtaaaacgtcaccatagctagaagacataatcagcatttgactttgagttttttttagctcattgcaaattcatttcactgagaggcatgcctctgtgcaagtgtgcaatgtgcattgcattatcaactacagcatgatccgtgatctgatcccaaaaaaatggtcattttctgtaagacactgtgtttcacatgggcaatcagcatggtctaattgatttggttgcttcaacattggtcttttttttttctgcactttgcgatactcctaccagttaccccattgcggttgccagttgggaagaaaggttcagattttttagataataataaaatacaggttcagttgttcgggttgaataaaaaagacagaatttgttcagactcgatctagatttgtcattttcatctcctcacatgcttcacgagttggttggcatgtagggaaatgtttatggtgtaacagtgtagattccatcgccacaatttcatacaaatagtttagtatggtatggttcatcttcattatttatgttgcgttcttttgagcaactctatacaacaactttcttatttttcgttggtgcatttcctgaactgctaaacaggctaaacaatgtgttttttgaaaactttatacatcaaagtttcttaaaaaataaaaaaaatcaactctctactttttttaataattaatacttaattaattatactctaattcctcttctcagttttacgtacaggtgaaaagctcaagcaagttacacatacaaatgcaaccttagacctttctattttcaagtatgatgttttttgtgaagagcataattaaaaagtggaaaattaaattttaattatgctcatacatatttttttagataatgaaaataacatctggtcgttacttcaaaagatgctacaaccaattattacaaatattgttcactcaacattgagctcatagaagctaactatgattagacaaaagtctaacactccaatatagtagtaaaaggagaaatacattttattcaattctatttgtaaatctccatctgaagttggtgaaaattcgcatgaccatggactccaaatttcagcattaaaactcaaaatttaagataaattatgttcttaattcgatcaaactgagaggcactcaaaaaggatgttcgagccaaaattcaaaaataggaaattgttacatttgatttcccaaaatgacatgctgaaatggtggtttttgtgtctgacaggacatgtacgcgggcaacccgacctccaagtacaagggcgcgctcgccatgggcgtccccggcgagctcgccggcctccacgccgcgtggtcccgctacggcaggctgccgtggaaggacctcttcgcgccggcgatcaagctagcgcgggacggcttcacggtggtgccgcccgtcgccggcgcgctcaaggaggcggagcgggacgtgctcgccgacccgggcctccgcgccgtgttcgcgccgcaggggaggatcctcgccgccggcgaggtgtgccgcaacccggcgctcgcggacacgcttgaggccgtcgccagcggcggcgtcgaggcgttctacggcggcgccatcggcgagaggttcgtcgccgacgtgcggcgcgccgggggcatcgcgacggtggacgacctgagggcgtacaaggtcgaggtgagcgacgccatgcgcgccgacgccatgggatacactttcctcggcatgccgccgccttccagcggcacagtcggaatggctctggtcagtatcaaattcccagtcaatttcgattatttgttcatccctcgatcgatccatatcaaacttgacatgattaatcgcaggttttgaacatcttggatggatacaaatcgctcgagttcttgaaagggtttcttggcgtgcaccggttcatcgaggcgctgaagcacatgctggccatcaggatggctctcggcgaccctgactacgtcaacgtcgccggcaacgtctcccagatgctctcgccggcgttcgccgacaaaatccggcagcggatcgtcgacaacactacgttccctcccagttactacttcccaaagtaattctcatctcagaaatgaacgtttctttcagaagttagctagagcagttttagtgatgagattttggtttttgtgtgatcagatggagccagctgaatgaccacgggacgagccacctctgcgtcgtcgacggcgaccggaacgcggtggcgatgacgacgacggtgaactcttacttcggggcgcacgtgctgtcgccgtcgacgggcatcgtgctgaacaacgagatggacgacttctccgtgccggcggagcggacgccggaccacctcccgccggcgccggcgaacttcatcgctccgggaaaacggcctctctcctccatgacgccgacgatcatactaaaggcaagcatatagtagtaactactaaccatttcgctgacgctgacgagctcgccgatgctgaccactgcagtgctatctgtgcagaacggacagctcgccggagtagtcggcggcagtggcgggacgaacatcatcgcgacggcggcccaggtgttcgtgaaccatttcatcgtcggcatgcacccgctcgccgccgtccagcatcccagagtctaccacaaggcaagcacgcatgcatcaattaattaccttaatctcgtcgattaataaacagcaattaattaattactgggaaactcaattaggatatctctcacttttacatgtcgctttaaaaagttatcaaaaaaatttaaaaaaattagtagaaatagatcgttatataatatgtcacctcacaaataatacaaattcaaatttaacttatacaattaaaaaaaaataacaaatttgactataaatagaacacattatggtaattatttttatttttttcgaattgtatatgtcgaattttaattcacatatttgtgaaaagatatattgtatattgatctatcttgacaaattcttttaaatttttttataacttttcgaacggacatgcacaaaaatcaatctcataattactgtctggtcggtggtatatataatgcagctggtgccgaacgtggtggtgtacgagaacgagacggtggtcggcggcgaggtgatcgagctcagcggcgaggcgagggagttcctgcggcggaggggccaccggctgaggagcacgggctccggcgccgtctgccagttcatcgtgcaggacttgctggcgccggtcggctcggccgccgaccgtcggcagcacggcggcgggaacgtcttccacgggatgctcaccgccgtcagcgacccgaggaaaggcggcagacctgccggaatgtgatggcgcatgcatggcgcgccacggcatcgattaggcccccgtttagacagccgaaattcttacacgattcatgtgaaagctgaacaagtttatatggaaattcttcaaaatttgtacagcagtggaacggccggctgtggcgctcgagcacggggcagccatgggtggtttggtggagaagatgactggaggtacatgagaggatgaacggagaagattgggtattttggtcccaaaaattgaaaaatacagccaagggatatttcagttttcaatgttagtgtcatatttttcaatttcaacatgtatataggcaaatagtaatgccaaattgtaaaattgcaaaatttataatgacgtgatcaatttttttttaaaaaaaatcagtttgtcacaactctgaaagatcagagctcctgattctgccaatggttgttttcccagctgattctgtgatcaagctgccgctgcggctacgcagtccactgcttgccacactgtccacaccataatattctttgcaggtgcagattattttctctatttctttcttgcaaaaaaaattatctgatattttgtcactcttaagaagatcaactgtcagaatttaaattttgtgatctcataaatctgacaatagtatacacatctgtagacctgtcaatctgctgtgtactctgtttcttctttacttacaagaaaaaggtaattcctgcggcttaatttggaaagtgatatcccaacaacaagtagcactaaatcgaaatattattttaaaaaaaaatctgatgggttattgcttttgatgagttagaatcacgccattgaatcagtacaattgcgtcaaacattcaaattctgaattttcatttgattagatctctctgttctaaaataaaactatttctatcacttaaacttatcctaaaataaaactattttccacctattctcccatcttaaccaaatcacaagtcacaagtcatttgattagctctaaagctatttctatcacttctcaacttgtcccaaaatggagtattctccattttatctctacctatatttttttctcctcacgaatcataacttttcctcaatatccactcacttttttaataccgatgtgtagggttgtcaacgagccgagctcgagcgagcttgtctgcctaggctcgagctcgatacaagctcgagccgagcctataaaatgttcaagctttctgataggctcggctcgagctcgactgccgagcttgatttttaagtaaaacaacatatatttgaaagataatctttaaaaatataattaatttttagttcatcatattaatataagaggaaaaaagaataaaataaatatatgatgtcaatataagccatacaaataacatatttgatctcctaatttattaaataataacaaaaatcatatattactaagctcgttggaagctcaagctcggctcgacaaagctcgcgagcttatagagaggctagggctcggctcgtcaggagctcgagctgagctcgaatcgagcctaggacaagccgagctcgagcagctcgcgagtctcgagcttttttgacagccctaccgatgtgtcccgctctataactgttatatattttctttttgtacgaagggagtataattaagaaaatagtgaaaatatcaagtacaataggatctgtagaatcattgcccagttagacacacgatcattataaaaatcaagcgtctcattgacaagccaacaaacgcacagtgtgacaagctctcgccatccaagaatccctccccttcctgacgacctacctgccgatcgccactacaatctccggcgatccggcggccatggccgcgcgaggcggcctagagaaccctctcctcggcggcggcgcggtttcttctccggacagtcggcgccgccgtccgtgcaccgcgctcgccatcgccgccgcggcgctgctcgccctggcggcgtgcgtcgtgctgcacctgagctcgggcggcgatgatcggagcagggtggtgtccggcggcggcgggggtgtgagactgagcccgcacgaggtggaggccggggtgggcgcggtggcgacggacgacgggcggtgctcggaggtgggcgccgcggcgctgcgcgccggcgggcacgcggtggacgcggccgtggcggcgacgctctgcctcggcgtggtgcacccgatgtcgagcggcgtcggcggcggcgcgttcatcgtcgccagggacgccgcctccggcgacgccgtcgccttcgacgcccgcgagaccgcgccggccgcggccacgccggtgagtgcgttacccgttactactcgtcaccaactagagcacgcagtaaaaacaaaaaaaaaaaactttttcccggaaattttgagcggatgacgtgtgtggccacgcgccacgtggccggcaacgagacctccgttagagcaagttgaatagtacagctcactactagctccaatatatatatatatatgtatgtatatatatatatatatgtatgtatgtatatatatatatatatgtatatgtatatattatattatagtctaatagccaatttatacaatagtttctttatatactattaatatacggtctcacctatcatacacccactatctcttggagtctgtactgcagctggctacagatctataacccgctgctcttttttttcaccttttatttcattaaaattaaaatatatctatacctgctcttataatattagggatttaaagcgattcggtggtctggcgcatgtcactgtctggtgggccacacctgcctacgcaaatgataggcacgtgattctgctcaccaactaacggccccatccggaataagtgaaacggtatatttacaaacgaaaaataatttatgaataaaacttttatatacgtgttcttagtgatctaaaagcaaatgctgtaaaataaactttgatgagaaaactccaaaatcaactctaaatttaaggttgaaattttaaattttggttgataagcataagtgaaaagacggggctgtaaaagaacagcaagaaaaatttcacatcagcaattcgaagtatccctatcagtaaattttgaaaaaagaattcgaaatgtctacattgcaactttcaaaaaggggttaattggatcatgttattacaagtttaccaattttttttaaaaaatattactattcataatatcagctgaatatcactaaaattttacaaagttagaatcgttctctcatgttttcatcttcttccttcttttctttcttcttcgcctcagtagccactgcattatttctttttctgaatagagctattgtttttttcatttagaaaggttgtctccgtaacttgtttattttgtgatggcatttgacagctattaaggctgtgtttggaggtatgacacgcaaaacgatgaaacattttagcctataatttattatgtattagctataaagagcttaaaaatgattagtatgattttgtaaagcaatttttttatatatttttttaaaaacgataaataagaagttggtgacttgcacaaaataacacaacctaaattgaaccccgcttcatttagtttagcaacagcatgtaagtcaccatatctagaaacatgattggcatttgactttgatttttttttttggctcattgcaaattccattccattcatggagaggcatgccactgtacaagcgtgcgatgtgcattgtcgactaccccgtggtccatgatcctaaaaccacattaaacaaaaacaacacattgtaggtcgcttagtaggtagtcctttttttttttagagtaaagtgtatgttaaatttgtagttgtgtgtcatctaagtccctaaactcttaaaatgcatatccaaattacagaacttattacagggtgtcatttaggcctcaaatcgccacaaccccttcaggatcttacatggcgttgacgtgatatgtcacacggaatgacgtgacatcattttgactgacaaatgggtcacatttaaaacttttcttttttttcttctctttttttccctttcttctcctttctctgtgacccgagcagaagaaaggaaaaaaagaagaatgagaagaaaacgaagaaaaagaaaaagaaaaagaaaagaagaaaagaaaatgaaaatgacacgtcacgtccatgtggcatgccacatcagcatcacgtaggatcttagaggggatgtgccgatttgggacctatatgatacactttgataaattctaggacctgaatatgcattttgagagtttaggaacctatataacacaaccctacaagtttaagaatcgctaatacactttactctttttttaatcaagctgtgattttgtaattcagaattattcaagctacaactctgcttcagtcttcagaactattcagaaatggacattgattatattattgaaataattgtagatcgcttcagaaaatgtccatttctgtaagactctctatttcacacgtgcaatcagcatgggctaattcattggttgcttcaaggtggtctttatagtttttctgcacttcgcgattaccatactgcagttgccagtttgggaaaatgagttcagtttctttaagataataaaatatgggttcagttgttcacactgaataaaaaagatgaaatttgtccagattcgatctagatttataattttcttcttctcacatgtttcacgcgttggtaattcctattaggcgggtgatcgctcctccatccgcccagcgatcacccccctgcctctctcctatactatgtactcctccctcctctcccccccttcctcctccctttcttctctttctaccaaagtacaccacacaattttttttaaaaaacaaaagttagaacaatttatgtatagaaatactctctctctctctctctctatatatatatatatatatatatatatatatatatatatatatataaattgaatttaaattcaaatttgaattgggcatgtaaacttttgacttataaactttggatctataaactttaggtgtataaactttatatgtatataaatactatatatatagaaaatatttgaattcaaattcaaatttgaatcgggtatataaactttaggtctataaactttaggtgtataaactttaaatgtatagaaatactatatatgaaaaatatttgaatttaaattcaaatttgaatcagatatataaatttttgacttataaactttagttctataaactttaggtatataaactttatatgtatagaaatactatatatataaaaaatatttgaattcaaattcaaatttgaatcggatatataaacttttgacttataaacttttggtctctaaactttagatgtgtaaacttgagatgtataaactttagatgcataaatttattaaaataggaaaataatgcggtgccaaaaaaggaaaccaggtggagggggctacctgatcgctactaggtaggtagggtgatcgatcgcccattagaactagcatatctccgggaaatgttttcggtatatataacagtataaggtcgccatttgtgtatagtttgttataatatggttcatcaactccattgtttagtactttctatggtccctgtcattatttggacttttggagccttggagggacatagcacctttgatatatagcaatgatcatgttactaatacaaagctgtagttttacgaggaaaccatgtatgatgttttttcttcttttgaaaaccatagctaaaaggataggaaaccaatagatttgggaaaaaatatctgaaattacttaaagaaaatagttgtgctcatgatgtatgatcttgtaaaattggtgtaattcggtacaacaacttgcataacattaactatatactcttcccgtttcaaattatttgtcattttaaatttgttctaagttaaacactttaatcattgactataaatttatataaagttgtgtagctaaacatcaaaaatttatatttttggattcaccataagaatatttttataatatagaattcatatattgttatttgttaactttcacggattcttaaaaattaatggttaaggataaacatgtttaacttagaacaaacctggaacagtaatttgaaacagagatagcaacaccttgggggatttgtgtgaaccagagctgaaattgtccattaggaaatttctttcaagtgagaatttgcattaaaagaactgaacagatcagttccacaataacaacgcattttgtcgatagcacatttgcaagtgtttatgaagcaaaacattttttgataatgcaccatgcgcgcgttgcaagtgctaattctatcgatagcattatgaagcaaaatctgagagcatctgaatttgccattatttgggcagttcttatggttacactgaatttgcttgtgtaaacttgctaagaaaaaagacgcgaatattagggaatgatctaatatcaaataattaaaaggggtgaggcttcgaatctaggttatttagcctaccaccttgtagagctagccggaaaacctctggacgtttctcaattgtgtaaacttgctgctagctgagtttgctggtccaaataaaggtagattatgttcttaattcgatcgaagtgagaggcatccgaaaaaggatgctcgaatcaaaattcaaaatatatatgaatttgttacatttgaattcccaaacatgacaagctgaaatggtggtttttgtgtctgacaggacatgtacgcgggcaacccgacctccaagtacaagggcgcgctcgccatgggcatccccggcgagctcgccggcctccacgccgcgtggtcccgctacggcaggctgccgtggaaggacctcttcgcgccggcgatcaagctggcgcgcgacggcttcacggtggtgccgtacctcgagatcgcgctcaagaagacggagcgcgacgtgctcgcggacccgggcctccgcgccgtgctggcgccggaggggaggatcctcgccgccggcgaggtgtgccgcaacccggcgctcgccgacacgctcgaggccatcgccagcggcggcgtcgaggcgttctacggcggcgccgtcggcgagaggttcgtcgccgacgtgcggcgcgccggcggcatcgcgaaggtggacgacctgagggcgtacaaggtcgaggtgagcgacgccatgcgctccgacgccatgggctacaccttcctcggcatgccgccgccgtccagcggcggcgtcggggtggctctggtcagtatccaaattcgtcccagttaaattctgatcatctgttcattcctcgatccatccaaaccaaacttgaatatgattaattccagattttgaacatcttgagcggatacaaatcactcgagttcttgaaaggatttcttggcttgcaccggttcatcgaggcgttcaagcacatgctggccatccggatggatctcggcgaccctgactacgtcaacatcaccggcaacgtctcggagatgctctcgccggcgttcgccgacaaactccggcagaggatcgtcgacaacaccacgttccctcccagctactacttcccaaagtacaactgatctcagaaaatgtacacgttcttgttcttgcagagatcataccaggaaacatttggattgatgatattacatcttgatcatcagatggagccagctggatgaccacgggacgagccacctgtgcgtcgtcgacggcgaccggaacgcggtggcgatgacgaccacggagaaccacctcttcggggcgcacctgctgtcgccgtcgacgggcatcgtggtgaacaaccagatggacgacttctccgtgccggcggaggggacgccgccgccggacaacctcccgccggcgccggcgaacttcatcgctccgggcaaacggccgctctcctccatgacgccgacgatcattctcaaggcatgtagttactaacaatttggctgacgacgctgtcacgctgatcgagctcaccgtcgccggtgctgacgaccaccattactgtttgtggctttgtgcaggacggacagctcgccggcgtcgtcggcggcagcggcgggccgttcatcatagcgacggtggtccaggtgttcgtgaaccacttcatcgtcggcatgcacccgctcgccgccgtcctgaatcccagggtctaccacaaggcaagcatcagttaatcgattagacctaatctctttgattaaccagtactccctaaacagagtataagctgcttagattttttaattaaatttatttaggtttaaccaattttacaaaaaaatttaatgcatctacaatatcaaattaggttcattaaatatattttaatactccctccgtttcaggttacaagatattttaactctacttaaagtcaaattgtatcaaatttaactaagttatagaaaaaataataacattttcaactcaagacaaatttattatgaaaatatatttaattattaatttaatgaaactaatttgatattataaatattactttatttgtctataaacttagtcaaccttaaaataatttaattttgatcaaagtaaaaaagttttataatctgaaacggatggagtaatatatttttttaattaaaagtactgctattttttatataaattttgttaaacttcaaaataatataattaaaaaaaataaaaataacttataatatgataaaaacggaaggagcaattaattaattacactatggtggtatgtatatgtagctggtgccaaatgaggtggtgtacgagaacgtgacggtggtcgacggcgaggtgttcgagctcagcggcgaggcgagggagttcctgcggcggaggggccaccggctgacgagcacggactccggcgccgtctgccagttcatcgtgcaggacttgctgacgccggtcgccgccgccggcgacgagaatgtcttccacgggatgctcaccgccgtcagcgacccgaggaaagacgggagacctgccgggatgtgatgacgcatgcatgacgtgtcacggcgcctattaggcctccttttaaaccaccgaaaattctcacaagattcatgtgaaaaagtgaacatgtttatatgaaaaattctgcaaaaaaattgtatgatttgaattgagtgaagagtgaccgatccgagctggtgcagaagatcccgtggagtaggctttttccacgtgtcgctgcatgcagctgtcgtgctgtcctcgagccaagataaaggttggtacacgtcagctacgcggcgaaaatggtggagcacagcagacggcacgcaatagcgtgggataagaagaaatcggcaatcatttcacacaatcaaatttttttttagagaaaaggctttgcagccctgcttctattgaaagcaaagaatcacacaatcaattcactgttaatattaagaaaaaaaatgcttacagtgcatgtctgaaacacgcagacagacagactattgtggagtacaacctgataatcagacacatgtttggaacacaaaaatttgacaaactttacaggtttgtttagtttctaaaaaaagttgaaagtttaaagaaagttgagagtttggaaaaaaagttaaaaatttacaagtatatgtaaatttttaatgtgatatgatatgataaaaagttgggaataaagagaaactaaacacggcctacacaaaacagtccaaaaaaaaatatttggcaaaattatttcgttggaaaagccgatcaaatgcgaccagaatcagaatcatctcttctcatccatttgcaatatcaaaatcacggtgatgcctatcctgccaccaccgctgaactcgcggttactcgccagcgtcgccggcccgccacgtgtacggctctgattggaccgccctaccacgagtcagaagaggggagaggagcaaagagaacaacgacgagacgaatcgttggagaagcgaagcgacgctactcgacccagcgtccacggcgagcgccccccgccggcgacggcgacggcgagagatgcgggcccgagccgccgaccacctcgaggcgctctccctggagatcgagcgcaagctgcagaaggttatatcctgccccttcctctccgcattccggttcctgcccccccccccccccccccctaatcgtctcgttctttcattgatttccgggagggttgggttgattcgtgctggtggtgtcctggcctgtttctgttgattattgagcatttcttggccacctttttgggttctttgcgattaatttcggtttggagtgaggaaggtgtttttttttgtttggatttgttttttctgaatcaatggtttttttcgagactgttgttctgttgggagttttcagtgttgaagaatatacgattttgatttgttttccacgtatcagttagagaaatttgggcctgtttcgtaatcccagaatttccccttttcgaatggcgctaagtcgatggcaattaccgcagttacagaatcgaaattggttctcccgttttcttttctcaaattctctaccgaattaaagattactttatatgatctcgaaacgatactgataatttgagtggtttggatagggcaggtggcactgtttcactggttgttgcttgcgtgtaggctctcaactccaattcgcaacgtcttcagctgctgcagcagttgtttgctgacatcgcattgaaggtggatgaccgcgctcgaggtgccatttctttcatagcttcagatgttaatcaaactaatgctttttcgtcatgtgtgtatttgtggacagtaatcatgagattggcaccaagtttgtggtagttttacctagagtttgaacctttgtactatttttttttttttgaaggaaggcaaaagcattgccttcctttgtactatggtttatatccattcccttgtttaacgtttttggcggagaactaacaattcattgatgtcagccaagagttaaaaactagttctttcccttgtcactttcactatattttgcttttcaaaaatcgtttaccaagattggcattacttcatttttattctaggaatccatcttaattgtttattttatatgcatctgtagattgaagtgtctaaaaaagttggctgttttggcatgcacttgctaactagggaagtactgcatacaccatcgttactgtgcacacctgcatcacaggaaaacatgatatttgacttaattgtgcataacaataaggctatactttaatagaaattcaatccattttttcttttagattcagagtattgagttttggttgcttggattcttctgacagtaagaactttgttgttacattagtatatcacttattttctgcacatgctctgtccttacttccttttatgatcaatgtttgggtcataatactactcaatcttgttacaagtgtttttgctatgttacatacttatttctttttaacagatgtgattttaagcacgaacgatgatggtattgctccagtagatgagcgagaagatacccggttgtgcttctatgagattcttgctaaccattttgttaaagtacctgaaagtgggaggcgtatacttgacttgatagtgcaactctggagccagtcttttgcagcgaacatatttgcacttcttttccacagatgggtatatattaattcttacaaccttatatgtttagaacatgcaataggttgattttcataaccaatataagtacaaactcaatcatgttcacaagaagtcatgttttccatttccagtaacgtttaaggaatttgtttaaccagtacctcagtgaatgtgccttttaccttttactccttgctatatgttcctctgaatgagctaatgtcttggtggttttaagttttcacttttgagtaatgtatatatgatctcaaaaggaaagataatcttactggggaatttgtatcccagcatcaagcttatactgcccattgttctggccaccatttactgcaaatagctagttaaacaagctaagtacagaattctgtaaatgctagctgtaattcgcttattcgatcttgcatacaagaatgctccggattgtattagccttcatctctatttcagtttggtgaattactagttcatcatttgcagttattcgaagtccctcttgatgggaaggaagtatcactgagatacagctctgctcttgtccaaggagctactaatgttttttggtatgatggcacccataaatttgatctgttgactgagaaagttattactgcaaaatatttctgctaacagagggattattgcactgatgttcctttttttcttgcctgaaacttccatagatctgatggaattactttttgacaggattgacatccaaaccaatacaagacactttctctcattatataatgtaaggatatatttggtttcagttgctcaaatttcgttgaaactgtgatgtatgtgttttagtaaaatcaaaacatgcttgctttattaaacagtatctccttgaagaggttgctttagtcccagatcaactgagtaagatatcagtacaggtcactccctattgacattgaactctgctatgagttttcctaataagcatgtacgatagtatttgttgtcattaatttgatgttttgaacaggctggtagaggtcttttcctcctcctctcgagatttatgctgttctatgatcaaggtatgttatttttctccacgttcttggtcccaattgtttgctattgaagtgatccaagtttgcatgtgcagatcacttgcttgcaagtttccttgagcattttcctacttttccaaattctttcttggttggtggcgctgcag

SEQ ID NO: 26325 - DNA, 651 bp, Oryza sativa
tagcaagcgcttctcttccatttgatatttaggcgaattatgtaacttatgagaaatattaccataaaaaacccattggatatgagaggaggggctctcattaagaaattattaagaggagtgaggctcgaacccggaccggctagcccactaccttgtggtgctagccggaataccccaggggccttctcatgagcaatattactaaaacagtgtgaaatttactatttgactcttagtggtagtacagtagatacttaattccttgttatgtaaaacttaccaaaacagtgttctgctttgattatgatttttattataaattattctccttgcacgattataatttgcattagatgaaaaaataattgtaggaagtagacgccgaggttcatatgttccactgaaagatgaagacactagtgtcatggacgatgacaaacacactgaggtacatacaagttgcttcatcctgttcaagcaagcattcaaacacttcttttttttacattttggttataatttcttaaacttcttggttgtgtatatccctcgtggatatagaggccggattaatgaaaatccattatctaaaaaaaattccttaaacttcttcagactacagtgcatactatgagcatctagtttcag

SEQ ID NO: 26326 - DNA, 91114 bp, Oryza sativa
  unsure (1)..(91114): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattactaccactactatttattgttagtaagtgtagttggttaatttactctttgtatgtatggctgactttgatatggttttagattgtaatcttatttatcagccacttggtttgaatatttatgtccctccacaagtcagtccatcaattgttgtccttaatttgcatctttggtaacagtcggatgatggatactatcagctttgattaaaaaaccaacagtatgtaacttgttccaacctgtcatcattgtcctcaatttttttgtcagacttacatttatttatataatcaacgtttgcttctttatgagtgatgttttcttaaactagcagaatgctcatatacttactttgctacagatagaataattgtgttacagaaccgaattccttctcatactcttctacagatagaacagactatgttgcaagccaaattcctgcatggaacaatatttgtattgcttgtgaaaagaaatatatgtgatgtttcctccatatgcttgagagattgtgttgcaggccggttgtgtgatgaatatcaaaacctaattacaactacattgctgaaaatttgtttcaaatttgtacagataatcagaggacaccatcacaccagtatgcactaggtgaagcatcctagtgttgctgcagataatcttctctgtgtactttgcaagtagcctaatggtatccaggaagagcttctgcagaaaccaccaccacaagatctttcagtgttataacttataatggttgcatttggtctctgaatcccattaaaccatgatccaaataaaactgaagaaacaaaagcaacttttctgtacattcatagtttttttttgggcatctaaaaggttttcccctttatttttccctcaagacacatgtttcaaccgaatgagattttcacaaatgcagagctaaggaaaactatatatatctcacaagttaacactcagcaaacaattaatatttgttccagaaccggtttgaggcataataaaacagaataaacttcattactattgtgtcatgtgctgaccaaagtataacaataactgatgaaaatgtagggtcatatttcaggcaacaaaccatctcaaggaggcacagcagatggatgagcttgttgatatggtacaccttagtcatgctctagattcttgtggtcatcagctaaactatcctcaacatgtacttatgcatacaggcatgctcaactgcaagatggagtggaagaacaccctcagtgacaatatctgatgctgcttgctggatggggaagaacccagagctgttcatgtagttggcacaacgcaggggcattgtgttgaacaatggaattgaagctttgagccattcggtccacatttcttcttatgaagagattgagcacagcgaaatatctgcaaattcggatccgttcatgtttcagaattcagagagggtaagattcagtcggttagtttttcgcagactgaagaaaaagaagatgttgctgaaattcatattatgatcaatggattgcggtgatcaattaattaatattccctccgtttctaaatatttgacgttaacttttcactacatgattgactgttcgtcttattcaaaaacttttatgaaatatgcaaaactatatatatatataacaataaatcaaatgataagaaaagaattaataattacttaaattttttgaataacacgaacggtcaaacatattttaaaaaaatcaacagcgtcaaatatttagaaacggagggagtatagtactaggcctaaatggctgtgacgtcaattttaaattttaaatttgaatttagaggattattttgaacggtcagtggtcaaaattttcaaaatttttgtgtggttggtgacccgacccccatctcctcctccgactccgatgcgctcctccgccgccgacgcgccgccccccgccaccgcgagtgagatcggagacctccccgtggagatcgtcagcgacgaggagatggcgctcatcgaggccgcgctctccgccgccgcggcagcatcccgcccggtcctctcctccgccgccgcccgccgagcggtccagctctcctcctgcgcggcctactcggccgcctccggcggcgacatcgaggactccccacctctcccgacgccgcggagggggtctctgctcgcgcggttccgcgaccgccgcgcgctcgccgtcaccgacatcaccgccacggtaaagctgcatcgccttgtgtttgtgttcttccattctcagtgattctgacggcggcgtgcgcccttgtggcaggaatggtgcgataagcagcaggagttcgtgctggagcacggcaagccggagatgacgcaggccatgaaggccgggtccgagcgccatgcccagctcgagcaagaggtgagccctgcactgcagtgttgggatcttccaagcagaatgctgccttcacatttttctaccttgaaatgcactgaaatgataatgccatattgagattgccattgttttgttcatcatgatgttataccatgcaggatcttatctgaaattaagtcacatttctagtgattgcgtatgattgatttgatgttatcatgagcttcatagccatattgagttttctcaatttctgaagaagacaaccatttgttcctttatttgggaatgggagctaactaccgatttatttcggttttgatttacttcattttggagcaggttatcgagagagtcgaagtcaccattagatccgcagaagaatcgtgggcagtgaaattcatgaactttatcgtcggagcaaaccagttaatgttggagggcatcactagggaaatccccgtgtaagcacctggcatgttcttatgtgtatacttctccaaaccagtagtgcatcttggctgcggtgttgatttacagaggatagaaaacatttttatttcgttaacattactttcagtaaaattgattctatatcatgtcattgcagaattggggtcgttgaaggttcatggatgataggtgttattgatgaactccgaatgcctccagatggtatttcagtccatcctatcctggtggatacaaagacacgttacaaaccaacagttcccttagaagcacaaaaaagaaatggaaggtttgctcttaatcacaaaatgtagacaccacaaaagtattattggcaggtagtagtacatagttaagcttagcttcaaatgcgtgttcccttgaataatgaatggtgaatggtgattcccttcaagtgacttctgctttgatctggaattatacaaagttgtatttgatgcttgattggtatattaacagtgccattgacaatcacaccatagttacaaagaagatttcaaagatcattttttgctagagcacacttaaatacttaacatttttctttcaaacaaatttagcttgtacctagatctgtaatggtagactggtagtatcctttcattctgattatagtatcttgtgagtattgttaggaagcaactctggggtcaattattcagtatgtggataaattaatccaagttgatgatacttggcaagtacaccttttacaaaaaaaaaaaaaagagtagcactggtatcccatttattgcgccatctaagagacagatatatcttatttcgtatgaaaaggtaaattggacattatctagaaaaaatgaaaaggtaaattggtgagccttactgtttaagaataaaattcagatgataagtagtatcagtatgtggagttctctactagttttactgttttgcctctctatgatgatgcaagcttgcagctgtgaagtttgtatcgttctctggttgatatttttgtggcaggcttcaggtgatgtgttacaagtatctatgggacaatttgatcagtgagaaattcccagcagagaatttcttcagctattttgacctggaccccggttacttgttatcagacgatatcaagcaatacattagattgttggggctcaatgcaaaggtgccaattccatgcctcaaattttctacactttgaattgtttcctgttactgtacaggcactctgatttgaattaccagctgtttatgggaaatcattccattccatgagcagtatagtgctaatatactatactgaacattccagcaagtgattgctaaaattaggatgctcatgctactttttgacaaagttataattctagtatctttgcgagttgtaacttgtgacatggtttctctttgtagaccttagaagatgtattgaaatatttcaaggtcacctgccatacactaccacggtctcaggaacagctgctcttgaggtaaatatgagttacaggtttacagcctgcacatgacctgtagtacctgactactgaatgcctaatcactagtgtagtgagctcttgcaaatgacatgctaaactggtgcagatatgagctacaagcggacaattccctgcttgaagaataccagttctcttatgatgctaggtggctcaaggatcaatttcaggaagtcctcagcttctggcaaggagcacgggagcctaaatttgtgagtgaagaagagaggtggaaatgcagtttctgcaaatttgcaaataattgcccaataaatgcttccacatcaagatgttgctgactaaaaaacaaatgtagcattgaagattgctataggtcaaagtttagtgagattcttttacgcctgactgaagaaccagtcgtagcgatgaatttgaacatttgaagcgccttatgttcgttctttcatttgttcttcttgttctttgatgatgatatgtagatcaatgtaagatttcagcattataacttagatgttgatcaggttgttataaagaggaatatttttgttgtacacaatgagataacttcatggaatttgctattgtggaattttaacttcaaatgtaaatttcttatgattattaatatagtgtgattttttgctttgatctggtgacattaggttttcacttgtccgaatattttttttctctgatggtctttagacagataggaatgctttgtttgtgcaatacaacaaactctgaaactgcgattgcactgttcagacttcagagggatcttcacaaaaagaaatatgtggctcacataaatagaagagacttgtttacatacaaacaccaaaggtttcaagtgacaaatcgatatagttttacagaaacaacaaatggaatcgactggcagggtacttgcgaatctgctagagcaaataatgtggttataactggaaaaacaatgccggcaactcatacagctgatatataatcttaaacctttgttcattggatgaaatatatctgcagaatccattgctccctcctggtacttgtcatatgagtcacttgcttccaccattgatcaccaaggcctctggctgtggtggctcagcaatgtccttcaccacctccaccttgggagggcccgaatgccgcctcatcggagaaggcggcgccattccagcttggaaggacagcttcttcttcactgaaccaacagaggctactttctccggtggtgtctctgcaccatcggtcactgcagatccttggaggcgcaacttagctcttgcagattttgtgggagccatgtagcttggcacagatggggagcttgcgaggctctcgtcgtcacgcacggttgacgtggctatactgtgcctcctcggtcgttcagactggacactgaacacactcttcgcgtcgtcatcaacctgtgagagcccattcttcggtgtcgcggatttcttctttgcaaagatcggtgacactttagcggagggagttgaaggggattgacgggaggctggacgggtcagctttggagttgttggtgatgacttgtctggcttggatcccctacggttgaaggcttttgtgatctcaccctctccaagattcaagcttgcactcttcgctgatgcacggtcaaggttgctctccttgtcggtcccagcacgcccctcccaaggctttgctgccatccagcgttccaaccagctccatccccattgtgggttgttagggtctacaaacattgggttgactgaccttgaagtgctcttccactgcagaagacagaagtttcgaaacattttaagcatgtgtggttgagtgagtcagagtacagattggcatctgtcattgagaagcacagatatctacctgatgtgaaaatgcatatgcgagcgccctctcccttcttactgcagcctcttgcctgcttataagactcgcctcaatttgttccttagactgagtgctgtcatcccactgctcccccatctgatatgattcacaaatagagtatgtttaatgctcccaatgatattttatgattttctgagagatgtagaacaactgcatactagagttctcatcaagcaaaatttatttacaatagaactaataataatagtatcctaggaaatattttatcgacagattgcaaggttttgagatagtttgcctaccctcaaactctccagctcctgtttcagcagaagctggcgctggagggcctggttctcctctgacattttcagcctccttgaacgtatctgcgactgcacccgtgctagagtctgcatgcaacgcagagtgcttgcagcttgacgcttaaccgagttaccctcaaccagtgacttcaatctgacaagtccccgcagagctcgtaatgccctccttgcctgcattattgcagcgatgaaatggtcaatatattatagaagtaacaaaatttttacttctcgctaggtcaagttttaaaatttgctatcatgttttccaaggaagagaatatactgctgctaagtcgacttcaagaaatgttatctttgtatgaagggacaaggggcatcaataagcctgaccaacaaatccatcaacatcaaaaaatgattaagaatcaaaattagtaatgaaaggtggcttccaccaactgccagttgatcaagaactaatttctaatacttgccaagattttttcgtagatcatgtcaacaaacatatgcagaaacaaataaacaacaaaacgactacttcaaaggagaggaaccaaactataagtttgaagttaccccaggtgcacaggtcacacaagaaaagtttacccctgaatcatagaagcttgtttttaccacacaacattatgaaaagaatacaggaactgtaaatacctaagatacttcaatcaagagtctcacttcaaattaacagcaaccagccaactaccggttgattgattggtgagctgccaatacctaaaatttctacaggaaaagagaaaaaaaatctcaggatggccagttggccaccagcagacatttgctttcatgtgcagtcatgttgatgaggagacaaaatcacaaaactatacaagaactgttcttttagcgtctaacctcaaattgcaatgacctaatcagcagccagcataaataaaaaactcaacacaaccacctttgtaatatttgcaccaacacagtggtaaatgaaagcagctgatgaaataaatagccacgacgaattctcagacaactgagtaaaatgtaatgaaaatgcaatcagatagctgaattcaagagctatttcacattaccaggtaacctcggaaggcggtctggatcttgattgtagcttgctcttcccttgatacaccaggtggcaatgacgatgtctgtgcgggtacggggacagcctcaggtacagcctccacagtgacatgtttgctttgctcctgctcaacttcagggaccttaacctcttcaatctgttgaacaggtggaggaggtggagggggtggcaccgaaacattgacttccagagaagccgaaggggttagatctggcgggttcgggttactagctgctaattttctcctcagtctctgttcatttcaatggacaaagtttgagttgtggttgcagttcagctcaaattggagtaagacatagtaattgcggaagataatatgataatttggtcatataaatcagtgaagacaatcaatttcaagaggaaatatgttatgtattcttctcaaattactgaatggcaattaaagaatgccaattgaaaccatgacatgggtgaaaattccttgggattttgaaattatgtgcaatggtcaccaaaagagcgcctcccttaaagcagtaacaataaaagtgagattttgatatcaaccaggtccaaaactagaaccaatgtgctcatcgctaattggaacaagaaaaaattgaaacttttatcacaacacaattgagacctcactgaaaaacagaattgtttgcaattcagacggaaaactacaaatcctgatcgaatccagattgaactttctaaattcgaaacaaaagggcctattcaaacgaaccccaagaatcatttacctcctccttcttctccttggattcagggctgaacaccttcttgacagctccaaaccacttccccttcttccccatcctcccaaatccttctgaagaaaaccaaagaaaattaccgatcagatctgcaacatccccagatctatcctacaaaaaatggcacaatgggatgggaaagagcacatacagaggagccctcagaagaagaatcaccaaatcttcctgcgaaaggaaagagaaagagggccaaataatcccccctttcggttgtgcggcaaccagcagcaacaacaacaacaaggtgtgtcagatcggcatgagaggacagcttaattctccaggaatctgcacaaatgcaatcatgtggatggtggtggtggatgaacaaggagggattctagctggagctaggactgacaggagggcacggccagcccagagccagccagagcaggaggaggaggaggaaaggaaaaaaatgggttcttggaagttggaagctgttgtagtagaggctgggatctcttggatgggagtggtgactggtgagagcagctgaagatgcttctttgggtacactttcttggtgcttcttgcaaattcttgcaactctctctcatcagtgggaagaggactgtggacagcttggagacagaaaagtgtgaaataataatacaactggaatctccattatatataatacactgctaatatagaaatattttcttgaaggcatccaattactcatagtatgatttattttggacttgtgtgcttatgtgtatttatgtattcttaaggcttgataggatcaggtggatgtagcactgaagatatgtagcactactagtcataacaaactgcaagtgatcatccaaaacactgaagttgtaactaacagtgattatctgaactctgaattatgatgacacaaccccacaagcatatgagtgattgcctgttgggattaggagaggagattagttgcaacttgcaaggccgggccttcatcaggaccctgcttgtctgaatggccatagcactcagcatagttagtggagacttgccttcagtcataagttactctattgagtgcttcatcagctaacaaaaaagttgtgtcagcattaatcagttatagatatgatcctacttattaagctgtgacagccaataaatcctgcatctatgttgtgtacaattttacaatatatatacactaggagcaaacaaattatagaggatgatttttagttcagtgtgaaaggacagcaaactagcatatatgtatagtattgcaaaggtggcctaaaaaaatgaaaaataaagaaaagttattgtatgattatgctaatgaacaaaataaatcatatcattctctatatgcaaggtggcaggaaattatttgatggatcatgttgcaaacaatgtgccaactcatcataactgtttatatttctctttcttgtttatagtcggctcccatatgcatgtctgttgtgctggcaagcttcaataattaaaatattcattcaatcttatcacaaatttctctccagggacacatcaaatttatacttctctaggtacagatatgtttcttgcatggcaaatttcatttcatacaattctttcttttcactagctcctgcaaaatataaaaacaaaaaaaatgcaaaatgtcacatgtacatgttcctaaccaagttacagtggcaaccatgcatgcattccaaattttaaattaaacaactatcaaggtcaaaatatcttaaaactagataaaaagtacatgcatgtggggtgaaatatatcttcaacctgagtgtttgtcctgttatctcagccatataaatacccttttttgtacgaaggccctgtaattagatatagttaactagaaccgaaattttttaaaactgtctgacacattacatgtcaagcaccagtaatcatggtcaaacaaacactaatgatacacacacatatatatgcaattatatagtagtatatatatagtgcaagtgagagccatcctttcattgtgtttcccatcagagattaaataatgtcacgagttgcaaagcgacagcctaacgagcgattaagctgcatcgatcatacacacactattcttatgtgcatctcttctttaatcatagtatcagagtcgcttttaagattagctggaagtaatttatcacagagcagtgtagtgtagagtttgcactggatagctacaagcacgtaccatttgcctccaatgatgcatatatgctacttgagcatattattgtgcgccactagcttgcaaatatgccccagtaccatatgttgagtatgttgttcatgcatgatcactgaattaaagttagctgtactggtttaattagtgggtgatgagaaattcgtctgctatgttgttaattaataaagagtaaatttcaggtacagggaattatggtatgatggttgtatgaggggttttggaaatgatacataatcccatttattgttgtcctataattttacagaaccatgcctttaatcaatttgactttctactgtagcaaaataaaaaatatttaacttatatggttaaaactttttatacaatgatcaaagaattcataatttgatttttgatattaatagtcataaataggtgaatcaaagaacaattgattaattaactcattaactgcttttggtacattccaagaggtaagccaattaatccctttagattaggtgaaggcacactactttcagcccttcaggttacttgacaaagaaattggattaaatttctgccaaactggatagactaggctcaaccttttccatgcatgtttcatccaagttaatatgcattacaattaaagatggttcatgtaaatttatccagacagattgatggggtgataattaattacacttaatcatgctttcaagacccaaatgatcgatcaaagatatatatggatggataggtaggagggcgttttctgctttggaaaaggatgatgcatacctatccatcatcatctctctcaaggtggttgctgctttgcattgggtcttctcttttctttctttctttcttcttcttttttaagtttctcctctttaattaatcaacttgccttaaattttcccctctctctctctatgtgatctctcactgcagatgaaagctaagcagagctttttcttttcttttttaatctttttgaaatctgaagaacgaaaggcacaaagtatcctaatgctgtcgacctcatcatcactggctgatcgatgatgaacagaagaaatggatatatcgatcgtcggaacaagtgtcggtcgttggaagtacttgttggatcgatcttcgcttgcttgtgtcagtgtccgtgtgtttcagtgtttgtctgcattaacgacaagtttccttaatgttcaggtgtcttggaggcatatatgaagcatattcgatcatgacacatttcttgagttctctctctgaatctcttgatctcttatttgagtgctgctaataccctgtttagatgggactaaaacttttaagtccctatcacatcgaatgtttgaaaattaattataaatattaaacgtggactattaataaaacccatccataatcttggactaattcgcgagacgaatctattgagcctaattaatccatgattagcctatgtgatgctacagtaaacattctctaattatggattaactaggcttaaaaaaattgtctcgtgaattagctttcatttatgtaattagttttataagtagtctatatttaatactataaattagtgtctaaatacagggactaaagttaagtccctggatccaaacaccacataaacaggtcaggccgtgtttattttcccccctattctcaactttccatcacatcatatcacatcaaaaactttcctacacacataaactttcaatttttttccaaactgccaactttcttcaaacttccaacttttttcaggaactaaacacagcctcagtttatatttttcatctttgtatataaaatgtgaatgtaatcaggatcttttattccactttaattattagcataattcctatgattatcgttgtggaatttttgtgttttttattcggtattttagttaaatatcattagaaaggagatagagttttgtcccataaaattattttatttatatttttagatttattggccatgtctcttttagcaagatcagagatgtaaatcattcgcatatctaaaagatatataaaatgtgcatgataaataacatactatatattccagaaaaaaatgtagaattaatgtaaaacagtgttgtaaaaaactgaaaaataaacaggaacgaagtgaagtgtcatgcaaacataaatatcacattcaagaacagtgaggtggatgcatgtatggggctcacgagtattccacagatgatgtactaaatatatatatacgcacacattagtgatatttttcacatagtgatgttttctttattcaaaaaaactgaaaatttttcacatccaggggcacgtctatcggtagcatttataaattacatgcaaaactatggtacagatcgtacgtacgtactcgtgaatttattgaattcttttggcgctgtactaactcttttttggaccacaaaataaatacaactcgatctgcttgtgcctgcctacatacagtgaaacagtgtatatgcatacataaataaaaaactttcttttgtcgtgaataactctttaatcgttcctttttgtgtctcttaacaaattccttagcattaacaggtttttaacacaaacatattgttcctagtttcctgtaccttttctctattagagtaatacattataatcaaatttaattaccttaatcgcaaaaataactaccttgcttcccaaaaaaactccccacaaaaggaaaaaaaaaagatcaaaattttacctctcacttatgctccgtttggcattttggtggatttatgataatctcgtttgttataacagcttttcgacagtttggttgtttggtgaacttttgtttcttataatctgtgttgcaaacaacagtatcatcatgggctgaaattatgaaacaatagggggagacatgaaagttggataatatattttatttaactataattcgatttgtaaaatcaaatgcagcgatgtaagtttcagtttccacatcaaccttaaaaataagcacaatgcaccaactagattttccaaaccaccgttagccatgcttttctatgggcagtgggggaacggaaagggttaccggtgataaggtttggtaaaatttgttcgaattcaaattttaagaaaagaaaagggaaataatcccccaaacaatttgtaatgatgtctggtgataaaatttatagagaaaatatatgctaagctaactctatttttgcatgactaaatggtggtgttacttcgaaatgaaggtctgatgctcgtgggtgatatattctggagctataatcatagtagttgtggatattacaatattatggtatgtctgttgttttctaatgtggtgttatggttttatttttgtttcatgtgattttccccttttttttaagtcaaagaccacggttaccacaacttaccgtgcaagcttactacatggtaaccgcgagttaccataagatttggaaattctagattttatttttcaaagatagtaacatacccctactttataaaacggagcaaaccaatataactatgattacagaataaaacattagattcagtggttacatacaagtggttacgtacataagctatgcgtgtgggcacatgctgagaacgtggtgggagacggaggcgaaagaaaaactactcaacttttaaggtagcatagagatacaattcatactgtttttagcggttaccgttgtaatcaccttaccatagtaggatatctccttctttggtggcccatcagaccgttggatcggttaacaaaaacaagcaagaaaaaaaaaagtttggtcgtgtgggcctaaacagtttgtatgggcttatatggctttacagggaaagggaccatctccatgtgcacgtactggcgtgggccaaaaagggtacaccaacattgatctagtgtttttttttccaaaaatgaaattcagtccagatattggtgctcgtaattgatttggatgctcataatttgcccaaatctgattccatcacaatttggacttcagaggacgaggagaagaaagaaagaaagaaagaaaataagagtacgaggagacgtgaatctcgatgcgcgcatctgccatgccggcccgacacatgaaaagtttgtcgctgtaaaacttgcacgagcaatctgccaatctgcagctgcactcttgctgcagatcacacacccaaattccccatattttttcaggctttgtccccgatgtctgaacctggctgttgctaccaccagtactagtactagtatgggcagtgacacaatgaacattcacgtactagaattatttattttatgacgaaagcagtaagtagtatccgagacagtaatcaccaaccttaattctgcttttacaatgccagaataagagtgaaaacaatgtcagaatatacagcaaggagattatgtgctctttttttttctttctgagaaggccttaatcttctgaattctcatggcattgccaaattttcacccacatttctacagtgtattattgcaatccacaaggggaatttgtttgaagcaacatccccctcacaaaagattacccaggagatgagatgagatgaagatgagaggagcagagttaaagaatcacaagtgaatctgaataaatactattgcttggggggagattttccgcagacaattcatggccccccaaactaaaaagaaaacaaaaatgagagaaaaagaaagggaaaaaaactcagtgtaaacaaccttcttccttttcttttgttttcaccacatttacatcaacttcccacttttttccctttctggagaatcctcttgcttgttctctccctaccttctattgtgagtttttggagtagaggtttgggcatgaacttgcatgggcatagtatattgccaaaccatgatttgggagcaatctgagggaatcccctttagcttggtcctgtcttccaatacaacctcttgcacaaacttgatggaatcctgcaatcacatcaagaaaagtatatccattattatttgggagaaggaagatttaactttggttgcattgatgcgggaatggtaagcaaattattattccgaatgtctccttcaaagaactgtttctggcttatgagaagtgcaagaaaagtataataccatcagcatcagctcataattcagaatgaagctcacaagttttgtatcaatacacattccttgcaagtctaggattgtagcaaacttgatgtggttacgaattaggatctttctggtgcaactagcctgtagcgtaattcaactggagggcaagaagttcgatgagtaatcgaagggctcgattatcttgttataatcagcagtcggtgtagatatgttatggtttaatggcaatgtagctttcagtaatcagtatcactggtgggatgcagctcaaggatgtgaccagtaggtcagtaggtgacttgaacaagataaaaatctgaagtttaagaaaagaatgcatgaaagtgatggtggagcatctgattgccaactgttgcacaccatgttccatagaaagtgaagtcgataattgcgtaacactagggcggtcaaatcaactcagaaaaatctgtatgattacgaaataatttataatgaaatcagccggtcagataattcatcttttccgaattataaatgtccttttatcaataggaagaatgaactcagtttttgttatgaaatgcgcaacttccaaaaggtaagaacctaaattaatatatctatttaagttgtttagtgggagagtcttttctacataagtttgtctgtaagaaagatcttgggtttcagaaagtatgatattccctcccctcaaggtaagaaccaaaattaatgaatctattcaaactaaaatttcctaacagctctgaaaatttgaccatcacatgttttttagaagaaatcaaatctgctgttgattttcagctctggggaaatctgttactgttctgcaagtataagtgtttagttatacgatccttctcctttcaaacttccaaatacacggttttttcaattatgggtcctctgttttaggaggttcactatttggctatcatgatgtggacagcctaaaactattgtgatctcagatccaatcaaatcttcctcaatttgcatactatttattacgtttagtgctatagtccaattaagtgttgcagaatgtgtgatgctattactaaaatgcagtgtagcttgatcaatttgacaacaagattggagatgaactaacctgtgaagtgtctggtaatgacgtcggcctgccccaacgctcgggatcccacaaaatagaactgttgaacgcaaaccctgagacgtcaatcgtgtgagctcgcgtgccagcagcaccagcaggattcaagtccgcctctgtgttatatgtcactgcacgggtggtcccatcattgaagtccctcgagaaccaaccgacaaccttggagtcactgcatagcgggccctcgactaccactttcttctcgcctgccgacattgttgccactggccatgtgccaaatgccctgtacatgttaacagttagagaatagaacatacatataccgtagtagcatatagttaagtaagaattacacaaatatgcaccagcaaagatgaaatgcatgaattatttgtgatgacatcaatctcatctttcttagacagagtacagtgccagttgactagaattagcatccaccgacactaagcacacatgggttaattgggtttgatttgaaaataagaggcttcactcaaactgagatattttaaggagaatatgtcaccataactccattgaaatatcttccacatgcttcattccatcataaaatctagtactactattatgctaattttttttgtcacccatctccatcactagacactaggcatggaacacaacacaaggtgagttattgcatgcatgcaactgcctcaacatacgtgggaatagactaaaatccaccacttgcccatacatgcggacaagtgacaaatattgaattaaatggattcaaattccaaagtttgaaagggctaaaaaaactagacagaacaagctatgggacgaggcgaccgttaacatggatgcaaaactttattgagcatgtattcaggtcatctgcaatatgattaacaaactcaactcggttaacgaagcttctttggataaacagtacacaaattctagcttctcaagttaaaagaactctcgaactctaattccaagtaaacaggtatggtaaccacggtcaaaacccatgccccaaaatgtgcgcggagtgtggtgagaacacagtattgcacacttgcacttcctcatttgtattaagcggtaaattctgtgacacatcccaggtcgtatcgaactgttaacaaggcaacgaagaatatatgcaatgtgacgatgctagtagctctgggatgtgcttggttgacgcccaagcgccacatttgttgctgatgtgcgcgcactaagcactatgggttgatgaagtgatgcacaaaagtttggttggaaaaaagaggagcgctttaatctcaacatgttcccctcaacacaaaagctatgttcttcctgggaatattaccactattcactcacatgatatgagcagtagtggtagtaccatagtactgaacaaagtgtacacatcttttctttatcaaggcaagtactgaacgtggtactacctccgtcccatattacttgtcgctttgacttttttcttgtaacgtttgaccattcgttttatttaaaaaataagtgcaaatatagaaaagaataaatcatacttaaaggacatttgataataaaacaagtcacaaacaaaataaataataattccaaatgtgtttgaataagacgaatgatcaaatattacaaacaaaatctcaaagcgacaagtaatatgggacggatgtagtagtactactcatcaaagtttggatgttgctattgaaaaagtaaaggcaaaaggcaagtcaaatgtttcagagccatgcatttctagtttggaagaaatgatgataaggtgaggatcacattataggactaacagcaatttttagcatattttagctggataggaaaaagataagaggcaaggtgaaacgtcaggcatttccgccagttgttgaatcaggtctaattgaaaatagaagaaagatttgacctggatttgagaggctcagagcaaacagaattggacatgatagtagtattctctggctgcaagatcacaatactggagtacagctaacatggaaggaaaacaatgttcaacatcaaactgccagccaaaaaatgttgctgttttttccttctttgcaattattcaagtatgaacaagaaaaatcatcaagcacaatctcgatgaccaaccattctgccgactccaaccgaatccaagacggcaactagacgccattccggaaaactctacaccgaaacggtgggcagatctcgttctgcatatgaaatggccattcaaggccatagaaagcaacagatggtggggatggggcctccttttattgggagttcaatggtcatggcctaacataaggttactattttctgccaaaattgtgttcaagcaaatttcttcctgcattttgctacccactttggggagcaccagaaatgcaacattcagttcatgctatagggagagtgatgtgtgattcaccatgcattttctaacattaggttgcacagggatgggcccacacgtcggtgggcaaacagctagttgtactgcaagcactgttaactaatcatttttgcacatttttaatagttttttgctttgctcatggctcatgagccacaggcacgttgaaggtcttaattaaactaattggagtggttgcaacatatttggttgttgggggtgagcaaaagcaagagatcttcaatcttcaaaagaagcatagatgcatactagtttgttgggagaaatggaataaataaggtgtaaagctagatccaataattgactccctggctcacatcagagtattgtgcacaagatgatgataaaagcatataggtacaacacacactaacctactctaattctcctccactaatgacagcttgtgcctttaatgatacttcccccaacgaaccacacggctactaaaattttattggcttgagtaaatttaccaaattaagaagtggtgattagttaagagaagccctagtaggtggtggacatctgaaaaggaaaaaaaaatctaaaacgtatgacctagatggattgaatttgaaggttttctttcctagattcaactccctgaagaacagcatggacatggaagaaatggggatcgaaaagaactcaaattgaattgaaaaacttagaaaaaaacaattaggttagaaatcaacaggaagaatcaaccaagaagcattcggattagcacattccacaatttgcaacctaaaatgaaagagcactcctaataatcaagcaaaaattgtgagaggttcaacctttgaggttagaaatcaacatggaagaatcaatcaagaagcattcggattagcacacattccaatttgcaatctataaacgaagaaagtatactcctagtaatcaagcaagaaaaaagaaaagtgagaaaccaaatgggatggatggatggatgtactgactcgatctggcggatctcgtcgaagaaatgggcgtcgtagacgccggcggcgtcggcgaagtggacgacgccggagaggcggtgcttctcgacgtgggcgagcgcggcgttgcgctgcgcgtgcgcctcggcgtcggcggtggtgaagttctcctcgggccggaacgcgaggtgccggtacatcacccccgtgccgcgcagcacctccgccgtcgccgccgcgtccgccgggggctccaccaccacccacaccaccggcggcctcaccagcctcagcgtgtgcgccagccgcagcagctcgccgcgccgccgccgccgctccccccgcgtcgtcgtcaccactatcagcatccgcctcgccccctcgcccccctcgtcgtcgcccacgtccaccaccgcgccgttcccgaccccggccgcctccgccgccgccgcatccggcaccaggctcacctgctggttcaccgcgacgtgggacgccgcgagctggtggcgcggctggacaccgccaccgccaccgctcccggcccgccacgacgacgacgacgagggcgcgaagccggtgaagaagcccatgacgaagcagagggagaagtggagcagcgccttcttccacaggtggctgctccgccgctgcttcggcctctccgccgccgccaccgccgccgtccccatggaggcccaaagattcactcaacctctccccagaatcccagatcaagatgcaccaacaccaccaatggagcaccagatcaagctagaagaagaagaagatggtatactactagtcctcctcctctagtgaagctttgcagccattaatggtggtgggggtgaagatcaacaaactccactagtactcctacaagaagatgatagatagatagatcacccaacaagatttggggtggtggtggaaatggagggaggaatgtgcatggggaatctcaacaagctcaatcaagatatggggagaaatggagagagatgaggaggaggaacaaggtttttgtggtgcttggaatggtgaaaaatttgtggtgaaaaatgaaaaataaaatgaaatggtgagagagatgagatggttggtgaggagggtttaaagaaggcgggaggagtgtggtgaaacttgcctgtccatcaacggccacaacaccccacaatttttttgcttttctttcttgcaaacaaatcaaccaaatctctctctctctctctcctgctaaatcacacacctcaccgacacaaaaattttcacatttttcattcatggttgaattgaaatggtagtaagaagaaaatgtagtatatggaatagtactaataatttattgtttctccaattctctagtgatggatctggtggccattggggtggggctgcacctacacattttattattgttgtggtactgtgttccattaggagagcaaatagtgttttcaagtaagtttaatgatggttttagtgtatgaccagtgatgaaaagtactagtgttatggtcagagctgctgattacaacttctcaacttggttggaaatggactgcaggactaccaccagctgctggatctttggctggttttgaggattccgcagtgatgaagcatagctctcacagattcagaagctagcagccaagaacaactagcatggccaaactgtcataaattcagagcctccgatttttttaactgaatcacaagttctccaatgcaattataaaatcactacctctgtcattcaccaaattgtcatcagtggtatatttcatcagttttatacaaaagattttttggcaattaactaattgattggattggcatttaccagaaagaaaattattcagacttccaggatgaagaatattaggtgagctgcagcttttgctctcttttaatacaaccacataattctattcctctctcagctctcttgaagccaaaggaaaaagactttgagctggaaggagaagaggccatttctgagtttgttgggattggaacatggaacctactcaaaaagcaacaaaagttgctgatttctctaatggtgcaattagccacacaagtgttgtgtttgttgcaaatgtgtgcaggaatctgaagcagagaagcttagcatcaaaaagtaggagtatttgacaagcaggatgaccagtctggaccaggcatctgcaaaattctgatgaattctgaatttctgatcgagctcaagaactttcaatgtcttgattagaactgtaaaaaggtgaaagcatgtaggagtatggattaacctcttgtaaacaagatgggagatgaatttgcatgtccttcgtccttcaagtactcagattctgtgtgcggttgccacgtagtaggacaggtgcaggactgcttggggcccacctgtcagctaccagcaattgtcatcaacgcatcgacggtacatttttgtggaatcacttcacatggagacaggaactgaattactgaacccctcaacactttcaaaattcactgtagacatgcatgattgctgtgagttttaccatgaaaaagttactagtcacatacaagaactctgataaggcataagcatagccatggatgtgaattgggtgtgttcttttctgcttaacaaaattattggacaactaaatacacacatttttcagacttctaagtgttataatttctgtaaaaaaactttgtgtatatgattttctaagaaaacaaatttaaatattataagaattaattcatcgtttgtcccatcaccttatttctcattttgatttacttttaccttacctttttaatattattaaacttataaacttatagctgtgtgtcttatgacagaaacaggagatgtaatccattttcattattaaaaaaagaattaattcatcgttaatatcctcgagagctaaatacacaagctttttggacttctaaatttataatttatgtaaaaaaaattatatatatgaatttctgagaaaataaatttcaattttaaaataataaattcatttgttaataccctcgaaatcattcggttattcagcgccgagaaaacatacaggaaccaaacggtcattaaacaactaaataatcatccagtcaaaaacaaatcagaatgcgtgttaattagtctttgagatggaaagagggaagaatgtgctgggattcagacagcgcagctctccctgtcagccaggccgactctcactactctttccaatctctttcttccttttttcttctcaagagaggtcaatctcgatgagcccatgtgattttgtccaaagaactaacttctgccctgtacacgtctactctaagttacaacaattcataaactattcagtttttttagatgaaatcgtgatcttcagtcgagctagctggtgatcatttgatcatggacaagaagtagttgaggaatatttgttcgatctccacctacgcgttggtttagtcctgtcttgctggatggtaattggtaagttaatgaactaactaataataattcagcatttgttcttcctctccaacctgtcattattcagcaaagtgatcatcttaagcaattggtaggcatgggtatctagcttaattggagattatgaccatttgtgtattattgtccacgagcagttatgcgtgtggttggaggcctctcccttttgctcatgcatggaagttaagagctaattgcagttaggatgattaatcaagttggagaaagaaacaaatttcaaaacctaacttggcagcctcataattgggagaacaatggaggcttcgaataagaaaaaaaaatctgcctttccttccattcctatatttatgcacgtatgtttctaatattctaagtaaagaagaacatatgtgttacatgttctttgcaaggaacggaagaatggattaatgtgacacatttccctagcttctaagttttaaggatgtatttttcttaaaaaaaattatgtttatgaatttataaaaactattttctctttaagagtgttttctaacgttataatagttaattcattacaaaataagtaagtattcagaaaaaacctgacaatgcatccattcagctagctgaactgagcgtagtgcaaccggagaaattaaaggagacaactgataatctactgcagtaacatgataatctctctccgtaataatggtgatcgtgcaggctaaggttggttaatttaggtctggtccatgagagtttggctttggtcactttcagagtttgggagacgacgacgatttggagacaggaactgcaggaatgcagggtggctcacctatcactctgtcatctagcagcttatactcgctcgaattaactcattaggagaattattatgatcccgtttcttagttgcaaacttgttactagaacagaagaataaaattaactgatgtgagccacttgcaagaaaattcaggctcgatcgatcttggcccgtattatctgtcagtcggtcactctgctgcatctccagttcgccgtgtgcgtttctctgaatttgcttccatctctcacttcttattcttctcctcaatttgttcttcttctcattctctcctccaagatcgtctcgtgcacgaactcttaattatcgttgtctggttgacgacgactgattgactactggttcgatgatctgtctttgtctgaactctgaaactcttcttcagttcttctcctactgcgtggaagcaagcagcaagcaatgcattatcagagaaggaaaaacagaagcatcactgtcagaaaagaggagggatttctcattggtcgcttcttattattttcaacccgaataattgcagcaaaaataagaaacacaaaaggacacaaagaaaaatatatatgcttgtgctaattaacaacttgttaaagagacgtcagtgaaagctatgctgcaactgacgactactcctactgcttgagtgtaattcaactactttatgtaagcaacaatcaaatgaataaattcatatatatgagatgaactgtatatttgttgatcaaagaatggcagaaagggagaagttgttgctgtgaaaatgacaagctaccgaaaatcatacgtacaagcgacagtatggactgccattcgtgtgaggcaatattccaaagctctgaaaacataaacttatttgcatcaaagtagcagcagcaaattaagagattcattcatcaagaatgttatggaattttttgtccaaaaagaatgtgatgggacagagaggacagaagcatcatgatccacatactgaatgcttgactatatacttccatggtgtaaaacaagttgtttgtcaggggattatataagtgattgctacgcacaaggacagtggctatcatcttaaaaggggttcattacttgaaaattcaggtaagctagctctgttctttactttactgataattaggcgacacttaggggtccttaaaagtggagccatgcacggtaatcgagataatcacccaacgaccaaatccaggcagtgctacacgtgtcaatgtaggccggacagattgcacaagctggcgatgagatgcacacagacccagcagcactcactgttagttaataacccaagaaagttgcatcaaaagctacctggtttcagaaaactgaaagattgttctgacgacggagttgcagatgcagctgtgcaagatggcagaaaatttcagtattattttcttctgatttcattgttttcatataatctaatggtaattaacaaaagaaaatgattgatccctacttatctcaactactgtaagctaggcaactaactaaacaagctcagcattaacagattcacatgtgaattaagcatctgtgaacaacaagaaaagctactaggtaggttagttagggcaaataaagaagagaaacaaccctgaacaatggcattgctaggttgtcatcaaaggctagtataatgccagccaaaaaaactgtccaaaagatggtggtgtggttactaacccccaaccacaatttccatgtgtgtgatgacatctcctctgctgcatctacatgcattcataaactatacagcagcatggtcagaagggcaaatggcacatgctgccctgaacaacatggagccaatgaacaggttcagcaatggttactgggcaagagacaagatgccaagttgccaaccaaaggggatggttggcatgggtattttttgcaatttgcatcccttgatgtgtttgatgtggatagtgcaatcaattgctagcatagcatttaccattgctacagttctttggtactctgaaactttaactgggatttctgaactttgggaagcagtggccatcatcttgcctgaaagaaaaaagtttcttgttttgtttccatctgctgcagatgcaggataattgcagtcatgcagtgagaattaccactactccagaaatgcagacctggctaatggctatgttcaggttcatgtgtccttcttcacagatgaccactaattaaatactccctctgttttaaaatataacaatttctagcatttaagatttgtctcaaaatataacaatttctcatccaacattctcttcccaaccaatcacaaccctcaaccattcacttttctcacctacttccacttctcaaccaatcacaacatttttctatttaattctatctactttctaactgtgtttaattttaaaactttttatattctgggatggaagtagtaattaataggaatcaaaactgcattgttatgcaaggattgagcccgctgtggccaatcactctcatctgatgaaatgaattttatggcccagttgtcctttggatatactgggctaggcctaaggatccattggccctgtattatgggcctttatggcccaaatcctgctgggccaaaagcacttgcagttggcctgtaatttccaccaaaatcttaatgctgaaacgaaagtgtattcagtattcagactactgttgcctcctttttgagatggatagattagattgatagagcacaaccattggcatgaaggaatcatattcatatgagcccatatccatcaagtggtgctttgaaaaaaagaagagagaagcatatatactgtagtacgttaactgaagaaatctaaaaaccatatcatatcagagattcagagataagtagcttaggtagcgtcctaattattcctgtgcagaaacaggctgtgtgctgtgcatacgtgtacgcatgaacagtgcaagatacagtcctagtgctggctgctggacctgtctgtctttctgaccattttctcgccgcgtctgcgccgaattggagttcggtacgctgccatttgcagccggggaaaaaaagcatcagatgcatgtaagaggaaaatgtgcatggcagctagcgctgtctcgatatattgattgcttgagtaaaataaaactagatttggagggagagacgtccctccaaatattttttaagaagaaattgtgagcgtgttaggaatataacacgagacctcgggattgaaaccacacaccctttaccactgcactgtcaagtgcatcttgcttgcttgagtaaaatatatcgatggtcctcaaatttagtagcgtgttttttttatataggtctctaaatatcgaaaatgtagactatgtttcggaatttgttagtataacaattaggttctaaattaccatataaccttatcatggaactgtcatggtggcagatctagaaaatttattcgttggtgtcataatgtgtctatcaatgtcatagcatgctaattatacttagaatatagtgttataatatatggataagctgtttaactatagtttctaccgaaagtcatcggtgttgcctaacaccgatgttagtattgtagatccgccactcatggaggtgccacataccctcttgagtaccattgagggtgtaacatgtaagggggtatatgtggtagttttgaaattagatagcacatttaaatttaagtatgctaccaatgcgttttactcttgcatcaatatatgcatgtatgtggataaaaaaacaaatggaaaaaaatttgagaaatggcaaaagcacaatgcctactacctcaattcccctccactgcatgcaaatatgaaatatgcagatatgctctcatgctatagcctcactatatgtatacatatgcagatatgctgcatgcaaaacctcgttcatacttaacagaaacaagagggtttacatgaatcgagctgaggtctttttgagtttgtgggtgtatcaccatacctaactgtcgtagcatctcatcatctggtttccaatttctctgtttctttccgtaccttttcttcagacatgcatgcatatataatgcagtcttctgatgcatctgtctatacgcgtcgtctgaatttctgacgaggataatctgagagagttgatttagtttgctgtattacgtgcagacagactactggctgctaaattaatcccggttctcgttccaggttgggctcaactgaagtctcacaaagtgcgctccagccatcccattagcagcgttagcatttagcaagctactacctctataccaacctcatctctgaattaatttctcgctcgtatatctatccatccatctaccagagcaagaaatcaactctctctctagtgtgtgtcatgcacagtcattaatttcttgcgttgatccaatgtgtagggatcaagttaataaatagtgttcgcagtttacctctgcggctaccgctataattaaggtagcggactggagattagtgtattgaaacttagcggctgctattatatatgttcagcttcactactgtagttttctatcggtttcgttggactgttattgcgtttaaatggtgttattcatacatggatggacgaacttaacgtagcgtatgcttatttatattttatttatttatgttattatatttttatgctataatatgtatgagtaatttaagtatgttgtctaaacttttgaatgaaattcgatgtttgtgttgatatgtaatgtaacttaaaatttaaatcttgctattggaacttagtatctataatagcacctgttatctgcaatccgctacccagacactaatatgctactgactcattatctactattgattatatatcttgatagtgatatatatacttctatacgtatgaattgcatgcatgcagcaacggtgcttcacgtatgtacatatatctgtgtaagttatttccttcatcctaaaatataaagattttttgaagtcattttagaaggtgattaaaaaagttggtgaaattaaatggggctaacaagattgtgatttagattattaaggccctctttatttaggcttaaagttattggcttagacttttaagttttaagtcagcttattggcttatatgatttataagtcgatggatttaatgtcctaagtttagtgatggagtcatacatctatctcacataagccaaaaaaagcttctccaacctagcttttggcttaatagtgttagagtggcttatggctttcaaaaaaagccaaacgaataagctgcttgtttatttaggcttagacttttcggcttataagttggcttataagtctaaacaaatagggcctaagtaggtgaagaagtttctttttttttgataaattttgaacaataaaaagttgctaatttcatgacttcaaactaaaagacaattttgaatcattcaatctcaattttagaatcaattttcactttatccttccgcggcaaattatatcggcacaaacataattactctcccagaccttttagtgcaactattaatttgactgcgaaagcactggtacgtactctcttccatcccaaaataatgtaggacgtcgttaactttttaggacgaagggagttgtaatcaaaagggccagatgcaccatgcatgcatggtttgatttgggagatgatatgatcgatgatgatgatgattagagtaaaagcgtattgttgttgtaacatgtaaagtccacacggcgatgcaaatacaattatttctactttagaaattcgcatgcagcttcaagaaaagaaatcaatacgcaggcgaaatttatatcatcgtgcattagtcgtagtggtggtctatatatacacgacgggattccactacaactaccttgccaatacacatgatgcatgctaaattattattatttgcaagctgatcgatgtatatgtgttggttaatttctatggcgaaataattgcttaatctctactaggataggctctaatgtttttgtggtctgcagcatgcttacgtgccgtgcccaatatcgtagtatattggcaataatgatgattggtactatatattaatatataatcttatagtaatatataatagatgagacaaattgaaaatatccctacctgcctttccaattttctaccaaatatacacatgcacatacaagtgaaaattcgttatacctctttcaagtttatactcaactcctttcaggacttttaattttcaaaacgcaaaaaaaaaacagagagagaatttggagggagagatgtccctccaaacattttttaagaaaaaattgtgagggtgttgaagattgaacacgtgatctcaggctgaaatcacaatgtacacacttcttaccactaaattatcaagtgcatctctaatttttacaccgcactcacgtgcacacacccgcgtggcgtctcgcacacatctaaaaggattcgagagatttagtctcatgcacatgatataggtacatgttttactaccgaacatatatacccatgtgtgcatgtactacctcctaatatataagcccagcaactctaactttctcttatgcatctaatatactacacatatctaacttttcattttaaatctatgcacgtgtcaatttcagtagttaaccaattcccttttttttttcaaatatgtccatgttgtcgatcactctcatctgcaggattaattttcaaatagatcaatatgaagtttatttaatggatggtacaatcaaatcacaaaacgttgttcattatttcacatgtgaaattagtactaagatttgtcatgtgaaaaatatgtattgcaaagctgctaatatattattatatagggggaatatatatatatatagtgcatttgctctatgtcaaggagagagaaattgatctataattaaatgcatgaatgtgccaactgcgtcacgtacaggcgcgtacgtaagtacataggtacatcaacatagattacgtacgtacgtacgtgggacacaagctgcatttttaactaatgttaccatatctttcacatgaccgttacaagccctttctggtaaaaaaaaaggttaaaattgtttattaagaaatcgacatggccggccggccgttaatttttgttataaaatatttggaaggcggtaaaattatactccatgtattacttaccgtctcaaaatatattaactaaatttaatttatctataattctgaacgcacaattatattttagtagtggtaaaagccgggagttatccatgggatgacccatagtctttcaaaacctccaaccaaaagaggggaggggagggcaagctagaaggagagaagatatcgctgatggcagcatgccgcatccatgtgtgcaacgctgaaattaattgaaccatgaaaaacgtatcgaattaggtccccagggtttggaggagaggggttggtggagggagcgtctttatagagaggtcatgtgtgaggtggaagatgtatcaataataggcggtggatttggtgggtagtgtggcggcgattgcaccaccttgacgatggtgtgagctaagagctagtagaggggtgaactgtcgagtagcggggaacctcattgaaatggttaggaggcagggagtagtgatggcatatccactggtgtgtaagtcgctagagacggaagaggagagatgccgcaccagagaagaagagaggagcgctacggccacaatagtatagtagggataaagcggtatgaggtaggtagctaggtgggtgcgtcctgcgagccttgttgatgccgagagcccgagacacgccaacgaggcaaagagcggcggtgtgtggataggcagatggaggttagggggtgagggtagggggaggcattgtggtggtgtataacgtgtgtacaaaacgaaccatgagaaaagaaggatagagtgggttagggttatacgtaggaaacaagactgaaatttagataaaaataaggtaattgagaagtaattaaacccttctaatatatacacgataaatatatatcaagcatcgacaattttaatttattttgatccactatcttcaatacagtatatgttatgttgtacttatcaatctttttcccctaacaatcaagatcaaatatatacagagatccactgtctaattttcaggcagacacttcaaataactgtcagagctgataagtgccaaccagtcaaccaattaatggcactatagcaagttaatgacagggccaaacatccattcctaccaacattaggtttaaacagtcagcttcacttccaatagcagcttgcttacccagctaagcgctgccactctcacactctctcttctctatatataccacatcaatggccacaaatccacttaactccccacaaacccagcaattaatcatcagctagctacaaggctgatcaagatgggctcgtcgagcgacacggcctgcaccgtcgccacggcgcctccttccccgacgccgacgtcgccgccgccgcagttggctgcgacgacgacgacggtggtgctcagcccgtgcgccgcgtgcaagatcctgcgccgccgctgcgtcgaccgctgcgtgctggcgccgtacttcccgccaaccgagccgcacaagttcaccaccgcgcaccgcgtcttcggcgccagcaacatcatcaagctcctgcaggcaagcagctatagctagctaactcgatcgtgtgctcggtgttgccggccatggcgagctcgccgttaatgtcgccgtcgtggttgcaggagttgccggaggagcagcgggcggacgcggtgagcagcatggtgtacgaggcgaacgcgcggatccgggacccggtgtacggctgcgcgggggccatctgccagctgcagaagcaggtcaacgacctcaaggcgcagctggcgcgcgcccacgccgagctcgccggcgcccgcgcccagcacgcccacctcgtcgcgctcctctgcatggagatggccgccgccgcgccgccccagcaccccaccaccaccgccgccgccgccgcctactgcgccgccgtcggcggcgccgcctcccccgccgcgcccgtcgacgcgctctacgtcgtcgacggtgccggcgccgccgccatgcaagcgagccccatcggctgggtcgacgagccgctctggacatgagctcgcggcgagctagctggcattcggcgttaattaatcccacgaagaaataattaactacttaattaatcaagctgatccaattagtacttaagtgctacaaggtggttgagatatgtcaattagtatagagtcatatttatatatatgtgagatatatatagtatatatatatgcatgtaattaaagtttaattacttgatgtaatatatatgttaccaaatgcaaagttaaccaaagggttaactagggtgcaatacttgaagaaatatatactttgttaagttggtgtttcaaagaacagtaagctaaggaaaataaattgctagattaggctactaagttgtactttggtcatgaaaaacaatggatcttgtggaataaaagttccagcatgttgaagctgcaacaagaagttaaaagtattgaccaattttgatgttacaagtcatggatagatatagctagttgaataattaagttgttctttgcttgactacgtcgtttgtgaaaatgatgtccttaattcccttctgtacatgttgttaggcatcaatgcatttcatatatcatgtaactttccacaaagggagagattttcaaagtccaaaaaaaggagataatttcttggtaaccatggaagtattagtagaactaggaattaaatttgaccaccatcagtttcttgagtgttaagttcagtctcatgatgcttcaccacaagaagtatagcaattttctggtctatgtataatcaaaagggatgaaagatgacccgcatttcaatcgatggtaaccacaaaagaagacggttaagaaagtctactatatttttttatctatacctgtaatgactattatagtatagcatgaataattgaattcccacgttatcgaagaaaaaaagtggtaaataagatcatccatgcatctaggcggtcgaataataacattttggactaacagaagaattcatggcattcacaattgctaactttcaaattaggatttcaaaattaaaattgagtctaacaaagataaaaattaaaattgatcgattaattcagaatattaaacttatcaaagatctaagaaacttaaaaaatgagactctaagccgagtataactttgcatcgatctgttagttacaaaattagaaattcattttatgaaaaaaaaatgagactcgatccgcaccaagtaaaatatttatgtttcttaatcatgattccaggtcccttacggcttgataattatcagtttaatattttaataacaattaaatcaaaaggggctaaattggccttgtaataccagcaaccttttcttatttatcaaattgaagaactattttattaaagaaaaatagtaaaaataagactatgataaatataactttgtatttctatatccaattttgaaagttttagcttcattctgttcatatgggcaggttaaattcaacttcattctgtcacggaaatgggatcctctgacttaactgtatatctgctgcttctctccaacgaggcttaactaaattctaagttgaattctaaaatattcatattaatttgaattagtggcacggtgcaaaagagttcaactcaaagctgaaccatgtgctgaattaacttgagtccagttagccaatcatgaagtgttctctggtttatatgcttatctcatctggcttatagaataagattataagcaaatggaatattatttaattatgaataaaagactaatcgatctgcgcattggacacttgacagtgtaaacaaaactcaactataacgaccctagctaccacgctactatttattcctgttcatatatatggtctgatgcagaagtgatcgatgcatcttactaatgattggtaggtcaggcacaatgcagtaattaattaaacgaattaattaattaaaaattatacgagtggcatattcatgccgtatgcaagcaacaactggagtacatgtatttcaaaacgacgtcaaatctataatcccagttgattgactagttgccctcgatcgtacggtgtttaaaatttgaaatgtatttatacgaagcgtgccggccaaatactgatcaaattaatttaagtttcagtacatatgcatgcattatattctccatacttgacgtggcattagtaactttttccccttgttttctagcttctagtatttcttaggcaactcccaagagatgaaatatctgcaacatgcactagtttgcatcatctaatgacaaaaattattaggaagaaaacaagttaaactactatcaaacacgcattcatgacaacatgcatgaagtagcttagtagagaggagatatatgtgcattgtacattgacctaacttaggtttacctagtagatgaaaaaattcctcagcaacacaagtggcaggttaaagtacatggatctaactactctactctacagatctactctaccatctaggttaattacatatatatctgcatgaaaaatgttcatctcctcaattttcctagttgtctgtctaatcatcttgcattagggatttccaagttaatttttctttccaacagaaatgagaagaaggcaacaagagtggcaacctaaataacaaccttatctagaccagatgcaaatggctccaaacccaatgccaaactagagcaatgtacatgccacatgatccaacctattgctcatcaaatgtggaagacagacatatgcatggtgaactcctagcttaattaggtttgatttgtaaatgtgtctagcgttggtcgagctgaaatgaaatacagccagctttgcactgatcccaattgtttagttaattaatttggcatgcagaagaatccttgaaaatgttggcaacagctactgtgggacttgacgcaaaaacgagtacaatattgtacggtgtattgtcggatgccactaattaacatgtgtttcatggcattttcttattctttttacgtactctttgtgatgctgctgagttaattactacaactaatttgatgtctgaacatgtcatacattagtggaagctagcactgtctatgcatgatctgcaactctgaagttctgccactgactgaattttttctgctctgtcaaccaaccaaatgagcagggcagctagctgccgacattttctttccatgcatgcacaaattcacaattcgtatgaacctttgtcgacatttatatccagttcctccagttcaaaataacactttgtcaccaaaatttgggggagatttgttgatgcaagaggggacatggacataatctctgaccattgctgaacaatcagtagccaaaaacgtcaactggagtcagtgtccgttcatagggagcttcttccatcctttgacccagatgtaacacgtatcgctaaacaacaaagaaattgctgatcatgaggggatcacgtttcagcataagatcaaagaaatgtgtttgaactggagaaagaacacatctatctcatgtcataaactaaacctaactggattgctgaatgtcaaatgcacactacttttcttcttattaacaccacatgggggccagtcctttctctgatccaatctcttctctcttaactggaatcatgtgctttgattggggtttggagaagaaagagcttgatttttctacatgacaatagttagttaagaggtttggacatgtggttaatctgcattgcttgtgctgggctcactgcattctaactggcatgcattgtttgaataattgattcatatgtcttatcattatttcttctcaacttttggacttgcagagtgataactggtaagcaagcaagctcttcacaatcatatggcattctagaaagaatctttagtgagcttgtgtgaactctggaccgaccaatgatgatttgatttcccactggactggtataattaatgggctcttttgtttctatggaattttgcgaaaaaatatatatgaaggatttcaattcatataggactatttgttgttttacatttgtcctaaatcaaacatatctatctttgaccattaaattttagaaatccgttttgcttaacaatatatattatatgaaagtatttcacacggtggatataaaatataaatcttatgatgcaaaatcataactatatagaaattgatggttaaatattaaaatgtttgatttgtgataagcctagaccaacaggtaatttgaaatggagggagcacacaatttgtgtccaaacaccccatctcttttttctattactagtatactcaaactaagatatttttttttaatttttacacttttttaaataaatatttacaaaaatatttttttcgttttgaaaatttataaatctaggcgtatcacgtttaaaaatcgcctttctagagggcgtctagaggcctaaattattgttgtaaatattttaataaaaaaatgtgtaaaataaaaaaaaaagttcctcaaactaactaggctgaaaaccccacggcccaaatggttgaaaaggaccacgaataatgggccgccaggacaattcactagcaggccttaatttccggcccactagtgagccaaggtgagtcacccacccacccacccagccacccccacacgcagtgacgcagacgcagccgaatccgaggagaagagagagaaagcgcgtggccggcggcgagaggagcggcggcgatgggcggcggcgggcacggcggcggcacgacgtacaaggggtacaccatcccccacaacaagcgctggcacaccgtcgccggcaagggcctctgcgccgtcatgtggtacgcaccgcacgcatccctcgctcgcccatttcccccccaaatctgggcctgcatcctcgccgaccggatgagatccgtccctcctctaccagaccctagattcgttcgttctactgctcaactactgcttgtgcgcgatcgattagttatattagagaggaattcgattgcagttaaacgtttactcaatttggggatctctcaaatcctctcgtttggtccatatgggactcatctttgtatcggaagatttcctcatggagtagaatagtcatcgatatcaacgctgctcgcgctccttcttcttggataggcaacggcagcggcagcggcagcatatcattattgatttcacgatttaggctctccgggagtttggttatgaattacaatattatgctgtagcaaattttagactccttttagctagcttttaaccacctttttcatccatgcatttttttcacaactctgggaagaatcacagtatttggctagcttgaaacgcctttggttcaaaccaatgttttgttatttcatcgttttgcaacctttattcacaacacatgaataagaaagcattaggcacgataaggacaaccaaccatatggctaattattcttgtttctatctccattgtatccattgtgatttgtgaaacgggactagctttaagatttggacaaactactatgtcaccttgaggtcgtcattaaacatcacttcagggggaaaaacatcctctgagaataaatgatttgtactattaaacccatcgccaactaatactaatcactggcaactaaaacaaccaagcacttataattattaagcaaatctgatatgagctccatgcccagtcaagggtctactggagggtaccgtcctgcctgaatgtcacaactttataataaaatcaatctacaaagatgcatgatagtgttgtccttagttcttttgtccactctattcttcgccagacattttcttatgcttctcgatgaagtcatttgctcatttgcagcctactgttaagcttctgcttgaatagcttatcatggcagcatgagtatagaaatctcattgttaacacgcttgcattttgttttaatttacattttaaaaaggtaacccgtaacctacctttcattgcaagacagtaaccaaatttgtctttaattccattttttttcctgtcatttcaagcatatccaattatgaacagttacagatgtttgcttatgactaagattttctaataccatggattttctacttgtttacatttataacccaagtcttgtctgtacaggttttgggttttctacagggctaagcaggacggtgctgttctcttggtaatataatctttcgatttcctcgatcttgagttgtgttgattcatctctttttaataaataataatgttttcagggcatgcgtcatccttgggatggtcatgatgatcactcacatggtcatgggcatgagcatgaggtaaccttctggcccgtttgtactgtggcatactagtccatgtttgaactaccttttgtcaatatgaaacccatggggctgtggtgcttggttattctttctttctttcttttttttttgtttttgataatcgagaatgtgaaaactgcaaggggatgaataatggaaaatagctaaaattttgcattcttgtgtatctccgtgccctgtaacatttgtaggcacctcttgaccactagtcacaaaaacgtcagatttgcaattttgccacgtataagtggatggcatttgttcttctgcggttttgccacatatgtatgtatgacatgtggacatgtgacccggggacctcgttgtcattagcttggggtgtgcctactgcctagtgagcaaacgccacttaactatggggcaaaagagaaaatctaccatcagttagtggggtatcagttacatgtaaatgtggtactggtttttgtgcgtgatggaacttcatggagctaccaaatggatcagatgaggtaatcctgaactgtagtgatgttctgctgggtttgacatgtgaaatgcccaagcatattgattatcgatagggcctttatctttgacttctgctagcaatgcctgcttcactgcttgacaatgtccaatgcccagtctgtagtgataacctgatcctgtgtctttaaatcagagaagtaacggatttgtaattgttttgcgcagggatcatcatcaacatcgtcgtctcactaaatcaactgcttcttggcggctgagggagactcgctgctttggttgtcgcgatgaaatcctcgaagataataaagtttcacactattaattttattaagatgggttcatgttgttggcaactgtttaaggcaaactggttatgtattttgcttttgagatagcctccctcgatggaaaacccatgtatgttgttgcttattaggctgtgtacatccttttggatgtagaggctgggtttttaatccattatctaaaaaaatgttgttgcttcttgtgatcattttacagctgttacaaattccagttgatacccattttccttttacctactatacttccctcccgacaagaatgcaattcccgctatgcgcctgagcattcccttgtctagatgaatagccagaattgcgttatttttggacggaggtagtagaatccatagagggaattttctccatagaatgccgcagcacatagtattcgttcatggttacaacttacaacaaatgactgaagcaggtggttcataacactgaagattcatctgtcgctggatcacaacactgtagcccacaatagtagggaagtttttgattatacccggtgtcacatcgatgcctcaaccatgtctatgttgttatacagaagaaaaaaaaattgttccatcagaaaacaaagaacataactgtgcagttgttagacgatctaagatcatcatattgcgcaatacctgatcagcaatcatcataacatggtcaaccattttaatttttaataatggaaacaaagtaaaagaaagagagagagagagagagagagagagaaggaactacagagcaatacattcatcatgtacatgatgataacatattcatctaagattatgccaaatcaaaatctccaatggtacagcacaatacattgctaaatgagggaactactcttgtttcttgcagatctcatcttgtacccagtacacaacagacctaaccctaaacactatagcaagcacaaaaccaaaccagactgaacattctgaaacaagaactactttcctttttcaccacccaaagtgtagctgattccacattccagtaaataatatataagagattcagacagagccttagcaccaccaattgtggtctttttgtacaggcaaaggggcaaaggctcccagttcttcactatctcagaactggaacctgctaggttgagtcttggtcatccttgccataccaaacggctcgtcgttttcgatcctcctggcgttgcggaaagcggcacagccagcaacatacacgatgacgaggatgatcagcacgacgatgttgaggatggcaaccttacgccagctcttcttgatgccagcgaggacgcctgccttgcaggagtcacactggaagcaaagcgtctgctggtcattgctccacttgctgcagtccacatcattcacgacggtcggaacgccagggtttgcggtccagaacgtttcgttaacatagttgtatgcacacgatgttggtggcttgcagcatccagactgcaaatgtcaagtcatgaaatggtgttagcatataatccaaactagatattcagaacttcgctcctatggttttactatcctaatggacatgaaaggaagtgacaagacaacaaaatgcatatttacagaatgtagttttacaagcaaaacatcatagctcattgactgtaattcactcctggaaatcccccccccccccaaacacacacacaaaaaggaacattttgttgatcagaacccaaatcaacatcattaaccagaaatattcagcgttagaatttaagttcttgcaacttgttcatggggacaactggtgtaaatgtgcacttaaaaaatttgactagtacatactccctccgtcccaaaaaaagacaaaccctggtttccgtgcccaacgtttgaccgtccgtcttatttaaaaaaattatgaaaaaaattaaaaagacaagtcacgcataaaatattaatcatgttttatcatctaacaacaatgaaaatacgaattataaaaaaatttcatataagacggaccgtcaaagttggacacggaaacccatggtttgtctttttttgggatggagggagtaacatttttttagatatggaagaactagtataatttatctacaggtagctttacatccaacataaattgaaatgaatagaactacaatagcactagcttaacaacacaaactgagcattttaaagtaccccatagattgggacagtatgtacaaatttggggagcaattatccattttccatcaccttagactgccaagtcttgtcgacagcaacaaacacaaatataaccgaatacataaaaagatatcctatattcaacacaaaattgatggtgccagttcgattagagatcaaacatgcatatgtctacatgaaaagggaaaacaaagcaatccgactctaaattaagggaaaccacgaaccaactttgaatgctttcatggtcaggacatgtcctacaaagtacaaagtatgtacccatgcacattaaactatacaaatttcttggctccatcaaagtaggcctataaagacatgggcaacagctaatctgtataagaatatttatgcaatccatagcataccagtacagtacagtctccggtgaaagactacaagagaaatgggtttttttttttttcatgtgatctgtgaaattgtagcaaaaaaaaaaaagactggcagttacagaagacagcaacgagaatataaaggacaaacaaggcaaggcttccatggtccaattccaactctcaaatgaggcacctagcaaccggcttttagctgtcctgatcgcattttgttgtgttgggtaagaagcgagaggccgtgatcccttcaatcatgctaatgctgtggtccaccttgtcttttggtatccagaaaagaagagagaaaaagctaggaaaatgaccttgtcctcagcatcacagcatattgcagattctacttcttaccactgcaatagtggcaactctgaaacgtcttagtattatttggtcttagcaattgcaccagcaaggtcacctaaggggaaaaaaataaacgacatagacaaagactcaaatcgaccaggcagtcaattcttgtcacataggtttcttttggtgcatagcctggagttggaggtaccaacttgctccataaaaaaggacactgctttgagggagttgtacacacttcaaagattgctttgagggagttaatcattcaagatttgaagtctgaatcaccctaaataggatgtacttagggcgcgccgcatggaatttagacaaaattccttgcaatttgaagcagttcaataaactattaaagcaagaaaaaagattgcttttgaagaaaggtatccggtggaatcgaaggacgggtgcggctaaaggtttgtgattttcttgctgctttggccaaatcatgggcaagcaaaaggttgcaggattaacaatttctcgaaggtgcaagctgatgcaggaacaaaaatattttaaagggccatatgacttgctaagcaaaaggggggctgctgatgaaagtggtaagcaaagcagcacatcttgagatccacatgggtaccatgcagtgataactgggaatatcctaaccaaactttacaacaagaaatcagaaaacagtataggtggttgttcccttccttcaaattgaatcaataatccaatcaagaccgaccccaaaaatgcaaatctttcccctaattgatgaatagagctccataaaaatgcaaatctttccctaatcctctcttatttttgtgccacaaaatcccagccttttctacactgacctgtagttggcaatggataaactgctaatgcccatctaatccatccaaaactcaccaagaatccaacctttcaactccagaacgcctaaaaacacatcgattctccgctatttttagctccttattaattcagttcatttggaccaaacaggaacaaatcaaaaaagaagtcagtttcctttcccccctctctgagcgcgtcacaactacgccaacttccaaaatccgaatcgcatcagaagcagcagcagtcaatctcctcaagaactgacgaatcaagagagagagagagaggagagagagagagagagagagagagggagagagattgtggtggtgacctggatgggggagaggtcgcgggcgtagaacatggagggggtctcggggacgagcatgccggtgttggggtcgcgggcgaagcggcgcatggcggcgcaggcgcggccgtcgcggaggcaggcgctgatggtggcccagtaggcggggtcggcgacgcggtcgcggagccatccgttgtagtcggagagctggtactcgaggaaccgccggttcatcaccacctggccgtcgccgcggtcggtgacggcgaaggcgaagacgatgaagaagaggagggcgacgacgatgaagaacatggcgaagaggtagaggcggagcagccacgtctggcggtagcacgcccccgcgaaccccatgagggacaccaccatgacggcgagcccgatggcgatgatcggccactgcaggaagcggatgcagtcggtggagttggccctcgacgccagccagattcctccccccaggatcgggatcgagatcaggaacgtcacgaagttgacgatccccagcaagctcgtccctcctcgcaacatccttgctcttgctcttctccttcttcttgaatcaaaccaccacctcctcttctcctgcttcaattcttggactcctcctcctctgcttcctcttcttctctctctgcttcttgctctgcaactgcaaatgcgagggggagaggagaggagaggggagaggcggttggggggttggtttttagcgagaggagcagctgcagcttcagctccagcggcagcagcaacagaagcgcggagagagagtgtgtgtgggagtggggcgtattatacgtcgacgtcggcagtaggaatacgtatacgtgtatacgtactctaatttatttcgtgtaatttcttccgtcctaaatgtaggagtattatatttcacgtttagagtaagatttttttttccaaaacgcaataaagatatgaacacgtctctaggcatacgcacgtacatcatagtagaatgagcatatctgtatgactgtaacgatacatttcgatatcgacggagtcatccgaataaatacctcccagagattatgctggaatatttttaatattaacaaagtcaccatgtacatacaaccgctcacatttagtatatcgcataacacttgaaaacaatttgccatgaatacaataacttatggacctatgtttaacctctgtaactgattccaaaaaaaaaaagctagtaactacccaggtcacgattatatcaagattttaaaactatgactaagtttataaaatgtaatggttctataacattgtgatattaccttttatgcatatgatttttttataaattattagtggataagttttaaaatttaaactaaatcatatctaaaacgttaattaaatacggagtgtttgtaaacagggatagtatagcaggtgggagaattgctcggttgctttttgactttatacggcttgggcgtccaatgtacgtactcctttgctgctactcgtactaatcgtatcaggttttcactggtgaaagtgattgattccactgctttgcaatattgaaaacgaatcacagttcacagccacatggtttttttctcgattatcgatgattacacgtttccatgatttacttggtaacaacatcaaacatggacggtgcctacgaatgtgatgtttgcctgaaaataggtggcaaagtctgggtatttcacatttgttgttgaaaatactttaatccgaaatggagtaatgttcaacatttttcttaaattaaaggctttcgtccagctttttactgaaaacataggagttcgatatactggtaaaatgtgaaaattacgcaattgaggctgtgtaagataaatctacattagtgtcctatttggaatcatgatgatttcataactaaaatgtctcaaaaaattttaccagttcagttattttctatgtagaaaaattaggaattttccatccacaaaggtagggcatacaagtggatcccatgataccttaatttctctagtattacatgacagggcatggttgctaggttactctctaagatatagaaaaatggtgcaagttggattattcaacagctaatccacctgaaaatgatgaggaaagcaggcacatgcatgtgcaatggagtgactacacagcaataaatatgaaatttcgacttgatgccaggtcaacatcgatcgattctgaaccaacatttagataattcgatggttacactgttacactaactaacactacttacttaaatacaaaaaaggagtttcttaatacatcaagtggacttgtagtgttagttagtcaataactagttatgggtcatgaggtgcagtgtgtgtacatcatgggcagcacaagatgggacattgcagggcatttacatgacacatctagtccataaatataaaatattttaaaaacaatgtaaagataaatagttttatttaactttgacaatcaatagataaaagtataaaaatttacggcgtaaaaatgatgtaactagatttatcgtgaaacaaattattgtaatatatatgcaactatatttatttaaaataatttatatttgtataaattattttagtcaaagcaacgtatcgaaaacgatgtcctccaatattttatatttgtgaaccgagagtagtacaaagtgtgatcctactgatatcatgttaaagtattccttcctttcataagagaagaaaatatctttttgatttttcaagtatagaacatgtgagtcacgcatatgagaatgacaagtccttttggatcaaggaaaaaaccctcaggaatatggggatggagacaaagttgatgatagaacatccggggcaaagggatatatacaaaggaccagaactcattttcatgctgatctttgaggggtaccaatgaacatggccagatactctccatttcagagaaagatgtattgtacactaaaatgaactcaaagtgttatatgtgtgtggcaaacttctcaaagtaaaaggtagtatgatccatgaaagagatagagaggggaatgggattaaatgttgtatagaaagatgaatggttttctttcctttctactacctccatcccagcttagttgtcgctttgactttttttaacgtttgaccattcgttttatttgaaaaattagtataaatataaaaaatgataagttataattaaaatactattaataaaaaagcaaatcacaaacaaaataaataataatttttatttttttaataagatgaatgatcaaaagttataaaaagactcaaagcgacaagtattttgggacggaggtagtactctagataagatgatgctaacgagagcttgttaggtttgctaccatgccaatgtcaaatcatacgcaagtctggttaacgctaatattttaacaatacaaatgtgttataaataaatatcgatagcaaatcaaatattaacaaattactatttaatatattaatattttggtaggaaagatatttaatataccaatattctgttactgcagatattgacttcaaacagaacatgctctaagatttcgaatttgtttcttgatactctacatctcaaaattatttatctattttgcgaacatcaatttcaattgcagcaagtaagaaaaataagacaacaaaacaacaaatacataattaagtaaaaaaatgaaccgtgtcttgtaaactgtgtctacgaattaaacatatattctctatgtccgaaatgcttggtccattttataaactacttcctccgtttcataatgtaagtcattttagtatttcacacattcatattgtatttaatgaatccatacatatatatctatctaaattcattaacatcaatataaatgtgaaaaataccagaataacttacattgtaaaatggagaaagtacgactctaaaaaattagcagcgtcgttatgtaaatcggagaactaactcgaagtaacaataatgattacgcatgacgaaattacgagtaaactactcctaatttgactcctttgtcaattgtcacgctcaccatcgacacatcacaaggcaaattaaaccaccaacattccaacaaccggcaccggcaaaactggcgaccaatggccgcgcgtgacgtgtcacccccaagggcgccacgtcgacgcacctacatcagccttggcaggttacgtgtcgagggtccacggagccacgtggcaccatcctgccggttggttggcgtcatgagctgactctgatgatggagcaccaaccggataagctagagcaacagtgcccacctgccacgtatgaattacttatccattgcgtcatcctctataacagaatatgtgccctgtttaattactgctccatccattttacaatttccatccgttgatgatttgacttttttcaaacttctttaaatttagtttaaactatagagagataatatttttaacactaaataaacatcctatgaaaatgtaatgttagacttaatgaaactaatttaattttttaagagttattacatttctctatacatgctatagttattgaggtttaacgtaaaaaaagtcaaaatagtttacaatatgaattacatatgtagctaaaaatcattctgtatgttatacaaatcttttgcttctggctaggatgtggacccaagcgaataaagggacgatgtttttttttttcttttttttctcgaaactcaatataaacacatacgcaagctcaagctcaccctttataaactcaaacacatgtacgctacatctatgagctataaaagattggttagtatattttaaagattgaagatgtcactatgatgtttcgttgttgagtgttatattgtgagatgtgtaagtttcactaaaaaaaaaacttttttcattttttttctcttcctaggaagagatggacttaaccagtttgactatcagagtagaagtaatgtattttctctagtaacatctttatggagcatatagccctatactacttttaaaaaaattaaagataggttgacctaagtgcgtagtatgggcatctcgtggccaagatatcagcagtggactggttgcaccggccaaagaagaacaattctgttagatcaaggactaaaatcaattaaaatacaaatagaacagatcatagcattgcattgcattgcactgcattccagcaggttcagtcatgggtcatgcaggttgcagaaacaagttacagtaagattctcccgtctcgtgtgtaacgtacctacgtgttcgatcatgcctggtcggtggacatgttgcttctctttgcttactcattactcattccgtccaaaaaaaaaaaaagacagactctggtttccgtgtctaacgtttgaccgtccgtcttatttaaaaaaattatgaaaaaaaattaaaaagacaagtcacgcataaagtattaatcatgttttatcatctatcaacaatgaaaatactaattataaaaaaaatttatataaaacggacagtaaaacgttgacacaggaacccacattttatctttttttttgacggagggagtaagtacttactaatataagtagtttacttgttaggaggtttactgtacacagatggaagttcctgtgctttgcttgtagtactagctacctctactcaatttccaggtagagcaattgctatggactatttattggattattatcatgaatcatctagttagttgtagaaatatattaaatatttttaagtaaagttaacaatagtttataataacttaaatcaagtattctaattaagtaatacagcacaagaattttttttaaaaaaagtgatttcataagtattcgaaacaaataatcttcaacaacaacttggtgaaaaagctaaaaaaatagtataataatgaaaggtctcctaggtaacagtatatcaatcctgattatatttcatactctctttaattcccagaacatatacatctctcctgcatctgtgcagcgtgtttagatctagaggtgtaaagttttgacgtatcaaattgggtaatatatagggtgtcgcatggtgtattcggacactaataaaaaaactataattacagaattcgtcagtaaacagcgagatgatttatcaagcctaattaatccgtcattagcaaatatttattgtagcactacattgtcaattcatagagtaattaggcttaaaagattcgtctcgtaaattagtcgcaatctatacaattaattatttttagtctatatttaatacttcatgcaggtgtcaaatatttgatgtgacagtgtgtaaaatttgcgtgtgggggctaaacagggcattagaaatgacgaaaaggatggcagaattaattggttgataaggatgttaaaatttattaatcgtcaagcagttaagtcagatcatctctcacgaaatgcctgcgtcatcagggatctcgatcatatagatattagttatgcagggctcggataagagaaggacaactcgatcgattactttttttttttacaaatatacgcgaatccatgaaaagctactgataaattcagtggatattcgattacaatctgaaaaggataacaaaaaaaaagggcatacaaatcagactacaatattccttctctgcttgctattgacgcgcagatagacttttgacgctaaccagctcctgcctttggatgaacagatatacacacatgattcgcccttccaccttaagcttaactagccgtatttgcaacacgaattgttaagtttaaacctatttttaaataaaattagaattaatgtgtctacgtaccaagattttgttcatgaattagtgaaaatgtgcaagagctctatttgcctctcctattctatgagtcatttcccttctgcgtatggcaccctaccttctttggcatcatctaatttgaaacttaatttgaaagccatattttaatctagatgtttttgggatgcttttaataaccaactaatgacaaatgttcttccttgtttagattctatttcaatcgaaactttccgcgttgatcctggtattcgagtactttattgaagaaatatacaaagataaaatttctctatcctaaaatataagatattttaaaaatattatattttgcgtatgaaggtagtaatcgctattgtgaagacacgaatgttcatatttacgcctaattatttttcagtggtaaaagaacatatctgtcacagtagaatacatatggcctcagccattctttaaaagatatcattacggataggacgtatgtgtatatgagtttgtacgtatgagcagctgcactactttgaaagaaacgtattttttgggttacactagctagagaattacttcctccgttacagctgcaatcttagaataaaatttgacctattctaaaacgttgaatctagactaacctatatatagattcgttattttatgataagtcaaatcccatataaaactaatagtatagtttactactaactctaaattatttatagttaatttaatatagtcaattcatacaatagctacctatatattacactatcgatacatggtgccagatatcatacacacattgtatttcgaagtccatgctacagctggctataaatttgtagtccgctgctttccctttcttttatcttctctttccctttctcttttatcttctcgaaatactccctccataaaaaaaaagacaaactctgggttttcgtatctaacgtttgactgcccgtcttataataattttttttatatttagtacttttattgttgttagatgataaacatgattaatactttatacgtgacttgtctttttaatttttttcataattttttcaaataagatggacggtcaaacattaggtacagaaacctagggtttgtcttttttttacataaagagtatgtttatagctggattatatagcacatgctctaactaatgttttgggacgcacgtactccctccgtctcataaaaaaccaaccactgaatatgacacattccagtactacgaatctgaacgtatttttattcagattacttgtactagaatgtatcatattaaggtctagattcaccttcttgggaacggagtgagtagcagcctgctagtgcaagcgaggcagcaggacaggacaggtgtccctgaaccaaaggctacgtgccatgccagggaagctttgaggtgccacgtggcccaacttcctcgatctgttctagagttgtcctccagctgagttctgcacttgctaaacatttcacacacacactcaacttgagaccatagcattctcagcttagcaccagctagctagctagctacctgaatactacactgaagaagaatcgatcgatatctgaaggaagtgaagtaagtgatgggttcagagacgttcttggagatcttgctggccatcctgctgccgccgctcggcgtcttcctccgctacggcatcggcgtaagcagttcatccttcattcttgttttgtttgatttgatttgatttttcatgcattcttgctggctgcagatggagttctggatcgccctgctgctcaccatcctgggatacttacccggcatcatctacgctgtttatgtgcttgttgcttaattagttagttactaccagtgatctgttctgatcgatcgattatgttagtatcatggtttagtttagttggtttctattatgtaagtcgtactagctgctacttacggcatgttcttcggttcctgcttgcctggatcagtggagctagtcgcctagactagacatcgatctctgtagtttctgtcagcattcagaaaagtgtgatctgaattctgactttctgatggatcgatgagtatggatgattcatgtgtgatctgaatggatgatgatcttcatgtatgtctccggtttgtatattcagacattcagtttctttcttccgtgggtatgatcacagcaaattatatcatgttgtgcgagattaatcaatgaagtattcttcggggggaaaaggattaatcaatgaagtaattggcgatcgattatcgtgttcatgagcagtcctagtataaacatgtgaccccaaacgaagctatgctcgactagttgctgggccggcccatgaaacaccaaacaaacacagtctacagaaaaatttcaactgccgcttgtctgacgcatgcatcaacaagcgggggttgctagggcgcgcatgcgcgccagaaaaatagctggcgagcatttttattagttaatatacttaacactgatgatagtaattaggactcctctttattagttaatatacttaacactgatgatagtaattaggaaaaattttggagattttttttttagacagattgaaaattttttaagttagatttgaaaactttcgatttaagttttaaattttaaagttaaattttaaaaactttcaactcagaattaaaaacttttaacttgagatttgaaaactttcaactcagattcgaaaactttcaactcgagaatcgagattcgaaaactttcaaatccagatttgaaaattttgaaaactttcaactcgagattcgaaaaatttcaaatcaagatttgaaaattttcaactcaaactttaaaaacttcagattttaaaaagttgaaaactttcaattttagatttgaaaactttcaagtcgagatttgaaaacttttaagatcagatttttaattttcaactcaaaatttaaaaactttcaaactcaaaagatgctaaagataaaaaaaatcagaaaaaagaaaggaaaaggggaaaaaggtaaaaaagaaacgaaaaaaaaacgcagaggagacgcgcgcgcgccggccatgcgagatgtctccattctaaatggaactatgccctgccatgcgagaaaattaaatattttttgtttagacagcgagaaatttgaacatgaagcaacaaaagcatgcattgcatacaggcctgatcagctaacaacacaagatcactcttgtcaaagacagcatgcagcccaaaatgtagatgctcctcatctccaacatcattacaagagttcttaacattctttttttactgcgaccacagcagcaaaaccaactaaccaaccagtagtaattaacttaactagctttgattcacagtgtttgcagctaaacccatccatggcgtgatcagatcagctcagcctagctagtcagtttcagttctttctagtacacacaccacaccaagctgtccatggcgtcgatggtcacttggggctcttcttccacagcccgctcatccgccggagcacgccgctgttgcgccgcttcggcgactcctcctccggctcgtcggagaacggcgagctcgccagcttcccgccgatcatggagttggtgtactccgccggctccagagaccccgtccgctccacgttcctgccaatgccgccaccgcctcctcccagcgccgccgccgctgcctcggccgccttgcgccactggtcagactgcacccggaggcgccgcagctcggcctccatctcgacgctggccgcctgcgccgcgtccagctgctccgacgccctggcggcgcgccggctgctcttgtcggcctcctccgtcacgtacccgagccgcatccggacgtcctgctccgccgccttggccagctccagctccgccaccgccgcctcgtacctccgctgcacctccgccgccttcttccccgcctccgacttgagcgtctcgttctcctccatcacgctctgcagcgccgtctccttgtccatcaggctcgccttcagctccgtcgcatcggtgatcgacttcatcagcttcgcctcaagctctggctgcatcacatcgctcttcccgtcacacctgacagccaaagtggccttcgcttcagtgagctcatcgttcttgctcttcagctccagctcaagatcgcgcactctgcggtcgtactctgacttggcattctccagcatttcgtaggcggtcttcgtctcgatcgtcgtgcgagtttgttcttcctggtacctaatctcagccacctcgagcgccgtccgcagctgctcaatctctgcgccagaaccaccacagctgccattgccattggggatagttaccaccaccttctccacagcttcaccatgatcagggctgccaaagctgccatcaacatcatccttgttatgtgccttcttcagatcttcctccagtgtggctaatcgagccatggactggccgagctctgcgtccttcgacctcaggcattcttgcaaccgggcaccctcagcaagcagcgagtcaatagtagcttgtgccatctcaagctgcttcttggtctcagctgccaccgcgttcgcctcagctacagccttgtcgctctcgccaacgtttaccttcaggccctcgatggtcgcaagccggagctccatctcctgcttcaagccctcgagctcagactccgcaaactcgcattgcttggcacgagctgcatcagactctgtggtggcccccagctgctgcttcaacctctgaatttcagacaaggctgagctcagagcagctgaatccactgactgctgcttcttcacagcctcgagctcagactcccaagcacggtcacgctcctgtgagaccttccgcagttcctggagtcgggactcctccgcagctgagaactcggcaagctggcgctgtaggtcctcgagctttgaggttgcagcctgctcctgcttttttgcttcctctgcttcctgttgtgtgtggcgtcttcgtgactccgataagctcagctgctccttggccttcttcagctcatcttgcagctggctgaccctggactccaactcggacagcctacttgggcgcttctggaacagggtgcaaattgttcagcgaatacccatttaagaaaatttacacttactaaatcaaataaagaaaaccacatgacaaaagaacatgtatttttcctgtgctaaatggtttctgaagtcaatcaccatcattatattacttgcttgcttacaggttaatgaaatattcagaatttgtgtctgaacatatcatttctataaataaatctgcagtcccaaaatgtatgttgtgctaaaggttcacttgcttgcccaaagccattgcagaataatgaaatatgcagagttttggtgttgaaacatcttatgagaatttgaggtgcacttcttaaaaaaaaaatatgcttctaagaatccaccaagtagtgaagtaaacgcgatgcctgcaaaacatatcagcacctcagtaattgggcttcgtggtgaccgacgctcggtgaccttagggctcctctctggagtggttcttgttggtgtgatccctgcagagtcagtttcattccctccagttttcgccacccgagatgaccgtggtgttgccggagaagccttctgtggggcatctgaaggcccattcctacacaaatcaatagccaaaaaacatgttatctaattgtcttgaagatcaacagactaacaacaacaatagaggtattccccgcaaaaaaaaaaacaacaatagaggtattgagggaaacagaagtttaatgattgtaagtactgtaattaaccgcaaacagtacactaagcatgaagttgttgaacaaccgagtgtactgatataccaactttgaagacaatgttttcaaataccatctattagtgcggatttttttagatacagatctattagttcacatgccagatgatgaagagattgataacaggagcagtacaataatctgagaaaacagttggcttacacaagactaatcaagagtagtacatccaaaaactatttcaccagtaggcaaccttcacttggttgtgtacaagatccagcaacatgcaaggtaatactagtaaataagcacaggaatgttctcattttgactgttctaagttgctaccgatgaaaaaaaatgatcttccaaaagaaaaggcctaatacttagcaaagatcaagtacactagtgcattgtaagatttatggtatatttggcaagtaacaattcatggaaaattcaatctgcaatggccccccctacatcagatccattttaatacacacaaccttggatactacttagtactgtctggtcatggtgtaaccactgtctcagacacgcacatgcatgagcagaactgcatacctgctgcgaaaacaagagcaagaggcaagatacatgaaagttctaggacaaaaaaactaacctggtttttgaagtctgcataatgagatcccttaccaaatccttctgagctcaccttacttctgcaagaaagaaagaagaaagaactcatgaggtaagtaataaaaaaacaaagttgcaagttaattacaactcaaacatgtacgccaacacaagattatctggttgacatttcacttgcaaattgcaaactttaaatgcaagaaaaagcaaagtacagtggtgaaattgtactgttaccgtatcaaaaggtacaggttattagcataggcatttttttagaagaaacaaacaacagtttggaaagctatggagtagcaaagccagtacttaataaaatggcataggatcccactaatttgaaatttttacagaccaagaaagatgaaaggaaagtaatgtgcactacatttcttctcacacctgtaacctcaggcagaggtaacagtgcacctagttgcccacagccacaaccacaaggacccccaatggcctttggcagcaggaatccggcaaacacagcaggaacccattcacacaacaaatgtaaaaaattgcaggaataccaaactgcccttgattcatccaacaccatcaagatgaacagcatgggctagaatggtcattctctctcaagaggggaataataatagcagccttacatggaatggagcaatagcacatagcagaaagtaaagaaagggagggtcaaaaattcaaagtgagaagaaggctgcagtaaacttgcacagttacagagaaggccctgtgtgtgtgctggtggtaaagccattctgccattattgtgaatttgtgatccccatgggtctagatcctgaaatgtgtttgcccatgtttgtagctggttcagtgaagcaatgcattcatgtggcaagaacctgagcggccaaaggattaaaattcattgcagatggagtgatgggaggacctgacagatgcaagcagcgtgattcatgctctcagctaaaaatatgggagctttaaacgttttaaaaactgaaacttatctgcatttcttgcagtaacggcaacgccattgtatttcggattaaagcaccggatttctagtgctactattaacagtattaaagggtatttattgctaactctttctcaggttgcggtttgcaagaacaagatgagaatgagaagaaagaaaagaagaggattcaaaaggaatgaaccttttttaaggaaaggaatgaacttactcctcaaaccaaataaacaacgagacatgaaacaaagagtgcaggaaaaacaaaagggatgcaatgcaaaaggagctagcaagaagaagcctttcttgatctttatccctagctattgaaacacgccatggacatggagaagcccagcaaccatgagagctctcaccctttcttcctcctcctacaacaacaatggccatggtccatacatacaaagaacccaagaaacaaccccacaagacaatactgcaagcacacacgcatttccgcaaacagaagcagggcatataaatcaaaagcaacaccattctcacctcacctctctcttgctcgctctctggtgattcttggagctccctctcctccctccaactcctctcctactgccttgctgcagctgctgctgcgtgtgtgttgtcttctactgctgctgctagtagaggagagtggacgagctagcgtttatgcggccgctgcgcctgtgcgcctcgctgtgccaaagccatggccgtttgcgtggctccgccgcacgaggccgcgcacgtgtcccggggcgcgtgtgggggcccacgagtcagtggcacgtgcgtggcgcatggcccacctgtcagtctctcctctccttccgagtgttgctggtctcgaggaggaacggtgtgtggtgggctttcggcgaccggttggttggtctgggtttacatgtcactgcagggtgggggccacgatggtgtgaggcccacatgtcattgtcgtgaggaggtcaggtgtccggtcagagagggtttggctccccgacaagagctggtgagtcaaaggaagggaggcatcgtccactgaccccagtaatttattgcgaggaaactgtgaaaaaattccagcatactttgagagggaaaaaaaaagaaggattggggggtgttctgcttttggtgccttcttttctttcttggggtgattgcatcactgcatcgtaattagcgagctgtgattatactactactagtgtactaatcctagcataagataatcgtaagaaacgggttttataatttttcacatcatatttatacgcatgtgaagaagattaaagagaagatagaagaaaaacagattaattattacaaataatttgtagccaactatagctcagctcaaaaaaaaaatatacgagagataggtgagccagatattaatagtgtattagtacatatctaaatctaattattactccctccgttttaaaatataagcatttttagtacagtgacaagttaaatatttttaactttgacttttaatagtaaaaaaaaaaaaagattaatcatgtaaaattgatgttactagattcatcatcaaacaaactatcataatatgtactccctccatttcacaatgtaagtcattttagcattttctcatattcatattgatgctaatgaatctagacatatatatctatctagattcattaacaacaatatgaatgtgagaaatgctagaatgacttacattgtgaaacggaggaagtaattctttttatttaaaacatcttacttttatagatattgttggtcaaagaagcatcttgaaaaactgtcaaagtcaaaaaaaaatgcttatattttaggacgaatagagcatatgattaggttatagttgtagatgatagttaatttttagagctagcagttagatatgttattaagcaagcactcgattaggattgtctcctgcgtcggcttctttacttgtgttgagtagagcagaaattcttatagaaaaaacaaatcagaatcacatgggaaggattagttttgattgtgaacaataattgtaaacacattcaaaacaggtgctagagtatcgagaggaacaacaggtatattgaatatgattatatgatactcccttttcctaaaatgtaagtatattttaagttagctacaggtacttaatgaagtaggttgagattaaatggagaaatgttttaaaatatataattgacgtgttgttaaattatatgaatttctcaaaaataatagtcaaattagatatattaaactttgaacaaaattaaacgacaattagcttgaaacattttttttgatgaaatgagtatatatctggtaattaagatgcaaggagtaattaagttgaaatgttgcaaggacaaaccattcaccctatccacttagcttagctgacacttcttgacactgcattgctgtgacatcaattatgggtgcacatatataggtaggatgcaaataagacgatagtgacctactgacctctgccctaaggcaaccttcaatctgctatacttattatagaacaagaaagaaggcaaataaacagtaatcagtaattgaccgtttagttgttgattatgaacagcaaactaaatagctgttgattattttagaataagaaagaaagcaaataaataggtaggatgtaaataagacaagagcgacgcatactgcatacacctgcaacaaagaaaataactgttactttttcagaaataataaaaccacataggaaggattagtacgttgttgattatgaacagcaaataaaaacattcaaaacatgtaaagttttgagagaacaacagatattgggcatggccataaatatgatgaaatgtagctcatgcaaagagtaattaattgtccatcgatttgcctatagctaattataaaatgcacgtttattagcgaaaaaaaagagtaaaacttgtataaatatgtttttaacgacttaaaaaccaatgctgaaaactaaaccatgatgaagaaaacatcaaaatgaactctaaaattaatatttaaaatttcaattttggctatgtccagggaaaacaaacccaacaggaaaaaagacttctaaggccggcttgatagcacaaactgttttccaatcaagttaatttaaaaaattaaactgaaatatgttctttttaccgaaactgttcgtttttgttggtttaccacggtttttgtaaaaaccgaagaaatcactcgtgagcattttttgtctagtaacaggactgtgaaccctaataacgactaacaagttgaagatcaaacgatgaaactcgttgaaatgtttcaagaaggcattcatcctatctacttagcttggttgacattgcattgctatgagattaattatgcgtgcacatatataggtaggatgtaaataagatgagagagatctttgccctaagacgtacaaccttcagtctactagacatattatacctgttcatcatattccattttttaacacaatttttaatcaagagaccagcgaggcagcgagtgaactttttaaactaactctgaaaattcactctcgaggaaagtcaatccaagagactggtaggtgctactataatgcagcgagcatgctaagcaaaatcactaattgacagaggctctacttgctttgtgttgattcccttctagaaagtaatagatagtgtgcaggctgcaatcaggcaaccgctagcttcacaatcaagatacttttagtcactaatcaggaattttgcaaaggagtatgattagctcaaagactatataggactgaagggtggtgcatcatgcctgaaaaatcatgctatgtggacatgtggtactactactacctgaatctctttgtaggcacgcaggtgttgcttgcatctgaaaaaaacaattgatcctgcacctaacaattaatcttgcttcacttatctgaataatgggaacgcagatccagtgacattctcccatgacattctcgtgacattgagccactgacatgtgggacccacatgtgcctggacccacgtgggtcccacacgtcagtgactcaatgtcacgtggaatgtcaccgagcaatgtcaccttaatcccaatccatctttagcatcaagctagcttagtgggccagcccttagtgtttttttttggttgcattagtttcatgcgtggcctgcacaatttcgtagcatcaatttagaaacaaactctcagaacaaattttggaagcaactccaacttaattatggtgtatgtaatcctatctcttaaactagattatgagcatctcttggggtgcagtagtgtactgttgagcaaaatggcagcaaagctagcttagctagtagatacagtaccattgttcatctgttcatttcatttcattaaggtggataaaggtacagagatgacaagtgtacaggcgcacggggtgattacattaactacactggatctagtagtttaattagcactaaacatcttgctcggtgagctatgttaattagcagctaaggcatggcattgccagtactgactgtagatagactgtcagctgctggtgtttgtctgatagcttgatttggactacataatggaggtaccacctcctaaactcagctcattgctgtgtggaattaagaacagctggttgaacaagtgacaggataggatgcagtacgtagttgaaactattatttattttagttgtgacttactttattattatttacagtactttaagcacaacttttcgttttttatatttgcaaaaaaaatttaaataagacgagtggtcaaacgttgcaatcaaaaactcaaaatcccttatattgtgagacgggtgagtagtaattactaattgcccctactactgtacctaactatatgcattttctgtatctgatcactaacttcacttttttctattgaaataaaaagaaagagaagaaggttcagatatggcagacaaaggccctgaaatcatggctcattatgcgttcatcagaacatctcaaaagcaaaggctacttattacaaaatggaacactgttttcttctagtatgagctcattaattggttctgtgaatgaaagagcaacacgagactgagcttttgcatggagtatgtatttcataccggtttgtgaaggttaaaaacttaaaatctgagtaccaagtcagaaacatgaactccactaacatatagaaaggagaaagacatgcagaagaagcatgaagactttgcccatgcaattcaaagttcatcttcgatgtaattaaaatcatctgcaagttcaatcaaagccatgagcccatgatgacttgattattactgcccaaataaaccaattgaattattgatgggcctgcacattgatattttatgagacaaaaattaactgaaatcagggcttgcacctcaaaatttgtcgtgaataacattgtaccacatgactgtcagacaaaatgatgcgttaaccaaattcagcccaagattggatcagtatcccaatttggcccaaaatttgtagcctggtccttgggccaaagaatcggacggccttcatcaccagcctcgtaatcgacccaaattcggcccaaaataggataaaacaaaattcggcctggaagaagaagatcaaaattcggcccaagcactgaattcagaattttgctgttccattggaacaaaaacaagacatgttttgcaactctgcagtggtgaaaagctgctttggccaaaagggtgaaagttctcttggacgcatgccattcttgccttgtcttgaaacacagaaaactccagctgctgtaaccacaagcaatgcaatgcaattcatgcccctcaagaagtacagtaaatattcaggcagttaaattccaagatttttttttaactttctgctaatgcattcaccttcccatctcacttcagaaggatcatagccagtttctgtttcactatggatcattcaactcacctgtagtaagtacagaagtttgtgaattccaagcacaaaaaaatggaggaatatttgcttacctatatcttgtaaatgcattgatgaaacctgatacagataatcacggaaaagggttgctggtaattgggattgggataatggtgtgaatcttttgccaaccaccaacggtgtgtgtgtgtgtgtgtgtgtgtgtctatctgcagcatttgcagagtttcagagatggcagtttcggtttcaacctccccaatccccatggtatatgcttttctttcttgcttctctttttttttcagaatagtccagtacctttatgtgattcacaacattacccccaatgaaatttgatagtactactacctttaaagcacgtacgaaaaacagtaaaagttgcattacctgcatactatcaattatcaccgtcaattatagagaacaagtgtaggaaaggcaggtttgcatttgttgtcaaaaaaaatattgtagcattattaaggatattctaaccatttatacattaaaaaaatgaagaaagcacttatataactagtatatgataaaattaaggacatgcagcggtgcccatcaagaagatttttttggttttaattaaggcacaattaaattccatcctcttcatttcaaattactagtcattatgggtttatcccaagtcaaatattttaatctttgaccatcaattttcaaagtaaatatttagacagttaaactccaagtttttttttcaactttctgctaatacattcaccatcccatctccacttcagaaacaccatcatcagtttttatgtttcactatggacattcaactcacctgtaaaaagtacagaagtttgtgaattccaagcacaaaaggttgtaggaatatttgcttacctatatcttgtaaatgcattgatgaaacctgatacatatatcacggaaaagggtatgttaattgggattgggagaatggtgtgaatcttttgccaaccaccaactatgcagaatttgcagcagcagcagagtttcagacatggcagtttcggtttcagcctcccttctccatggcccatggcacagcttttctttcttgcttctctttttgctttcagaaataatccagagcctttatgtgatttacaacaatatccccaatgaaatttgatattttttagataatactccctgtttcatattacaagttactttaattttttttcttaatcaaatttattttaagtttgaccaagtttataaaaaaaccataacaacactttcaacaccaaataatcatactattaaaatatatttaatgttcggtttaataaaatttgtcgggataaccgaaggaggtcatccaatgttattaagatagaaagaaaaggttataaaaaagtttttcaggatgtgcactagagcacacgtcccgaaccatgtgccaaccgcccagacatacactatagagagggaagccgagcactgaaccagtcgttgctatgcgagaccggtcgccaccgggcttacaacaccaccacggagcaaagactgtaaaaaaacgacgccctcacgaaggtcgcaatgccaaaagacgccgtcgtcatctgtccacgatatttttctggtgttaaaagagttagtacatttttctgtaaaagttggtaaaacttacaaaaatttgacataaaaaagaatcaaagcatcttatacggagtaatatgaaacgaagagaatatttaatttgatactacctataaaccgcacaagctgcattacctgcataccaattatcagcgtgcattatacagagaacaggtgtagaaaaggcaggtgcagatttgcatttgttgtcaaaaaatattgtagcattaaggatattcaaactatttacacattaacaaaacaaagaaagaacttatatagttaaatgatgaaattgatgacacaggcaattgtgcatatcaacaagaatttttttggttgtaactaacgcacaatcagattacatctcttctttttgtgtacttaacttgtgtcaatctgtctatatagtatatagtctatacaaaacactaatttcttgtaagaaatataattttgtgcgaaatacaaggtcctaattgacaaatccacagaagtagtactccaggagtacttctgttctgcatagtccaaagtccagacaaaaaacatttctcacttaacccctcgaaaacattcgaaattacacacttacaccttctacctctgctactactagtaaaccccaagccaaaccctcctctgctccggcgagctcccacctcctccgtctccaactccggcgatatctccggccatctcctccagccccagcaagaacaccactctccggtacgtctctctcgcactctcgtgtcctctcgacaggacatggtgctgatcggtttttggcgcttgttttacttttacaggtggcggaggatcgccatggcgccgccggagaaaggcgcggcggcgcacggcgcggtggccaagaacggtggcgagggggaggtgagcgccgtgaggcgcccggggcggcctcgcgtcgtgcaccctgacgtggcggagttcctcttgaacttccgccgcttgcggagggagaagaagaagcgtgcgacgccacggccggcggtggtggtggtgcccggcgagcgcgcgaggtacgactgcgccttcgaggacgagggggaggtcgggcggcgaggagggttcgcgcccgggcggcttgtgtggggcaaggtgaggtgccacccgtggtggcccgggcaggtgttcgacccggctgacgcgtcggagcaggcgctggaggagcggaggaagcacggcgccaccctcgtcgccttcttctgggacaagacgttcgcgtgggtcgacgcggatgagctcctcccgttccgcggtgacggcggcgacttcgcgctcctcgccggccagagcgcccacgccatgcccgcgctcaccgcctcggtggacgccgcgctgggcgaggtcgcgcgccgcgtggccgcggggctctcgtgctgctgctgctgcgacggcgccgccgtggccaagaagcaggtgatcgagaacgccggcatccgggagggagcgcacggcgcgacggtcgacgcggcgttcacgcgtggcgcgctccgcggcgaggccttcgtcgggtacgtctccgcgctggcggtggcgccgctcgccggagccgacaggctcgacctcgccatcgccacggcgcagctgaaggcgttcgaccggtggaggggcgccgccgcgaggagcctcccggagtacacgtgtcaccacggcatcgaggcgaacgccatggcgccacgccgcaagagaggaagagcaaccaagaacacgatcactggcaatgtggatgacgatgcatcggaactggagaatttcgagccaacgccacagccactgtcccatcagatgtccacaaagatcggcaagctcatgagccgcgccgcgcagcagatgtcgcggtcaccggcggtgatccaccgtgacaccaccaccaccaccaccaatggcgatgcgccgcctcctcctcctccggcgatttcactcacaatgggaaggtgcacaagaagtgcagatgagaagaagaagaacagtgacatcagagaagatccttttctggctggattggtgctgaatttcatctgcccaagtgctgttcttcctctaagtgaacttgtcaacatcttcagcaagtttgggccgatcatggaggccaagacagagaatgcatatgccatggtgatgttcaagaggcgtgcagatgctgaggctgcattctcaggcacaaccaagatcaacgctcttagctcttctctcatcagcttccggctcaactactcgatgtcggcttcgccgatcgattctccagagtgctcactgaacactgccatggatcgcctgctcttttgagctgttcagtttgatgaaacaacttactcaggtttgttctggtgatccctggcattgtagctctcaatatcatctgatccatgacagagttgcagcttgtttgttcttgttttgcttatcagtatcatgttcttgatgcaggtcatagtagatgaggagacagtgaacagattacaaacaagaaatgttattaggtgatactcagaatccataggaggaggcagtggattaagctatatcatttcagtaggctatgtgttgaactagtctctctagttgcatctttttggcagtcttgctcaacagttatttaaattataagtgatgcagatgagttaccagtggctgcaaaaacatcttggatggtcatgttctattatatatttatatctacattttggattactctctctgatatgtcaactggttgttggtactctattatctgcttgaaaaatgtgatgaggattttcattatatgtgacaacaatggattaagttttggaaattgtagcataattttctgagttactgagtgctattaattcttctgtttggttgtgatggatatgaacgtgccattttttttgacagtcatctgcagagtgttgctttgacttgtgttgcagatcagcagatgctaacaatggttgtaaaagcatctgaacctctgaattttgttctattttctgcttgaaaaatgggatggggattttgattatatgcaagatcactggattatatctggatttgtaacgcaagtttttcagtgactaatgctcctgggtcttgtgtttggctatgacagtcggatcatatatattcaatttggtatctgaaattaatatagcatagtgctcgtgcatgtttctgtcaatgttacaagtacagacataatagttcttcatgtgttcatagaaatgagttcccaacctacacgacagactggcgatttgtcaagaaattcatatttcaatccatcgtaaattacatcaacacagtcaatcactatcagtttcagagttaaaaaaatggtggatattcattatcaaagagcagcaatacagtccccagagattgggggtgtaaatacatatcatatagacatataaaatgaaagaatcgaagtagtctatatacataatctagcaggaggggagaaaattggtgttacatctcaagtaactatttccccaagtaaaaacatcgccagatcagataatctaagtcaaattagtgagtcagtgcaattccatcattgccatcagccgtgaatgaacatctatcatctgaagtattgtacatcgttctgctataagttgtaccttcagccttttatcatgataattggaaggagcctaaaccctccttgatagcatatttgagcttctgtctcataatctcctgcaatcagaaatgaaggcaattgagaaatcatttttagttttgcatcattcatgaactaggttgaaagtgcatgtttttatggtaccttagaggagtacggtggaagcttgaagaaatgccggcaagtattgacactcggtaattcgttgtctactttgccatcacattgctgttgagtacaattaataatactaagttaagtttctatcgaaatattaatcttgggacctaataggatagtctcttatgagttaaaaataaacgcaaacctttcgcactacggtgagcttaggatcgagcgaagctaggccaccaagtgggagctgaggagctccagtcgtaaaatgcaagaacgcccgctggtcctctcttccaaactcccgcaagatctccaggaactgaaaagaaaacgatttttccaattgacttcctcattacaagttaagatataaaatatgtgggaggcataggcttatatgttgtacttacactaattactgatgcactgttcgcatcatatccataatcaaaattgatgtgatcctcaagtttgttcgactgcaagtattgaaagttagaaactctaacaagaaactctcttgcagaaatgaatgtataaaataaaaggaattgtaaaggatgcatacagcccaagaatcttgttcgccacatagtatacgctccatctcatcctcactgaacaaccgaagagtcttaagagcaaaaacctgcaggatgctgaaataaatcaggagtgatttttttggctttatttggaaaaaaataaagacattagatctactgaatattttcctcacaaaccttgttaattccagccttgaaagcttctatttgattggatatcccacttttcaaggttgcatcaacaattgaagacacatactcctccaaattgtcaagtgtcaccatcttctctgaacctccagggacaagttcatattccggatttccaggaagggtaaagtcaagacataaatcctccaatcgcacgtttttataggacaaatcagctgctggattggatgccctttcctccaggaacttcttccttttaacaagtgcttgaaactccataacagtcttgcccaacttgggatcaaatgatggaatgtcataaatatcaaggtcctaaaagcaaaaacaggcatgatcagagaaaaggtgacatgaatgatcaaagaagagggaagagattgacattggacgattgctgaaaagttacctgctcaagcatgatcttgtaaaatgctttcgagagaggaatatccagaacccttccatccaaaactgctcttgctacaagatgcccaagaagcttgaatttttgtaccacattggacaaactgatcccttgagatgaagtgtttgctgaggaccatggctgtggaaagagaccaaaaggggcatggacaaaaccagcttcgcattcttggctggtgtcgtctcctctccacattccaagacccactctctgtagttcatgactaactgtggtatagaattcgaaggttgggcctcgaccggtcccaacctctccatcaaattccacctcaatgaatttggtgtctgatccatgtttgttcaacatcgatgaagcatcttcaaggattttgctccgtgttacgctgtacttcttagtttctgttgaactgctagcctcatctgtcatgaatgagtgatgtgccgtcaggcagaaatacttccatcgagcttcgaatgacaacaagaacgggcaagtttcaaccaaatagatacaccacgagggtatcaagccatccccaaacaagctatcttgcatttgctgctctaacttatttgtcagtagactgctcacgaactgatcccgtggaattggacaaattgccaccttaaggtcatcaaactcttggaggcagccttcagcaaatttgcataacttatcatccattgatagatgatatgaaaaacggttgagcccttcgaggactttcagcatgaacaggaagttatatgatggatcagattcatccagatcaccaggaagcttgccagtgagtatggtggagaaaaaggggtccttaagcaatgacatttcaagtttttcatgcacacggcacaactgaatattgtaggaactatgggaagatattttcttgcttttggttcttcttctgtatactatcttgtgttctttatcccaaaaagatgggtcaatctggagatcggtttctccttcatgcattgagcggaggattgactcaaaaagtggtgtagatgactggagttgtgttcctttgtaagagaatttcaatcttgagaacttgtgcccgtcacctggggaatcaacattcgttagtttgtttctcttaaaatcatgatatcataattgaccaagtaaacaacattgcagtttgtaacatcatgtaaagaagtacactagatcctagaggtaagcggcataggagaaaggtttaataccatttctgagcccaacagattttctgctcccatttgcttcttgagtgttttcctgaatcatagaaataacacgttataaataaaactgaatttacacttgatggttcatgatatgtgtgaatacaaaagtgaaaacatgcagtaaacgtttgagaaaatatgaacaagccggtgtaatgtgtaataccttgtatgaagtttcattgccagttcttttacagatctcaggcaacaggacctcttcaatggattcaggtgtcgaagaaagatcaacagggagaactccaccataatcctccaactcctcctccctggctgatctcgaaaattttatatatagtgacattggttcctcagttcctgaatccctcagaggaatcatggtgctctcacgtgtgcactgttcatcagccaggattacagggaaactgtcataccacacatgcaacgcatctatcagtttctccaccaaaatctcaagtggcttcaccgagctttcattgtccacgctgagagccaagtgcgtgaacttctgcagccggattttcacctccttaagctcccctatcaagtcctggcaattcctgagatttgaattaaagtatgtcccattggaaagataacctgccaaatgtttgatagatccactctgcacaaactcaaaagtagaagtacttggcagttcatccgataataattgccttgaaaaatcagacaactgcttgcagagatcctgatctttagctgggggtgccgtggcatgacaattcaaacgagaaaaaaattcctttatgcttttaaaagcacacccaaacttgtgaggagacttggcaacctttaccaagaagtttttctttatctcctccgctagtttcaggatagcaccattattaatcctgcatgcatcatctgtcgaggtctccaagtctaaatcaaaacaaaggcaactttctggcaagcggctctttcctttttcctgtgttagtattgcatcaattgcatgctttagaccctccctgatgaaggtctcaaagaagaatttctggtcttttctcagaagggtcttcgaaacgttgagcgtttggaatatgatatggcggttcttccgggccaaccagccagcaagtaagctgatacaagggcaagatatcagtaccatcattcaagttggttagttaaataaaggaagcgtgtttcaaggcccctcaaaatatttttgggagaaaattcaactgtgtgaaaagttcaccttgacaggtttactgtcttctgtacctccaccaaggaagaaggtgtgcttaattcaacaatgtttctgatgacaacaacacaactgtagcaaattgatgatagtgcagcagatttcgcaacctacgttacaagaagaaatatgttatatcaagggatagttgcagaactatcttcctgtgttacaaggagactggagagaattttcttacctgtattataaaagtaaggatgctagcaagctgttggatgtatccactttgttctgtgatgacattcttctttgcaatgattagttcggtacgatggtcacacatttcaagaggtggcataagataataaatgagctctacaagcgtctgcacctgcagttttgaattgaattgaattgtgtaaatagatattacgaaaaactactgtacaatggaatacttgtacagttcattcacatatctactctactctgataaacacacattcattgtaattgtataaaaaaaacaaatgagaagtactaccaatttttctaactcttgaaaatatacattaaggtataaacatgtgacgccactttaacaatttacactaaaatttttaatctgcttttgtgtcaagtattaggtcatcataggaaaacatggcaacaaaatttctgatgctaagacacacagggaaaaatgtaccttattgtgatcactgtgcgacgaggtgtagtatgttatcatctgcttgagcaaatcacaaatgtttaactcaaaaagagactttacagcccttgctgagagagaagctaggtctttgagaagaccaaggatgccctgtcacacatgtcaattcagtcatgaatgatcaattgctaaaactaagataggaatgaattaacagctaacataccacatgtgctttgctgcggattactaaatagtgtgcctgtgttgtcgatacttcttacactatttagattttctaaagggagccataaacatctaagatagtttgccgtaaaaatgacttctaaataaaaaggacgccttttcatgaaacatgaaaaaacacatgcgaattataaaggtggtaatcaaagagtctcctgatttcgaatacttaaagagttgataattagttacatctttaaggctacaggtttataaggtaatgtggaataacaagaatatttcattttgagtcaattttagagtaagaaaaacgatggctgaggaagcagtatcatgcaacatacagataaagtctcatcgctgaggctcttccacccgtcgttctccatcaacctcatcgtcgcttggactgcattaagctcgtaaagcttttccatgtgttgggcactgtcgcaagcaccatcagagaccaaaaccaagcaagaaacggcggagtcgagtatctaaacatccagaacggtcaacaaacccatcagtcagaaacagtagctctccaagaaagagaagaagaagacaaactcataatataaccatcataaaattaaacacgcgtaccgtcttgtcagtggattgcaggaggttgcacagaacgggcgcggcctccatggccttggccgcatccttcgcgctgaagtcgcccaagacgttggcgacgatcttgagcaccagcttctgcgaggcatttccacaaacaggtggtgagcgtgggcgcaagcatgtcaagcacggaggcggcagagcagcgcaaagaaggattaaaccacaagagatgagagatagtctgatcaggatgaggaggcttcacctgcttgtgcatcgagaagaagtcgaagaactgcagcacggcggctggcacgccgtggctgaggcactccttggggcactccatggatatgacgcccagagcgcgaaggcactgtataaacacacaaaacgaagcaaccgtctcctttagcaccacatccacaccaaccaaccataaaagagaaggatatacccttacaattgtactcaatttaatcttactattgatggaacaacaataggagatttagatttaaaaaatgtatgtcgttgtaaaaaaaaaagaatgcagtcttgatgaaaccacgtgttatgttacacaatacacgaacgaacgtataattaacttaatcgtgcacgtaaaacctatgttaccgacaaaaatatggataaattatagtgtaaaatctatatcattggtatataaatataaatataaggacagtaagtattagtgggtgtcgtaattttttattaaaaaagattgtctcgtacacctgaaatacatttaatttttttaaaaggtagaaaaaaaatcacatattaacggttgtattatcaagtttaacctaatatagctagggttttaggccggctttcaggttttaaggaggggttttaggtttacaattaaggtggtccgaaaagatgaatacaattactactagtacgtacaaattttacctcttcgacaagctggatgtagtccttataggcatattaaccataatattgtcagtttaacctaacatagctagggttttaatgcatataaatggtttaaattttatttaaacagacacatattaaccatagtattattatcagtactttaacctaataaaactagggtttatataagagggttttataagtatagctatataattaattcagaaagatgaatataactattactactaccgattaattacctcttcggcgagctcgatgcagtcgatggcgaggagcttgtcacggagcgcctcgatggcgccgtacctggcgaagctggtcgcccagggccggacgccctcgcatacctcggcgatggcacgcgcggcgaagagcggcacgtctccctcgccggaggcgaggaggcgcgggaggcgggcgacgaactcggcgatggggagggcgtcgaagaggtggtcggcggcgaccgccagcacgtcgcagagcgccgccagcgccgccacgtgcgccccggcccccgccgcctcgtccctcagctccgccaccacgtactcgatcaccgccatctccgacgactccatcggaattaattaatctgtgattggcggcggcggtggtggtggtgtcggcgactcgctcgccggagcgcgcgcgcggccgcggcgcacggtggtggtggttgtggtggtgtggcggcgtggggttttgggtggtggttgggttgggtttgggttgggccggagggttttatggcggcggcggcgcgagagacgcagatggagtcgggcacggcgagcgatggaagagaccgtgtgggtctctctgttgcggcgggatccgacgtggcacatgcatgcgtgagtctctgtgtgtgcctacgtgtccatgcaggagcaggcggatacgattgatatctggttttctcttggtcaggtcagatttttttttcttttttttacttaccaccacgtttgaggacttaccaccattgtcttctttgcatgtctatgggccatcacaccggctgtagtttcaacatattaaaaagggagtgtctacagatcatgcgacagattttgatgtttcccatctgtcgaatattttgaccatttgatccagatccaacgaacaacgttttttgatcaaaatagaaggaaaaaaaataaaaaaaaacacagatcgggccagatattggcccagctgactcgatccaaattaaatggaggcccaaacaaaaaaagtctaaaattcaagcccaatgtaataaatcaacaaaaaaagcccaaatagatgagcacaatacacgtgacacatgccaggttacttaattagaaaacttggcacccaagaagaaagtgtcacgtgatctggatataaaaagcaaaaagcaaattcaacatagggggaatcaaacagagacagatctgaagtcagaagaaaaaaagatggagattaacgagaaaattgacgatagagaagcaaatttacagtacacacagaaaggaatcacaagtttgagcgatttggagaaggaaaaaggtgaagagcaggaaaaatcaacaggtaagtgcaccttttgattcctcctttgaaatatcttgttgttttgaatctggatctgaatcttgatcttgaattttgttcttctgaccattctagataaactttaactctgatcttttgaagaatatgaaattttggagagttttccttgagacattcaaatattcacatatattgacttctgaatatacacatgttcacacattgtagacagtgcctctctcgaaacttctaaattcctgttaaatgaacatcacagtattagaacagaagagaaaattttaggaggataaacagaatcattacaattttaggaggataaacagaatctcttgggtagaacatcagcaaattcatgcaactcataaacacatctcattcaaaaattttacatgaataaggaaactcaaatcactgtcacaagtaattctctccactgtcacgaaagcaagtcatctcaaactttcagaaaattaaaattcaccagcaataaacatgattgtaaaaaattcagtgtgaactattcagtttgtaattaaaactagtttattctaatgcagttcatgtcattcaaacagaagaagatttgctctgaaacagaaaacatgccacctttgaaaaaatctgaatgaacaaaacactaaagcatgtcatgtcaaaatttcattacagaacactaaagcatttcatgtcaaactttcattgcttaaaatattcattgcctactatttcattctgaaattaaaactagtgaaatttaatgtagttcatgttcttttgtactaagaaacagaacaagcaaatacttgttccttctgaaaatttctatattaacagcagagacttgtacattctgaaaattctgaataaacagtacactaaaaataggaactaaaattctgaatgatgtaggaaattcagattttatactacaatgcaaataaaacagaatcagaaatcatgtttgaacaaaaaagattctctggatgaacaagaataaaaacaggatctgctgaaaatctagaaatcagattgtctaattgaacaagatcacactttatatgcctttttgtaaaaaatttgaaaaacataaacactttcaaatcatcaaacaagatacatgacataactacaccttataaagcactccatttcataacatagtttagacttaactaaaactatgaaatataaaaattacaatgaatttgaaccataattacatggaaaaaactgtaatttcaatattgaaatcatgtaaaaaacattttacaaccagaaattgttgtcaatctagcaaacatttttgtattcatgtttataatgagatgatgtactccaatgttcaaaatcatttcagattcaaagaatctatttcataacatagcttagacataaattcaaaaaaagtaaaaattcactttgtaattaaaactagtttattctaatgcagctcatgtcattcaaatagaagaagatttgctctgaaaaaatctgaatagcagacacttgtcacctctgaaaaaatctgaatgaacagaacactaaagcatgtcatgtcaaaatttcattatagaacactaaagcatttcatgtcaaactttcattgtttaaaaaattcattgcccactatttcattctgaaattaaaacaagtgaaattcaatgtagttcatgtccttttgtactaagaaacagaacaagtaaatacatcaaaaaattcagtccaccagaaattgttgtcaatctggcaacattttgtattcatgttgttaatgagcttatgtacttcaatgttcaaaaacatatcaatccagattcaaacaattccattacaaaccaaagcttagacaaacaaaaactttgaaatataaaaattacagtgaatttgtaccataattacatagaaaaaaactgtattttcaatattgaaatcatgtaactgacattgtagatcatatagatcaggagaatcaaaatcattacaaaaaaaagacataaatacaaaagtggccaccagataagtaaaaaaacaccccaattctctgcacatcatctggacaagaattttaatcattattttaacttagcatgattaattttcttgcctgatgatgtgcagaaaattgatttgcttaatcaaaaaaatatttatcatcatctggccaaaaaaaaattcattaagggtaatgcttctcaaaagagaagaaattgaaaatatcaaatgtcctaaagacggcggatgaaaagcaattcgaagcagggaaaacatcaagtggtaaatgcattactctgtattattcatgtttagttctgttttttttgcactaatcttctataaaattactttttttgtattgaaacagattcaggcaaaaaatcacagggtctgaagataatgaagcaattagcaggtatattatgctaaattttataatattatctatttatcaaattaaacaataggacgagagaaaaattatgtatctgatcttaattataaacttttgcaggaaaaattgaagctggaactagtactgattctgttaattcaaaatcaggtttgcaaaagaagtccaaaacttcatactaatattacttgaaccacaaaagattcatttagaaaaatgaaaaaaaagacataaaaccaaatgtggccatcagataagtaaaaaaacacctcaattctctgcacatcatcaggacaagaattttaatcattcttttaacttagcatgattaattttcttgcctgatgacgtacagaaaattgatttgcttaatcaaaaaaaatatttatcatcatctggccaaaaaaaaaaattcatgaagaggaatgcttctatcttcaggaacagaagagaagattttgaaaatatcaaatgatctaaagaaggctgatgaaaagcaattacaagaagtaaagacatcgagaggtaagtgtattgctatgtaaatttcatattaagtacttttttttcactaatcttgatcaaaaaataaaaaattttggtttcgaaaggttttgaaacagataccgacaaaaaagcacagagatttaagacaatgaagcaattaccaggtaattataagaataattagaagaataattaaaagtaaaaaattatgcttgtaatttgttttataatcttttgcaggaattttcgaagatggaacttgtactgctttggttcagtcaaattcaggtatacaaaaagaagtccattaaattcaaattatttttttagaaaaaaaattcatagaaagagtttaactggattctaacaaatgtgagtctttcattttaaacaggtctagcattcctagagaagaattacaacacaactcaatcatataaaatgcaagaaaacagagacaacataaaatcaggtaattaatgaatatgttacaagcactcaatcatattttcatcaaaattgtaaatgttatacaactatggattgacaacaattttttttaaaaaaacagggaacaaggggcacttgtcagatataggaagaagattgagaagaagaacacaacaaatcagacatgtaaatataaataaatgtataaaattgtttgacaactttcatactgcattaattattttgtgaaacaaatttaatagtttatatgattgaaaacaggtttagcattgcttgaggagaattacaatacaacactatcttatagagtgcaagaaaacatggacattacaaaaacaggtaagggaaaaattatgaagcaaattgcaggtatgagtaatagtaaaacaaaaaaaaatagatattttcctcatatttattttcaggtaacagtaaagacttctcagaaacagaagctaaacttgacaagaccaaaaattcagaagcagacattggatgtagtgctttgaatgaatcagagaaaagtaaaaaatttgcagtaatatttatattatttttaagagaatttttttgattaattaaaagttacactaacctataatactggtatcaaatattgcaggtattatagaaaacaatgacaaaggaactataagttgtatgaatatgcaagaaattaattcaggtaacaagttgaaaaaattcaatcatatttctttcatattcaatcatatttgtatgaatatgcaagaaattaattcaggtaacaagaattgtagaatagcacatttctttcatataatttcttttatgattagaattttcaaaatttctgcagaaaatggagctaacaatgcaaaggttgattatgaaaacaatgttctatctctgttggaccaagactacattgcagtaagtatttttactttgacaaccttaagtttgatataatttcttttattttctttgacaatcaagactacattgattttttgttttttttatcaaataggattcatttatatcatacactagtctaatggaacatattatttcatcacaaccaaaacgttgcaatgaattgaaggtaaatttttttttgaaaacaaaagtactgatttgttgttcatttatgtatttatgtgttcaattaagtatattttttgaaaatctttcaaaaactgtttaattaaggttgaaggaacaaaaaaatgatacaatagagactggaattggacaagattatcaaaaggttgacgaaagtttgaattcacacgttgaatatcaatcagaacaaagatgcttgatggatattttaaatttgcaagaatctgtgcaggtatgtaattgttgtataatatttttaaaaaaaatactaaaacttttgtctattaaatttaaaaaatgagaaaccttttatttatttatttttttgcattttgttttttcacaggataaaagtttagagcaaacaagtgaaattggttacagcaatgttgacaatcagtcacaacatgcatggtcactagatattttcaatttgcaagaatcagttcaggtatgaacttcttacaaatataagtttttctataaaatgaaaagtaaaacattattctaaataaatgtgaaaaaagttttatattttgtttaaatcttgtgataggaaccaattttagaacaatcaagtgatattggtaacatcagtggtaatggtgttgatgatgatgttatgaatgatgaattgctaactgaggaagacattgaacaatttttagaagaagaacaacaagaagcattgaaagggaataacgcaatcatagatagaaagtacatacctgaattagatcagaagttcaaatcaattattgaggcacataactatttcaacttctatgcatacatggctggattttcaattgtcaatgttcatagtgctagaactacaagtaagaaaagaaatagagaagttattagagtaacattcaagtgctacaaatatgtcaaagcagattgcaatacaaagccagaaacagtagatgagactgctactggagagagaaaaacaaatgaagttattggaacagagtgcaaatgtgttatggtaatctcagaaagaaatttggaatggattataacaaggttagatttggatcataatcatgagctgagccctccaaacaaagtcagatttctaaggtcacacaagtatttatcaacagaagagcgggtgcttattcgaactttgaaagaatgtcacattcccacaaggaacatgatagttattctgtcagttcttagaggtggtttaacttcattaccttacactaagaaggatatcagcaatgtcagaacagaaatcaacagagaaacaagcagcaatgatatgatgcagtgtttgacatatctgaagaaaaaacaagaaaaagatccaaatttcttttatgaatttgatttggatgaaaataggaaagtgagaaatttcttttggacagatggtagatccagagattggtatcacaaatttggtgattgtataagttttgacactacttttttgaccaacagatataacctaccatttgcaccttttgtgggagtttctggtcatggaaatacgatattgtttggttgtgcatttttacatgatgagacaacagagacttttgaatggttgttcacaacatttctgaaatgtatgaatgggaagcaaccaaagacaataattacagaccaagatggtgctatgagagcagctatcaaaaatattttcagagaagctaagcatcgaaattgttttttccatataatttcaaaagctttgaaaagatctagatccttattcaaaaagaatcaaggtctttatgcaatatacagtgatatcatacataactgtttgactgaagaggaatttgaggttctttggcaggatatgattcaagaattcaatctgcaagagataaattttctagcacacatgtggcatatcagaaaaaggtttattccagtatatttcaaaacagatttctgtcctttcattcaatcaacagcattaagtgaaggaactaactcgagattcaagaaaaatgttggcccccaatatagcatcagaagtttcttgacagaatatgaaagggttatggacactattcaaaatttagaatagcatgacgatcatgaatcaagaacaaaaaggccgactagtttttggtcaaactactccattgagtaccaagcagtgaaattatataacaacaaaatattcaaaagatttcaggctcagctcaggaagacattagaattacaagttgaagagattaaaaagttcaagtgttatgcagtgtttgaggcagaaaatgtgatcagcaagcaaatcagaaagagaaaataccttgtgatgatggacttggatacagaagaatacacatgtatttgtgcaatgttccagaaagatggcatactatgctctcatatattgaagattatgcttcaccttagcatcaaagaaataccggagaaatatatcatgcatagatggagaaagaatcataaatcaacagaaataattatagggaaggaaatcatacctgtttcagaatcatcagttctcagatttaatatcctgtcaaggaaatttgctgaaattgcatcaaaaggtgcgaaaacagttgaagcatacaaattcttgatggaagaatcagaaaagattgatgaaaagttgaatactatgttctctcatgaatttgaaggagcagataaacaacagggacatgaagagaacaatagttttagtccaacagcagaagtgaatgaaaaatcagaaaacacacacattcatggagatatcagaaatgaagaagattacattgaagatccagatatagcaaattcaaaagggaggcctaagcaaagatataaaacaattagagagcaaatagaggacaaagaaacaaatcactgcagtcactgcggtaggacagaacatacttttccaacatgtcccttcaagcatattgagtttgatttggcaaggaaaaggaaaagaaaaattccaagtaaaccacaaaaggtaatctgcaaaaacaaatgaattctgtttttcatattttaagatattatgagtgattaatttttggctcatttacagagtggagaagaagagaagaaggaagctacttcaaagaaaagaaaaccaaacaaaaaggagaatacagaaataagcaaaagtcatcaagacgaagtacaacagttgagcaaaagggtcaagaagaaatcagaaatcaacacaagcaagtgatgtgtgatgaaaagaaaagagtagaagatgaaaactagaacaaacagaatttatgtagtgctgacagcacaaatatcagaacttgtatatttcaccaccatgaatttgtgctgaaaattatatcatgtactgctatattctagttacagtactatatatcatataccgctatagtctagtatcagtactgagattacaaaaaaaaattgtctagacaaatatattctagttacagttttatgagaattgatatcctgcactgctatactctattgcttgcatgtaaagacaaatttgttgtcctgttgaatcagatcttcagcacacctacaaaaaaaaatctcaaatttaattaaattttaaaaagttatcaattttgaattagctatttgttcactgaaagttgttaccttcagaagtgatcatccagtagtttgtaaaggtctgaacaaagaattgaattgggggggtgaaaccaccttttggtggagtacctggctttctgatttaagaaatatctctttgcgaaaaagatatttggaaagcagcactctagggccccaaacctccgtgaacttgagagtaaaaatcccttagtcaaatctacaaaaaaaagaaaataaaatcttaaaacatttcaaatgatgtctgacatcaaaaattttacaattcataaaaatcatatcaatcaatggcagttgaaaaataccaaacaaaagatatctgaaaatttcagtacatattttttcttcaatgtcattgatttcataaaatgaaaatagacaactcataattcataatagtgcagtgacatattaaatttacaatgaattagaacaataattataaagaaaaacactgtaatatcaatagtaaaaatatgtaaatggcattcaagatggcataaatcagaagagtcataatcattatcaattaatctcagaaaataagcaatgaaagcccataaagcaagtatatgtaaactaacatgcaggtcagccatatgctgaaaggtcagtgaactaggaggtaaacaattccctatactaaacaacaatcattcaaactctgttaatgagccactagtattaaatttgttctacaaaataaatgaattttggtaagttgacacatcacaaaaacaaccaaattacatttttacccattgtattccgtattggagatcattgtagaacatgttagcatctaattgtaaggatatcagaacaattaaaaaaattacagtgagtttgaatcataaatatatagaaaaaaactgtaatatcaatacaaaaatcatgtaattgacattttagatgacataaatcagaagaatcaaaatccaatgaccagctgatacacattctattataaaaatgaatctagtctttacttgccaaatcttaatttgtgctaaacaacatgtgaagacatgtattttggacaaaattaaacttaaaatgaaattacagttattttgaattaaaattacatgaaaagaatactgtaatttcagtaatagaaatatgtaaatgagactttttaagatgagtttatacctgtttgtttgcttgggcactggaggataaatgactgtgtagttgttgaaatctattggatgatctttgacataaaggttccaggcaagactaaagtttgatatctacgaacaatcaatttcaagtaataattacaaatttgtatgtaaataaaacatatgagaatggaaaaaattcaaaaaaaaagataagcaaaatcataagaacttaaataactataacttatcataccagttttggcctaatctgttgatgatatatactgtcctcatcatacattgaatccaaaaaaacaaacctctgagctttcagatcaattgcaaacacaaaccagtgccgattcttgacaattggaaaaaaaagctgaaaaagaaaaaaataatgacaagattgaatattataaaaaatttaatttagattaaaaaatactaaccaagtcacagctgtgaacaggtcttgcaagggatgctccatcaaaacactttttaacaacagagaagttagttgcagagcgttccttaagaagatcatcctaacattagaaaaacagaaaaactgtgaacctatgaaacaacagctatggctatgaacttaatatttcaaaaactaacagaatatcaagttacaaaaaagatattggcatatgttaaaatttattgagaaatctttaacttacgccaattgatgagaagaagtaatttttttggattttgagggatgggatagtcgaaacatgtacgacagaaaactgacgttacaaaatttgagagttcaccaccaggcttgaaagaatcaccaaaagtaaaaaatttgcagtgcacaccgtcaatgtcaacaacaaccttactgcattgtcaaaaagaaaaaaatcgttaaacattgtacgatcaattttaaataatctattacatattattaatttataagatgaaatacttactcttgaaatgaacttttgcttatcttgcaaacagcattatatagttgtctatcataagctgtgacacaaaaagattgcttctcaggactatatggatcagtagaatatcttgctggttgtagaattctcctgagatcatgctgaggtttttgactggaactacactgtccaacatttctgtcaacattgcataaaagaaccctttctggactggcagtgcacatcttcaatttcttatctggattgactatgaaagtgttgattttgttgtacaatacattagtctttgatgtgatatcaagacaattttctgtcgattgcctttccccaagaaaaactacttcaggtgaatcctaaaagaaaaaaataattgagaaaacagatattaaatattaataaatttagatttataaattaaacaaacaaaaattgcatatcataaacatataataaatttttttaaccatgacatgcatacctttttgttttctgttgtcttagtgtactgttgttgaacaggcaaattttccttttcattgtgttgagattgtgtttctgaatcttccaaagttaccattatcaactggtcctgtgaagttaaaaagcaaaaataaaaattttaaaaaggaatgaaaaattatttgagtacaattttaaaatttacctcgttttctgaattgttttcttggttttgagataaatcatataaattttgtgacaggtccaatggaataatctgtaatagtacaacaagatgattaaatagatttgcactatatggcaaattgtaaagacaaaaaaagatcagaataaattataccatgtgacatgtttgctatctgaatttgattataaagttcaatgaaaactgtgacatgtcaatacagttagtatcatagtaaaaacttataatagttatattttgttaatagaaagtgaaaatttcaaacaaagtgagttataatagaaatctcagtaacagggaatgtgaatataactcatgaggatgacaaaaaaatatataaataatcaaatatgaatttgttgtttactgcaaagtatttctagttaagacctcaagatcagaattgaattttggccaatcaattttagaacatatctaagaccacatatatcatataaacaaacaaagttttgatgtcagaccacaattcaaagaatgagagaactaaccttggttttgttcaattcagtagggcatgctggggagtaagaatcaggaacaattttgcttgatttgagtccatgtcttggtgttacttcagacctcaaattatcttcttgattaatgttatcatcatctgaatcccagatttgaaactgtggcttctcatgatcaaaatagatgggttttctttcattgaaaccaacaaatcttgctttagttatctttggaggactagaaatcattcctgcataaaaaattaaatcagtaatataaatttttttcttaagaaacagatatgaatcaaaaagcagaattactatcaaaaaaataacaaagaaataatcataattgaaaagggaaaagacataccaggcttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26327 - DNA, 455 bp, Oryza sativa
aaaaagcaaaagaattagactttttgatgagcttttagaaacaaatcaacagaaaaatcaatataatcaaatatttctttgtcttcagcgggtacatctagacccatcaaaatacgccattcaacatcccgaagaattccaaaatacatcgtggctgaaaattgtggcttttcgcaaaaaatttcacctgaatgatgagcttgttttagcgcaagtgatacactattttgaatgttcatcgcacatttattataaagatagtgggcaaggtcggtattgttctgtgattgctcaagaaacatacgcatgaatgcaatatttttaggctgtatgatgtgctgataaaatctttgcagcgtttgtacaaggtaatttcttaagtttgtaacattacaaatgtatggtaagcatatatctttgaagaagacttcgcggcggtaatcgcagatcgcagt

SEQ ID NO: 26328 - DNA, 55342 bp, Oryza sativa
  unsure (1)..(55342): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacgcagcaatgttcataaatttttgactgaacgtagtgatgcagaaggcaaatgttaagttcttatgcttctgaaagcgttctatcatccatgtgaatgttgcacgatatggtatatctagtctcaatccttttcgagtagtactctactatgtacttgcccataagaattatttccataacctcatgccgattttcttatcgtatatggagctttaccgtacatactggcatattctatattccacgactcgtacaccacccgtagtagaattttcagtatatgtcatcctattcgcagcactttcagctgttgccacttaattcgtaacaccttcagaacataccaccagagacgcgaattgttttattccgtgacactccgtccatccgatgccgcacccgtcaattggtccgtgcaagcgctgtcgttcgtccatcgggcggggagcagctcgctcgtcccatcggccgacgaggtcctcccagcgctccgccggccagcaaggacgtacacacgcgtatctggctgccgtcgagcgcagccggccgccgaggtcctccatgggtggccgccgtcggcgagctcctcctcgcgtaagccatcagcagtcgatgtcttgcccagcgtacgcatccggtcgccatcgagaaccgccagctaccgaggtactcccgatgggctcattgggatgttcggccgccatcgacgagttactcctcgcgcacggcattggccggcggggtcccctcacacgcagcgtgctggccgacgaggtccagtcgtccagccgcgtcggtcgcttctccaatgcatggcctcaacatcctggacattatcagcgagcatgcacacattacttcatagcgttcatggggtgttcttgcttgtgagcatgttgttcttgctcgtgaccatggtcagaggcgacgcgatatggggacgaggagggtgctagtgacacagggatggggccgttgggtgcgtgctgcgcggccggagcggcgagtgcgcgccggaggagatgaatgccctcgtcggcagcgcgggaaatccgactccttctttgtccacttcgacggcagccgacgccgcgtgcaggaaggaactcagcggctggcggcgcacgcggggaggaccgacaagctgctccccgcccgatggacgaacgatggcgcttgcatggaccgattgacggatgccacattggatggacggagtggtacggaatgaaacaatttgcatcctccatggtatattctgaaagtgtgacgaactgagtggcaaaatctgatagtgctgcgaattgagtggcatatagtgaaaattctcccctacaatggaaactattgtaaagtggttttttattttagctcctacagtcttacatgtcagcctctgctaatttttttattttcagataactaaaacttttatacttcacaccctataacaataaaaaaacacatataaaccctatactcctggtagttctactgtgagcctctcactttcattgtccttacccatccttgctcgctctcctcacggaatcccccactgttggtgctcttctccgcctctctccctcttcattttttccaccagtggtgccgcctctcccttcgctcttcccgcaaaacggaccactatcggtcgacaagctcataggccgagggtgacgagatcggagcggatcgaggctccttcccgaccatcacggcgggatccaggcggcgcaaattgaggcgactccatcgcctcctctccttcgtcgaccatcgcgtggcccagatcaaggtgactcccttcctagctgccatcgtattctctccttcttcggccaccgtagcagccctattgaggcggctccctacctggccgtcaccatcacgcgaatggaggatggctctctccctaaccgtcgttttctcctcttcttcttcggccgttgccgtcggcgcagatctaggcagctcccaccccatctgccgcccctgttgttcgcagcgttttccgacggtgacctccagattcctctttttttctctggtctaagtctctaacaggattaccaagatgtcagggttatggataccatatacctaatagtagttgactaaatctcggcaggacccaccacacaccatgtcttatacggaaactgacttcagatatggaggcagttttggataaggaaagacaaccagagttctacatggaaacgacaaggactactcggattgtatccattttggtttccctagttctacttggaaatgggacacctatgggtataaatacaaggccctctaggagaagaggggacacgaccaccacaatcaacatacacggaacaatagatcaaaccacaagatcaatatacaagtcaacatacgccaagacaagatgccagatatcgacttcagggataagcacagctagtctcctacggtgtctccggatactgtcaggagagatgaaagcgctatctctgatcttgccgggcacggattcgaggaggaagactactctgttgtcgacttcgagtcagagcttcagaccgccatgtcgacaacagttagataggctaccccaaatattgtactggtatgattatggtgaataaagagcaacgaccggctccggccaacaggatgtagggttattacctgacaattcaagggctcgaacctatataaaaatcctgtctccatctattttacctcagtctcgcatatatcctagtaccaacaatccccatactatgcaaataccggaatcgcgacatcaaacgtcgacagtggcgcgccaggtaggggggttttggtgcttcaggatttggacgagatgggttcaagagatggattctccgacaacatattactcgacgagatctccgaaccatcttctcgtcgactacaagggaaagtgctcctcgcgacgccctgactggtcggccctacgttggttttcgagagatgcagacatatacagcaggaggacggcgcgccagccacccgccatcttgcatgtagctgccagagatcaggaggacatcagcacgcggaagacagaagtcgacatcgatcgattatcatgcatatcactgtgcgtgtgcgtccagatcctgtccatgagtcaccgagtcggactggtagccaacagatgtctgtacacggcacttgttggtaaaaaccaggatatacactcgtatacgtgaccagggcacgtgaaggagttacatgcacgtggcttcttgtctacttgttgatcttgatgctcagactgtaaaaagaaaagggtaattagtggattagttttttgaattaatctactaatttcgtagatatctacacaggtacgcaatattttatatgcaatgtactgtacttatttttcagataatataatattgtcagatctataatttattatgtttacctagagcatgttttttatacaatctctgttatacgagcgtcttcaatattagaccaccgcggtctaatactgggggctcgctttattttcttctgtataaatcatgcttgttcacggtttatataatgcttgatatttaatctgctcgttatatcctgataatgctagaagatccatacagttattcgagtacatactcgatattctctgctatatgtcttgccttctagaaaatatttttcaggaacaattgagcacatgagtaggttgtcatcgagtacactccattatcgagaacattctcgacaaatgcggagttatcgcacccaacctgccaacgaagaccaacgacctatctcatagcaccggccatggctggaatagtcgagaaaaggttgttaacggataattcctcgcgaatgtcgtcggcttgattgcccgacatgattgcgaacagatatccggatatgctataagttgggtatgtgagtcatgctggccacatgagatgcacatgtaataaaccaactctagcgtctccattggtgttcgagagataattctactcgctcgctggttcttgaaccagtacgtaacaatctctcacaccgcaaacttccattggtgttcgagagataatcctactcgctcgcaggttctcgaaccagtacgtagcaatctctcgcaccgcaaacttccattggtgttcgagagataattctacttgctcgctggttctcgaaccagtacgtagcaatctctcgcaccgcaaacttccagtggtgttcgagagataattctactcgctcgctagttgtaacgccccgattttcgttcgggattaaaaatcgtttaataatgcattttctagaaattaaataaaagttaaaacaaattcatcaagtgaaataatgggaggattaaaattttcccttgaaaatcatcggccaggaatattttgtaatattctttgtgccctaaatattttctaaaaatttcccgagaattttcggagctcgagaaataattttaaaagtcacaaagttcatttaatcaattaaaataaatagaaaaaccaagttaaatctcccctccttcactttgggccacttccggcccaaagccctccttccctccccacgacccgttccctcccctcttccttccttcctccttgggccatcgacccatcttccttcccctcgcgcaaagtctaaataaccccctgggttctcctccctttctccgttcccgacaggtgggcccggcaaccccacctgtcaggcccttcctctacctgcagtctctagagcagaagctgccatggacggccgttgccgcccacgtcgccgccgattccgggttctcccgcccgcgccctcgcacccaaaccacatgaaatcggctccccaccatctcctacacattttcccccacttttccccaatttttggcgccaatttgagctccacttcacccacgatgtcgcccacgtcgccggtcggttgccgcctgattccacccctctcagccatgatctccctcccccgcgcccataaaaaagatccccgggctcccctcctccgtttccccctctctcccaagctcccccatgcccggaaccccctcctccccttgaggccgtgcgccgccgctcgcgggagctcttcggtcggccgctgctgccgctcctgacgtccccgcgccacgccgcttgcgctaccgcgttcgccgctctctgccgcaaccctgcagccgctccattttccccaatagccaccggaaagccgccccaccgcgccaccaacctccgctgctcgtcggcgtcgttcagccacctaccgccgccactctagctgcgcccgtgctgtgccactaccactatcggcatcgccgtaccgagctccaccccggcatccactcctccgcccccaaaccccaccgcaaccacctttccacctcacatcccgagctccaccaccgcctgtcgcctccagccgcgcacctccatcgcctcagccgtcgccgcaccgcgccgcctgcgccactcgcttcgcaacgccgaggagcacctcggttgctttttttcatcgccggaaccccaccaaaacatgttttccgtcgccggtgagtcccttctttctttttcctcttcggccggccatgctcacgccttctcccttttccctaatccctccaatagcttccccaggtgtagccgcccctcggcctcccctcctccttcgtcggaagccaccgaatcgtcgccgtcatcgtcttcctccgtgccggctgctgcttccggtgaggatccctcctcccccgtcccccttcctttcctgtcccccttcccgccgcctctcggccgcttgccaccattccacaccgccagtggccgcgcgctgcccatcgccgtcgttcggctggccggctttgagccgtgccgtgccctagccatgctgcctaggccgtcggtcccgtggaccactcccgtggtccgggtccacggtgctgccccggccgcggtggaccgagtcaaccatgcacccgtccccattgcccgctgacgtgcggggtccacgtgtcggcgccggccgctcctttctgacgttagcgatggtcttttcctttgagaaaatatttaataattgcacgataaataattaataattccagaaatccattaaaatggctcaaaacttctaaaattcatatctaattcattcgaactccaaattaggccattcaacttgcaaaattcatctaaaattgagatctacatgtttgtttactttttatgtactgtttccttgttgtttatgagagcttttcctcattttacgtgccagcgtgtagaattcgctgtttcggaagttcgcggtcgcgaggataagagttcggaagattgcttgaagaagcaaggcaagtcatacattccccttgagcattttgatcctactttacaaatgttttaccgtttgcaaataaatatgaattgttttgcttattacatgggatctgggtattacctatctgctcgcttgtgccatgtttacttgatatatatcctttgtcaaccgtgggtaatagatcgactagctcatgttacttatgtgacatagctagaactatatgcttagtcatgcttaattaccactagctcagttgatgggataattgcagtattagacctttttagtatcagaacgagctgtgtgctcgagacacctgaccatgttgcattggtcgtaattatccaactaaaatgcgactgaatggtgggctgtgggtgcatggttttgctggtcgcatccatggcaattaaggaccggttcacgggaaaccctggaagacttacagtgcttaacacaagcgggagcgggtaactgcttaatctgaagtatagctcgaccctttcctaggcaccggtggcaagggtgggcgtgatggagttgggtcggccggggagaccggttgtccagctgccggattcaccacggcgcacgaggggactgcccgctgccttgcgaggagtgggggtgaaaccttagcgtggtgtggatggttaggggagggttatatgaagggtcttgtcacaatcactcgacgtggtgacatgttcatcatgggcacatgatgacatggtgacatgccggtggattgtgtcttgtgggtacagttgtgcacctctagccagagtaaaactattcgaatagccgtgcctgcggttatgggcgatcgaccagattcaccgtgattagtctcacacttaataaatcgacccaatgcactgtagttcaagtgggttggttgggcctgttcaacgtggtgtagcgttgatatgtggagatttaatattaccttaattactcaactgttttactattttgctcaatgaaatgttttacaactgcctttacgcaaatagccacaagccattcttgtatccccttgcacgtttgcatcattggtgtggcttgctgagtacggtggttgtagtcagccttgctattattcccccttttcagaagtgtagtacttctgagctgaagacaaagttagaagaccaaggcttagaacccagttgagttttgcctatggagtggagctgaagccccgctaggatcgcctttttccgctgctgctgttttcttttggtgtgaggactaagtgcctcttctataagtattttacgctttatttatgtttggaactgtttattatttgtcgttttgtgtaccctggctggtcctggatagggatttaatacacaaaatagtctggaaatttgggttaaatttctgggcgagacactggttcccgaaccagtacgtagtaatctctcgcaccgcaacttccattggtgttcgagagataattctactcgctcgctggttctcgaactagtacgtagcaatctctctcaccgcaaacttccattggtgtacgagagataattctaatcgctcactggttctcgaaccagtacgtagcaatctctcgcaccgcaaacttccattggtgttcgaaagataattctactcgctcgctggttctcgaaccagtacgtagcaatctctcgcaccgcaaacttccattggtgttcgagagataattctactcgttcgctggttctcgaaccagtcgtagcaatccctcccaccgtaacttccattggtattcgagagataattctactcgctcgctggttctcgaaccagtatgtagcaatctctcgcaccacaaacttccattggtgttcgagagataattctactcgcttgctggttctcgaactagtacgtagcaatctctcgcaccacaaacttctattggtgttcgagagataattctactcgctcgctggttctcgaactagtaaaacgtagcaatctctcgcaccttaacttcagatggttgaggaacagctacgactgatcttcgaccgacagcatagtggtcctcgtaccacgagtcgaaatgatcgagagacacctattcactggttctcaaccaattaatcgtagcgatctctcgtacatctacatctaatggtcgagttacaactactacctggttctcgaccaacggtgtagcgattctcccactatttccactttaagtggtcaagttacgactactacctggtcctcgaccagaggtgtagcgattctcccactacctctactccaacaaaactgatatcaggtacataatatcgccaagtgttttacccagagatcccttaccacgacgacacctagcgttaaaacctatcctactgttcctttacgccgtcttgacaaggccttcgagtaacctaagggaacttcggctggggacgcccagagccgataaggccttgtcagagcctgtagagacaaaagaccatgtaagatctggtcgtgtaagagttctcgccgtgcgtattaaccaagccgtgtaatcggaaattgagttttccaacttcatggctgggggctaggatcagtgcttgttcaaccaaggcaggtcaagggtccaaaagccttctccttcgagaacgattctctgacgataaggctgggggctaggcagagtgtatgacttaacaaactgactgatcgaagtcggtaagagagaagacgctcacatacaaaacattggtctgtaaatttaattcattttcagttttccatacatattataacatgtcaccctttgagcattcgctcgggggctatttctatctaatattcttttctgagtattaatttcaggaaaattctattcgacattgttgaagtctccatgtctctatggttttataccaagatcgactaaggcgagtacgacaaatgttgacaaggctccatcgcagactctgcgccttctcgatcactcgagaacgattggtggatctcgacaaggaatacggaatgaagagagggtgtacccgccgagataaaatttcttgatttcaatccaaattctcgattacagcaagacaagagacttagtcgtatattctgtactttcttggttgacgttggagattgactcagacaaaccctttaggtgcccgcacgaggctgataaaggaagtctaacattatctctgaactcatcaagaacagtcacgtgagcacgacaacagttactctagggtctgcggttgagaatatgaatttgttcatttgcattgaagtcgggggctactgtcagggttatggataccacatacctaatagtagttgactaaatctcagcatgacccaccacataccatgtcttccgaactatccgagaattatccgatccgaaaagtatccgtatccgtttttgtccggagcggatggaaactatccgctccgttttcatccctagctgtatagtggtagcatgcttttatcctcttctttgttactataactactgtagctgatggatttttttttcacttgagggacatcctatcgtttgtccatgtagtataaaagtcatcacaaaatttttaaacgattgataaaatagattaatatgtaatatattattatacaaatatataagttttaagtacgacctatataattagagtttttttttaccgttcagcactgagagacgggaccaaatactgatcattgatcggaccaaatccaacggctgccagtgtacagtaccgcgaggtaccacttttgtcccttatctagtaccgtacggtgaagagaggtgaaaaggtaagatagtaatttcgcttagtagggatggatgaggctgaatggatgggtgaggggttgaggtgggccaaaaaaaaaaatcctagaataggattggatcgaactcgccgctgctatgtttatcctccaccgccgttcccctattcttcttttcttgctcgtcatctctctttccctcgctgccgcgccaccattttgcaccctgctgccgcggcgctacgaggggatggaaggggagaagcggcgcaaagggatgggtggcgtgcgctgggaatgcgaaaggggatggaaggggagaagggcgcacggggaatggaagcagagaagtgacggcggcgcgggttgggaagggcgaaagggcgaggcagcgcacgctaggaagggcaaaggcgtcgaggcaaccaccctaacttcgattcccatcatacccccaatgaattgaacagtcggatttgttttggcacctataggttgtaggtactagtactaggcggtactttttgctggataggaacaaaactagtataactaaaataataaaaaaatagatttgactccaaattacatgttatttttaaagttaaattttttttctacttgcatgagttgaatttgaatatgtatgttgtgtatttttgtggacatccctttcaagtaagagaaaattcccaacataccccttaaaagtttcacaatttcttctatacccctaaattttgtcccattcctacatgccattgagttttcattttgatctcctctatctctattccattagttgaccgtgagttgatcgttagattttttccaaaatgaccatatcgcccatttcccatacttacatgctatctatgtcagggttacgggtaaggtataccctttacccttcgatatacgtcacatatcgatatggtatacctgcgcgtatacagacgttctctgcatacattaaggaaattcatcatggagttcacagatggaaggagtcctactcggacaggactgggtcgtcactgtatcgtgcaaggtccgatgtctccgagttctacttggaaaccgcctgacctgcgatataaaagggaccccctgggaggacctaaggcatcgaatctcatagccaacacatccaccacagcctacgaagtcggaatctacaggagccaagtcgtcgggagatttagtcgaaccagctcgattacgatctcgccggtatcattgagttccattgttccctttgtaacctgtgatttccatcatataatcccatatcaactggattagggctattacgtatcaaggggcctgaaccagtataatctgtgctttttgtctgcttgatgtcgtattacgtagatcctcgtaccagcgtaccacagtacccactatatccggtatcccccatcgacagtggcgcgccatgtagggggccttggtgctcaaggttctactactatttcatctagcttcgtcgacaacagcgtcaacaccaacctcgaccaaggagttcctgcttcaacaatgctggtgtgtactcaagtcggcgaaatcgtcttcccgatttacaccacggtgccgatctcggctggtccatcagtgactggaagcgagaacacagtggctacaacccaggacgacttcatgtcgaaggatcctcccgccgaagcggagaacggaacgtcgacgacatccgagcccgagaaggatcctaatgcggccaaaccttgtctcttcaacaagaatcacgagccgacgaggataacttccgaggtgataaggtcctggtgccctatccacaaaaccagaaaacacaccttgcaagcctgctgggtttttctcaacgtacatgccgaaattcgtgcctgcaaagagcgtggaattcagcgtacttctccaacccgtgatatctattgtcctatccacaagacaaagaatcacgacctctcaagctgcaaggtctttctcagcgccatgaagacggcgcctcctaaggtccagcagtcatgtatctctcctagggatgcggacaaggaacaaggagcgacactgatctcggatcgattcgttggggtaatcgacatcgatcctcacaagccgtcagttctacacttgctcgaagactatggctcatcatcaacaagtacgccacgcgaggtattggctatcgacaggactagcacgtcagcgcgcgctaatgcggaagtagaaaatcaagtgactacactggcccagcatatcagggccatcaacgcaatactgagggaggccccctacgatcccgttctgaacgacgatctcgcacggtggacagaacggctacaggaatcagtaaccaacctcagtaacgcgtttgaagaggccgtcgctacagcgcacccggaacagccaccaactggtggtgctaatggcgaaaaccctgaacagcgggaatcgcctcatcgagccacccctccacctcgcggcaccggcgatctccgcgatcacctgaatggccgccgagaggcacgacgcacacgagacaacgggaaccgttcctgacatcgcgtctcttcacgacgtcacgataacgaagaacgaggaggccgctcaagtgaagaccgagaccgtgataaccgccacaactaccacgatcacgacgatcgcgaatggcgggtgccgggcgatacaggtcgaggacgccgccataatgacgacgacaatggagatcggcgctgggacaacaacgggaggcgacgacaggattctcgagaacccggccgacgcccttgtaatcgcacaccggagtagatgacaacgcgttttcgaattatttgccaactgcattgaaaggctctgcacgttcatggctgatgcatctcccgccctactcgatttcttcgtgggcagacctgtggcagcagttcgtcgtcaacttccaaggaacttacaagcgccacgctatcaaagacgacctacatgcgttgacacaaaacccaggtgaatccttgagagattatgttcagcgctttaatgagtgcagaaatacaatccccgaaatcaccgacgcttctgtaatccgcgctttcaagtccggtgccagagatcgctatactacccaggagttggcaacgaggcgcatcacaactacttggagattattcgagattgtcgatcgatgcgcccacgcagatgacgcactgagacgcaagaacgacaagccgaagaccgcaggagagaagaaaccagccaaggacgcacctgagtcaagcaaaaagaaaaatcacaagagtgggaaaaagaaagctcaagcggaagttctcgcagcagaatacgcggaccctcccaaacgcccagacctacaaggtagtgacgcgaaggaagcatggtgcgctatacacaagtcggacagacactctctggaagattgcctcgtcttcaaaaagtcgctcggaaagcacatggcatcggaaaaaagcaagcgagtacgtgtggtagagaaggacactgagacggctacttaggaatcggactcatcatacccagactccgatctccatgtctcgcacatctttggaggttccacggcatactcctcaaagcgagaatacaagaaagtgaaacgtgaagtctgttcgacgtggcagggggctacacccaagatgaagtggtctgaacagaagatagaattctcagaagaagaccaccccaagactgccgtcatcccatggcgatatccgatcgtggtcgaacctactattcggaatatcaaggtcgcacgagttctgatcgacggcggcagctcaatcaaccttctcttcgccagcacattggacgcgatggggatcccacgaagcgaattgacaccaaccgatcaacccttccatggaatcactccccagtcatcgtccgaaccattgggcaaaattacgttgcctgtgactttcggccaagcaagtaacttccgaacggagcagatcacctttcatgtcactgaattcgatacagcatacaatgccatcattgggagaactgcactcgcgaagtacatggccgcatctcactacgcgtatcaagtgctcaatatgccgggaccaaagggaacaatcactattcaagggaacgctaagctggcagtgcaatgcgacaagcggagcctcgacatggtcgagcacacgcccagcccacccgccacagctgagccactcaagaaagtgagcaaaacaaacaagacgccgaaaccagacggcgcaatcaggatcgttccactctccagtgctaaccccgacaggaccgtcaagatcggggcatcactaggcgagaaataggaactcgcgctcatcaccttcctccgcgacaatgctggcgttttcgcttggcagccgtccgacatgccgggggttcccagggaggtgattgagcacaaactcatggtgcgacccgacgccaagccagtaaaacaaaaactacggagatttgcaccagattaaaaacaagacatatgagaagagctcgacaaacttctcaaagctagtttcatcagagaggtactccatccagagtggctagccaatccagtcatggtgcggaaggccaacgggaaatggagaatgtgcgtcgatttcaccgacctcaacaaggcgtgtcccaaggatcacttccctctttctcgaatagaccaacgggtggactcaacagccggttgtgagttgttgagttttctcgacgcttactccggttaccaccaaatcagcatggcaaaagaggacgaggagaaaacaacattcatcacgccattcggggtattctactatgttaagatgccgttcagactgataaccgcaggaaatactttccagcgcacggtccagggcgcacttagcgaccaacttggaaacaatgtcgaggcctacgtcgatgacattgttgtcaagaccaagacaagcgactcattgattgacgatctgcgggaaacgttcgacaacctccgacgatatcgcctcatgctcaatccagagaagtgcacgttcggagtaccatcgggcaagctactcggttttctcatctctagcagaggaatagaagcaaatcccgagaagatcaaggcaatcgataatatgaagtcgcccacaagactcaaggaagtacagaagctatccggatgcatggcggcactaagtaggtttgtcgctaggatgggagagcgaggacaacctttcttcgctctactcaagaaacaaaacaaatttatatggacataggaagccgaagaggcattcattgcactcaagtgctaactatcaaatccccctatacttgttgctccccaacctaatgaagaattatttctctatattgtcgccacgccatattccgttagcactgtcattgtcgtcgagagagagaaggtacaacgaccaatctactacatcagcgaagctctccacgacgcaaagacaagatatccacagatccaaaaactgctctacgcggtaatcatgacatcaagaaagctacgccactacttccaaacccacaggggagcaggggcaggattcatcttgacatcaccttcaggagatcaattcaagcatgcaattcacctcaacttcaaagcgaccaataacacagccgagtacgaaggactactcgccgggataagagctgcagccacactcgtcgtgaaaggggattccgaactagtcgcgaaccaggtgcacaaagactataagtgctctagccccgagttatccaagtatctcgcagaagtcaggaagctggaaaaaaggttcgatgggatcgaggtccgacacgtataccgtgtcacgtcccaaaacgactctaaaatacatcctctaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggctggctcggcccatctccctccccctccctctcctctccccgcggcccatccggcctctccccgcgcgcgcgccactgacgggcgggcccgcccgccaccctcgctgatgggtggggcccacccgtcatccccttcctcccgccgcatccttgccgacctcgtccaccctccgtttcgctcgtcgaccgccggagcgccgccgtccccgtcgacccgagccgcgccgccgccttcctccgctccagccgccttttcgtcgtctccgtcgacctagggtgagccgtggaccgccgcctcgtttccccctttccctcccttctctcggccgccgctccgccgtgcctatggccgccgccggcgaccataggggcgcgggcgcgccgcctcccgccggccgtgccgccgtggccgccttcgggcgcatcgagcggctgccgcgtggggcccggctgtcagccgcccgcgccctcgggtgcggctgacgcgtggggcccacggcgccggccggtgtgagcccgggtgcacccagtccaccgtggaccgtgaggctgccgcgtgggccccactcccgtggacccggtccgcgcgccccctcccctcggctggcgcaataaacttttttttaaattaaaatttaaatgaagaaattcgcaaatattcacttaaagagcatataaacttcaaatagccataacatggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcggtttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgtttcgccgcttaattaggcagcattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgcaaggggctcagtcttgcctacctgtcccgggggttccggccgtaggtggggttgggtcggtactcttgtctatggctaggatgggttggaaactatgtcacgtcttccgtccgtataccgtggtggtatgcggcacgtggttacacatgaggaagatgtgtcttgtgggtaaagatgtacacctctgatcagagtataatctattcgaatagctgcgccctcggttatgggcaagccgagcaatgtacccaagttagtgttttaattcttaaaacctgcttaacaactaaaatgtggaatggttggcctgggttgacttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctggaagatgaaggcgttggtgtctagctcgtgcctgccgtcaagcgcctgtggtcgtcgccctagtcttccgttgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttggattaattccggtcatgacataccgcaaggacaacatcgagccggatgatctagcatggcgtgcatccagacgagagccactcgaacccggtactcttctggacgtcctgacaaagccatcagtgaaagaggcaagcgacgaagatagcccagtcgcccccgacatcagcttgggggctacagaggcagagcgcgccgttgccgatatcgagaccacagatgactggcgcaccccactgatgaaattcatatgcagcgaagagttgcccgaggacgacgaagaagccgacaaaataacctgtaaagcaaaaatctactgtatgatcggcaacgatctatacaagaaagcgccaaatggggtacttctcaaatgcgtctcgtccgacgacgatagacatctcctcctcgacatacatgaagggatctgcgggtcacacgcagccggtcgcacattggttggaaaagcttttcggcaagggtttttctggccaaccgccctcaaagacgcttgcgacatggttcagcggtgcgaagcctgtcaatttcacagtaaacacacaaagctaccagcgcaagcactccagactatccctcttacttggccgttctcgtcctgggggctcgacatactcggaccattcccacgaggatagggcggctacaggttcctattcgtggcgatcgacaaattcactaagtggatcgaagcgacacccacggggaaaatcaaggccgacgccatcaaattcatcaaagggatattttgcagatatggactgccgcaccacatcataaccgacaacggctcccagttcattagcgccgacttccaggattattgtatcgggctgggagtcaagatctgctttgcctcggtttctcaccctcagagcaacggataggtcgagagggcaaatggcatagtactagaaggaatgaagacccgcgtctatgacaggctcatgtcacaggacaagaagtgggtcgaagaactcccatcagtactatgggccgtgcgtaccacaccgacaacgtctaacaaggaaacacccttcttcctcgtgtacagctcagaggccatgctccccaccgagctacgacatcaaagtacacgagtacagaagtatttcgatgagaatcaggaggagcagtgaaacgacgatgtgaatctactcgaggaacatcgtgaacgagttgtcgtccgagaaaccagctaccaacaggcccttcgccgttaccacgagaagcgcatccgagcacgcacgcttttgatcggtgactacgtcctccgacgggttcaaagccaagcagggcgaaacaagctctcacccaaatgggaaggaccgtacacgatcacacatgtcttgcggccaggcgcattcaaaattgcagacggcgatggtcgtgagatggcaaatttctggaacattgatcaattacgtaaattctatgtataagtcaatagtatccatacttgtaagacatcttacagcttcaataaagcctattttcaggtacagattacaaccaaagtgttccttcccgatgatcccttacccagatgacacctagcgttgaaatctatcctcatgtccctttacgccgtcttgacaaggcctccgaggaacctaagagatctttggctggggacgcccaaagccgataaggccttgtcggatcctgtagagacgaaagaccatgtaagatctggtcgtgtaagagttctcgtcgtgcgtattaaccaagccatgtaatcgaaaatcaattttctaacttcacggctggggctaggatcagtgcttgttcaaccgaggtaggtcaaaggtccaagagccttatcttccgagaagaattctccgatgacaaggctggggctagggagagtgtatgactcaaatgactgatcgaagtcgctaagtaataagacactcttacacactacatccagagtaagagagcttagttaagatagatttcttttctatttcacaagtacttcttacaattccgtaaaaacccaaaactatattacacttttccctaagatatttgtcacagggtacagagactaccaggaaggccaatgccagtccatagactggaagtccttccctgccagcagcgccatcgacttcgccaggtgatctatctccaccggagttcaccgagaacgagaaaacccttcgtggaggaactcgaggtgcagttgcggacgatgatgtcgtatgcaagccaacacgtgccctccggcatatcggctcgatcgacggcactcctgcttcagggcttcgtcgatacgctttgaagcatctaggcccccgttgttaattttggtaattaatgacaagcgctaattgtggactaaccgttgctattgggataatattttaagttagatccacatcatgtgtgtgcatggatgactatcgatggattaaaatttgctagtttattttacaattgatcgaggtgtagggcgatcaaatttagaattgatcgaggtgtagggcgatcaaatttgctagtttattttctagtttcgccgtactattaagaggggtaatgacctagcaaagagatgattaaattgccacattaggtcattatgcatttagacgtgtgctcgcttttcatcacacacacacaatcacttgggatttcactgggctcggcctgaacaggggcggtcagaccggccacatagtggcggtctgaccggcgtaccttggccagtctgaacggccgcaagaaggcggtctgaccggcgcataaagccggtctgaccggcagtacatgcgcggtcagaccggcccactggaggccgggatggtgctgctccgggtggccgatacagagccgatggagccgtagtcggtcagaccgagccgatggcggtctgaccgagccgaggccggtctgaccgcccactcaacgccggtctgaccagccaggccgatggggccctctgatagcacttcaacggctagttttctagccgttgcacagtagcacggtctgaccggccacatacctccggtcagaccggcagagcacaaagttgggggatttcacccctaacggctagttttggtgggtgggagtataaatacttccccaccagcagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttagaggttgccgcctcctagacggcttgtggaggagttgcccggtgacctctccgagaagattgtggaggaggcccggcgtcggtttgtgagtggtttggagttcagcaccttcggagtgaaggaagaactaccctagtgatcgaggcttgggtagtcctctccatgggccgctcccgccttgcccaccccttgacgaaaggggcgtgcggtggtttcgtggttgagcggtggagttgggctcgcctcaacggggtgtaggaaacaggcgagtttccgaacctcggtgaaaaatctcttgtctacttgtctaatttgattgtcgcatttacatttgtgcaatttacatttctagagacatacttgagatcatatcaccctaggattgctaaacattgacataggagtgtgatttacttttcctagagatataattgagccactatcaccttaggtttgcaaaacataacttagttacttagttagagttgacccttaccaagcctagcaacttaggttagttttgattaggtgtcatttagttttaaatcgcctattcacccccctctagttgacctctcgatcctacaagtggtatcagggcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgtggatgtaggctttgctatcaacggcacacccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcatttcgtcaagatccaatatgagacattctccatgttgcctcatgagagtgtgaatgacatgtatgggaggctcaatgttattgtgaatgatctcaaggggcttggggcaaactacaccgatcttgaggttgcccaaaagatgcttagggctctaccagagaagtatgagacccttgtcaccatgctcatcaactccgacaagtcaaggatgacaccggcaagcctcttggggaagatcaacaccaatgacatgtacaagttgaagaagaaggagatggaggaagcctcaccttccaagaagtgcattgctctccaagctgaagttgaggacaagggcaagggcaaggtgaatgaagccaatgaggacttggaggaagagattgcccttcttgctagaaggttcaatgatctcttgggaaggagaaaggagagaggaaggggctcaaactcaaataggagaagaaatagaagacccaacaagactctctccaacttgaggtgctttgagtgtggtgagaagggacactttgcttccaagtgcccttccaaagatgatgatggagacaagtcatccaagaagaagagtggaggatacaagctcatgaagaagctcaagaaggaaggcaagaagattgaagccttcatcggggaatgggactcaaatgaggagagctccgcctcatccgggtccgaggaagaaggtggtgatgatgcaagctccaagaagaagaagatggccgttgttgccatcaaggaggctctatcactcttcgctccactttgtctcatggcaaagggttcctctaaggtaacatctcttagtgatagtgagagtaatgataattgtaatgatgtttcctatgatgagcttgtgagtatgtttgaggagctccatgcttatagtgagaaaaagattgtcaagttcatggccctaaagaaggatcatgcttctttggaggtcttgtatgaggagctaaagacttctcatgagagactcaccatgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaactagatcgtcagatctatatacacccggcggattcaaatccccaaacaggagtagggtattacctttcattgagagggcctgaacctgtctaaatcctttgtctccgcatccatccactttaggtctcgtacgctaccctcttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgatcacttcttcaagctcctcttctctgacttgatccaaatcagtcagggggaaactcaatctgatttttatcattatttatcatattgatttttaatctcagattaatctcttgctattttttgttgttgttcacatataattacgcggcactattgaggcgattgatgctggtcatggactcgaagcgtctcagctttccggtcgatcggccgcgagtccactctgccggcttgtcttcgccaccgccattgctgataacaacaacgacttcaccgaccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttaccgctgagtggtgcctccgcctacacggctggcctattatgccgccgctgttgggcatctacgacttcaccgccggcctgcctccgtcgccgccgattggtgcctccgcctacacggctggcctattatgccgccgctgttgggcgtctacgacttcaccgccggcctgcctccgtcgccgccgagtggtgtccccgcctatacggtcggttggtcacaccaccgttgaagggcatcgtcatcttcaccgccggcccgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagcagtgagtcgggggctatagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgactaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactagtgttttcgcctgcacggttggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgacgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgccgcatccgccgctgactggtgtcaccgcctgcacggctggcctgttataacgccaactaatgctatcttcttcacggctggccacgtcgccgtcaccgctaataggcgttatcatcttcaacgcaagctgtctacatctgctgccgactagtttattcacttccatggctgcatgattccgccaatgttgattggctttatcttcttcatcgccggtcgtctcgtctactgctgactagtgccctcgtctctacatctggtttatacagcctaccactactgatgaacatcatcgtcttccgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaatacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggctccttcatcttcattgtagttgatctgtctgccgccgactggtttcttcgcctccatggctatgcgacttcattacttttgattggtatcactatcttcactaccaccagtattgttgccacctctggtgggcaatattatctctatattggtcgtcttgtctatatgccaactgcgtcagctaccatcaatggacaattgtgactacgacagaaggacaagctatatgctcaggggctcatcaactcaagcgtgaggattatatctccaatttggacttattccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcatttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatgcaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaactagatcgtcagatctatatacacccggcggattcaaatccccaaacaggagtagggtattacctttcattgagagggcctgaacctgtctaaatcctttgtctccgcatccatccactttaggtctcgtacgctaccctcttttattattgccgaattcatgtttcgacacaccatttctcctgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagatctagctcttgtgtttctatttgtgatgtctcacttgttgttgagaacaatgagcttaaggagcaagtggctaagctcaacaagagcttggagaggtgcttcaagggtaagaacactcttgacaagattttgagtgagcaatggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgccctggtggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgacagtggatgcactcaacacatgatagggctatgttcaccacatttgaggtaggaggaaatgaacaagagaaagtgacatttggagacaatagcaaaggaaaggtaattgggttaggtaaaattgctatctccaatgatttgtcaattgataatgtctctcttgttaaatctctaaattttaatttgctttcggttgctcaaatttgtgatcttggcttgtcatgtgctttcttcccgcaagaagttattgtttctagccttcttgacaagtcttgtgtattcaaaggttttagatatggaaatctttatttggttgatttcaattctagtgaagcaaatttgaaaacttgtttagttgcaaaaacttcattgggttggctttagcataggaggctagcccatgttggcatgaatcaattgagcaaactttcaaaacgtgatctagttgtgggcttgaaagatgtgaagtttgagaaatataagctttgtagtgcttgtcaagccggcaagcaaattgcatgttctcatcctactaagagtatcatgtctacatcgagactattggagctcttgcatatggatttgtttggcccaacaacctataagagcattggtggtaatagtcattgtcttgtgattgttgatgattattctcgctatacttgggtgttctttttgcatgtcaagtctatcgttgccgagcttttcaaaaagtttgcaaaagggcccaaaataaatttaattgcactcttgtgaaaataagaagtgacaatggttccgagtttaagaataccaatatcgaggactattgtgatgatcttggtattaaacacgaactttccgctacctactcacctcaacaaaatggtgtagtggtgaggaaaaatcgtacattgattgagatggcaaggactatgcttgatgaatatagtgtttccgattccttttgggtggaagccataaacaccgcttgccatgcaaccaataggctttatttgcatcgtctcttgaaaaagacttcctatgagctaattgttgggaggaagcctaatattacctattttcaagtttttggttgcaagtgttatatttaccgaaagggtgatagtctaaccaaatttgaaagtcggtgtgatgaagggttttttctaggttatgcctcaaatagcaaggtataccgggtctacaacaagaacaaaggtattgtggaagaaaccgccgatgttcaatttgatgagactaatggctcccaagagggacatgagaatttggatgatgtaggtgatgaaggcttgatgagagctatgaagaacatgtccattggagatgtcaagcctattgaagtggaagacaagccatccacctccactcaagatgagccgtctacttccgctatgccaagtcaagcttaagttgaagtggaggaggagaaggcacaagatccacctatgcctctaaggatacacaccgctctttccaaggatcacccaattgaccaagtgttgggtgacattagtaagggtgttcaaactcgatctcgtgtcgcttcgatttgtgaactttactcatttgtttcttgtcttgagccaaaacatgtagatgaagctccttgtgatccggattggatgaatgctatgcatgaagaactcaacaactttgcaagaaacaaggtgtggactttggttgaaagacctagagaccacaatgtcatagggacaaagtgggtctttaggaacaaacaagacgagaacgggttggtggtgagaaacaaggtaaggttagtggcacaaggtttcacacaagttgaaggtttggacttcggtgaaacttttgcccccgtggcaagacttgaggatattcgcatccttcttacatttgcatcatgctttgatataaaactatttcaaatagatgtgaaaagtgcttttctaaatggtgaaattgccgaacttgtctttgttgaacaacctcccggttttgaagatcctaaaaatcctaaccatgtttacaaactctcaaaagctctttatggtttaaaacaagctcctagggcttggtacgaaagattgagagattttcttttgtcaaaggatttcaaaattggaaaagttgacaccaccattttcacaaaaatcattggtgatgatttctttgtgtgtcaaatttatgttgatgacatcatattcggttctactaatgaggtattttgcaaggaatttggtgatatgatgtctagggaatttgagatgtccatgattagagagttgagcttcttccttggacttcaaatcaagcaactcaaggatgggacgttcgtgagccaaaccaagtacatcaaggatctactcaagaggtttagcttggaggatgcgaagcccatcaagacacctatggcaaccaacgggcatttcgaccttgatgagggaggtaaaccggtagatttaaagctttatcgttctatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcattcctgtactattggcttgtggtacccaaaaggtgctaagtttaagcttgttggctattccgattcggattatgccggttgcaaagtggatagaaagagcacatccggtagttgccaaatgcttggtagatcccttgtgtcatggtcatccaagaaacaaaactccgtagacctctctaccgccgaggcagaatatgtttcggcgggtagttattgtgcccaattgctttggatgaaacaaacattgttggactatggcatatccttcaccaaaaccacactcctatgtgacaatgatagtgccataaagatagccaataacccggtccaacattctagaaccaagcatattgacatacgccatcacttcctaagacaccatgttgccaagtgtgacatagtcattagccacataagaaccgaggatcaactagccgacatctttaccaagcctcttgatgaaacccacttttgcaagttgaggaatgagttaaatgtcatagacttctctaatgtggcttgagatggtgcaccatggttgcttcttttgcatattgtatatttgctcctatttgctcttatgctttggatttatttccatttggttcttcattgcgaaaatggagcatgtcacattaagggggagttttgcactcttgcatgtgctctacttccttttatatgtgagcaaatcaactaaaagtgctagtagtgtttttaaaatgcccaagtcaacataagtcaaaacttttgcaaaatcaatgtaatttgaaaactatctcttggaaaatgtttcaaaaggttccctatatgttttccaagcctcacattgcaagaaaaatgatttttgaatgaaaatgccattttgaccctcttttgaagaaactagattcttacttttggctaaaatgagatttatccccaaaatgagattgagaaggaatttgagaaaagtttcaaaacaaagttggtagagaagaagatttgaaatgtttttggtattcaaacctatttcaaaaaccaaatcattcaaaagttatttgaaaatcaaattcgcccaaaaacccctatagaccataaaaggtcacctcctagcactcaagtgagttttgttgcaaatcttcataattttcaaatgttatgaatggttggaaatatttcaactcacacatttcaaaattgctccaaaaatcaaatttttgttgaattttattgtgtggggatagccgaactgtgtaagagctgtgcacaggcggctgggggccaggcggtctgaccggcctcatatagccggtctgaccggccggggatggtgggcccaggaaacttccttttctttctctcttcttcccctacccgactccatctcctcccattcagccttcttcttccccaactcgaaaaaaactcctcctctctcctctcccaaaccctagccacctccctccaccaaatcccctcggtttgaccgcggatttctctccgattacaccgtaagtgattctcctcctcttcctctctctaatccatggattagttcgtgtttttgttgagtttttgatccatggcatggaaccctaggtgaagcacgagttgttcttcgatttgcaccaatagagggtagtttcttggtgtgattcaactcctccaaccggtaaatcactctccctcttgtgcattctctcaaatcgatctatttcaccctagggctatgggtagttgttccaatcttgatgaaataggtccaaccttttgatgttctagttccaatcttgtgcaatattgttctagcaatttttagactcttagtagatgtgaaaatttttggatgcttgaacttgtgggaggaggtctgcccggagccacaggcggtctgaccgttggtcagccgccggtctgaccggcgtgtgcgcccagtctaaccggccggcagctgtcggtctgaccggccaccggtgggcggtctgaccggcctgatgccgtcggtctgaccggctaccacgggcggtctgaccgccctactggctgcggtcttaccacccctccataggatataggcaaattttcacctctccaaattgtttctagaattattgctaatatcctatcatcctttgttctttgacagtgatgcctccccgcactcgtcatggtcgtcgtgatgcttctcatccttccagttcggcgcgtcctccttctcctccacaagagtgaagaccttttttttggtgcttgatgccaaaaaggggagaaaagtgtgttttatgttttggtgcttgatgccaaaagggggagaaaagtgtgttttatgttgggttgggactagtagtagtaaggatagtgccctcatatctaataggttaaggtggtttgggctatattatgtacgggtatgggctattactctatattgtgtgttatttgtcgttttgttaaactctaagtcatttggacccttcgtggtcttgtaatagcctatgttttatttgtgagccctttttaggatgttttgtgacttttgtgagttaaatggttaagtgatgtgaacttatgcaatgatggatggtgtatgtgatattgatgtatatgtgaccatcttatgcttatggattgaagtttacattgatatattgctaatgtgtctgtgcttgttgaaatgtgcattggctccatatttgttgtttatgattgatatgcacatgtttaggggagcttttgattgttattgcaatatatgtccatgtgttctatgtttgattatatatatatttgtggtgtttgtcatcaattaccaaaaagggggagattgaaacatctaggcccccgttgttaattttggtaattaataacaagtgctaattgtggactaaccgttgctattgagataatattttaagttaggtccacatcatgtgtgcgcatggatgactatcgatggattaaaattgacggagcaaagcaaagagaagacggtaaaactagtgctttaatttagaattgatcgaggtgtagggcgatcaaatttgctagtttattttctagtttcgccgttctattaagaggggtaatgacctagcaaagagatgattaaattgccacattaggtcattatgcatttagacgtgtgctcgcttttcatcacacacacacaatcacttgggatttcactgggctcggcctgaccaggggcggtcagaccagccacatagtggcggtctgaccggcgtgccttgaccggtctgaccggccgcaagaaggcggtctgaccggcgcataaggccggtctgaccggcggtacatgcgcggtcagaccggcccactggaggccgggatagtgctgctcggggtggccgatacagagccaacggagccgtagtcgatcagaccgagccgatggcggtctgaccgagccgaggccggtctgaccgccaactcaatgtcggtctgaccggccaggccgatggggccctctgacagcacttcaatggctagttttctagccgttgcacagtagcacggtctgaccggccacatacctccggtcagaccggcagagcacaaagttgggggattgcacccccaacggctagttttggtgggtgggagtattaatacttccccaccagcagcaaggggactctcttggcacccaattcaattgcatacatcccttgcacctctctcatacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctagacggcttgtagaggagttgcccggtgacctctccgagaagattgtggaggaggcccggcgccggtttgtgagtggtttggagttcaccaccttcggagtaaaggaagaactaccctagtgatcgaggcttgggtagtcctctccgtgggccggctcccaccttgcccaccccttgacgaagggggcgtgcggtggcttcgtggttgagcggtggagttgggctctcctcaacgggtagtaggaaaccggcgagtttccgaacctcgaaaaaaaatctcttgtctccttgtctaatttgattatcgcatttacatttgtgcaatttacatttctagagacatacttgagatcatatcaccctaggattgctaaacattgacataggagtgtgatttacttttcctagagatataattgagccactatcaccttaggtttgcaaaacgtaacttagttgcttagttagagttaaccctcaccaagcctagcaatttaggttagttttgattaggtgtcatttagttttaaatcgcctattcaccctccctctagtcgacatctcgatcctacacgcttgtcgatgccttcgagctgggtgcaggccccatacagccacgagatgtatccggccgccgactcctcgggatcgccacggggtactcggagctctctacagactctcgtcatggacgtgcagcaactcttcaggtacaagttgaaccacacctcgcgacctcggagtgtttccacggcctgctccttcttcacttctagcatagtcttctcgagctccgctacctcaaatttcgtcttccaatattggatgcgacgatcttcgttagcaagcacactctcgaaatctgctcagcatggaaacaactaagtcaagctgctcttctcttctaagaacacagcaaattaagtcaatccagacggaagagtaaaggagatgaaaacaaagatcaccaacctaaggaagtcgtcggcaagcccgtttccacgggcaaattttgatctacatcgtcctgtgacacatgtggctcaaacgcaagtgccggaacgatcactggcaactcaggctgcccgcgctgctggacatcctcgacatcgacatctctataaacaataacaaagtactcgggatcaaaatgctaaagaaaattaaggtgatgacttcacacgcaaaggcagttggagccaacaaaagttttacaaagcatgactgattaaagagtacaagggaactgaagtcctactcttcaaaaagtgggagaacagactctcccagatcgccgacttcttccatcacgcccttacgcacgtcgttagtcgctccctgatccaagatccgctggagatcaagttcagggtgcgccaaccttatgaacgcgaggatttgacatgccccagtgtaaatcccattagatgtctcctctccgatcctggccgcatgcttggagggtatcgcctccatcgccgtggccagttctgcgagcgaagtcgtcagcgagaactcgtcggggttcaccgggatggtggtcgtaacaccacattccccggcgagctggtgtaggccggtgtaggtgacccgcgacgagccacggatctccgacaggttgttctcgagttccgacatgcggttctcgagtccccgccgttgtcgctcgttgccagccactagttccctcattttctggaggtcttcatgaacctccgccaggtcacacgccagcttgtcggcatgctcgtttgccgatgacgccgccgccgccctcgcctccgcaatctcacgacttatgccgcgagcactggcctcgaggatgcaccccatgtcgacttggagctccccctaggtgaggacgtcagcaggcgggcctcgagtgggcacaagatcgctggcagggccgctgggcgtcacctcacggctcctgggcacgagcacgacatctgtcgaggccactgcaggagacacgctagagtttcctctggacccatcttgcgccgtcttcgcccgcactgacctacaaaagattgtcatcaccagccttcaagacaaattcccggaattcgatcaagtgaaagacctctaatttcatccacttacttttcgccaagtgtcaccagcctctgccgccgcggaggtgacggagacgcatccaaggcctaagtaaaccaagtacgacgtgagggagccatcttccaactacgtaattaataacccaagagacttaccgacggggaggacgctttccggcgaccgccgagcacggaggtgaacttcctccccttcctcgggacatggctgccactggtcgtggcgacagcagcagtaatggccatgtcggacgcctcctgggcgatgccctccttcaacgaggccgccgcctggtggtccacgagcggtccaatgacgtcggtcagagggagagcctgcaccgcacgaagtcattgtgcgatccaggagtaaaaataaaggggtcatcgaatacactcacattgattgcggcttcacgctcggccgtccccttctcgcaaagggggatggggacgttgctcgccgttgtcgagccgctgatcatcaactggccgacgcgacgctatacggtctcgctgttcaaacctgtaagtcaggaggaacatgcacaaaaggaagtcaaattaaacacaagaaaaataccccgaagagaaacccgggtcacgtccttcggccaataatagtcaaaggctgggtggactcgagcctggagcggctggatccgcctaccaatgaagtcggcagcgacttcataccccgacaaacctcttactcagaggtcatcgatggcatcgatgaacgactgaagagaaggggtcaaggcgggtttggcggtccaagacagagtcttgactggttgttcctcaggaacaacaaagattggatctggatcctttatctgaagatagaaccacctcgcccgccacttgctacgagaagaagggcactggaaggggatgtagtgcgacttcagcccaacccaaagtcagaaaccgacgcatccagataccctggtggatcccatccaacgcaactcgtagtagaagcgaaagaggtcgagaaacggctctaccccaatgtaggcctcacaaagatgcgaaaagatactgaggaaggcgatggaattggggttcaaatggagcaaagaaagaccgtagaaattcaaaatgagaaggagaaactcagaaggcggggggagaaaaccacagagaatataatcctcaaccgcaaccatgcgacctaggacaggttcaggttcagtacctcctggttccctctccatggtcccgcgaccggggagagcaccctcctcctgcaacttcttcagggatgcactagtggaagtggacttgtcgaggtccattgccgcaggagatcgccggagaagggaccggcgataaacaagctagggtttggcgggagcggagaagacgaggaacgcttggaggctgaagagctttttcacaacaggcggacttcaaattggatccccaaaatcctcttaaatagatacatttctgacggtgcgaattccaaggaaaggagaaagagatggccgccggaaatttctgggtccgttacgcgcggcagtttttcgaacttcaatttaaattcactcatgaccgttgggcttcacacggtgttgtcgattactccctgtcacctggagaattagtcgaaccaactcaattacgatctcgctggtatcatcgagttccattgttccccttgtaacctatgatttccatcatataataccatatcaactggattagggctattacctatcaaggggcctgaaccagtataatctgtgctttttgtctgcttgatgtcgtattatgtagatcctcgtaccagcgtaccccaatacccactatatccggtctatgggtatcccccgtcgacaatctacttcataattcacaacgtcaaaaattgtacttcatgataaaatcaaacggggcctaattatttattgtaaaattcaaaaaataaaatttatttttttgaacaaatttattttttttgacaaaatccatataagagttttagctagaaattatgaaccaaaattatttatttattgggttcaaagtttgatgaaaacaatgtacgaatttcataaaatttaatttaaaatttatttaaatattttagatttatttttatataagaattgtgtttttatcactaaactagcacataagtataagagaggggtaataaagtctatttataaaacattcaatggtcaactcatggccaactaacagaatggacatagaggagatcaaaataaaaactcaggggtatataagggataaggcaaattttaggacacacaagggattgaacaaattctcatgggtacatagaggattatctcttcaagtaaggattcggatcaggtttagtcactgcaactttggcagtaccaatcatccaaccatccggcaaataagggatggtctagattcttgctcaattttccccaacttttcacctaccctctaactcccaaccgatgccttttggagggaaaatgctgagaggtggtgagagttggcgccaattctaccatgggatcagaagaatacttttgagaatgctctacgacaggtgcccgatcaaacgaacaattatcggacgctcctctgctacatgcaatggaattctctctttcccttttactccgcattgctatgtcgcctgctatctttcttattcccattcccatacttgagtagaataatcgcaaaccatattgcatggcatcaaattataatcaagaatttgggctcacttaactaaaacttatgttttactagttactaacaaactgtagctaatacagaataaaagcacctagtcctcgtcgttggtccacagtcgtcgaccgccttcatcatcggatcaaatcagggcttgacaaaccacctccacaagggttactataccttccttggttgggtggtttcaccacaagaattaccttctccactgctagagattcacggacgaggaccaccttctccatggacattggatcccgctcaagagaaatataaggagaagggtgaactaggagggaaagctttgagaaggagactgcaatgggagagtgtcacggatgagtagcaggattgggcctgcgtgcctgtgttgggtgtaatttaagtcttgggcctgcgagcccacaaacgatggctatttaagcaaacgctgaggattgtaggcggcataaaaacagaaataagaaatacgccttcctcctcaactctgtcttcttcctccagcttctccgttctctcacgtctctctctgcttcttcctcaatccccttctctagatcgaatcgcgtggtgccggaggcgtgtggcggcggtgagttcatatcagagagttggatggctaccactcatgcctagtcgcgaggatggactgaatccagcgctagtcaaaggtctaaactgtaactgtgtgtaaaaaagagatacacagagttgaaagaaaactttaggtacatttgatccattgtaaaactctagtcaaattgacttttgtttcaacagaccattaattcagttttagatatcaacaattaaattaaatcacacattttatacttacagtgttgattgccacaaacgtgcttttttttatttttcaataagttgaggggtataaaatgggaaattaaatgtcaacattaatttattagcttaactaaaattaaggggaatataagaacgactgtataaaaaaatattttctagtttgcccaccttttgtgaataaatttcagaggacctagtttcacagttgttgttaacccaaatctatatatgcagcaaaatatttataaaacccatgcactctttgaagaataaatatctggtaattttgtacctatacacatgcattagccattttcttttgtaagtatatgatttgatggcatatttattaattaaataaagtgtaaaacctttgcattacggataaaaaaggattttagggttttgcgaaaattttgggctctgtttggtacggctccaaatttcaactttcaactctaaactctaactccagtaagagtaggtttctataggagctgaggtgggtatgaaagtgtttgtctagattactaaactccatactaccacgttccttgtagttatttcatcgaacatcttgttggcgttgccctaccgctgttgccgtcatcgtcgtcggtgccgccaccagcggtcagcccgagcgccgccaccgctgttgccgcaggtctgcccgcaggccgccttcacaggtccgccggcacccgccgccatcactcaacccacgcgtcaccgccctgccgttgccgccgtcgtcgcttagcccgcacatcgccttgccaccaccgccactgttggtcataccgcgcattgccggcactagcaccggtgcccatcgctcaacccgcacgctgccgttcgctaaaatatgagagagaacaggcggagaggggtagatgaggagagagaacggagggagaggtgtaaaggggtagttcagtggcatttttatgtaaatactccctccatttcgaaatgtttgacaccgttgactttttagcacatagttgaccatttgtcttattcaaaaacttttatgagatatgtaaaattatatgcctacataaaaatatatttaacaatgaatcaaatgataggaaaataattaataattacttaaattttttgaataagacgaacgatcaaacatgtgataaaaagtcaacagcgacaaacatttcgaaacggagggagtacactgaaaaggcagtggctatggaacagaaaaacctagctccactcccactcctgcagtagaatctatactgtttggtacagcggaagctgtaggtagggcatcgtccaaactccaaactccatttgcatttctgggcggaggaacaaccgccggcgatcagggctagagagctcgccgtggacagcctcctcctagctcccctctccccgccgcacgccgtctcctccaatctgcggcctgacctcctcgcgcgctcggccggcacggcaagaaaggctgacctccgtctccgttcgaatcggagccgaaggtatatccatcccttcttctctccctcttcctcctcgccacttcatgacgcacgtatgacctggcctggccgtgtgacctgagttggagatcaatccgagggggtttggattgatttcttaatttcttcctttccctcgaatcaacccatccgactaggtgtgtttgattcgtcatgttgtactaatgtcagttcgtttccaagattttggggtccatgccacacgttaggtaggcccctgatgaacgcacgtatgctccctgattggggtaaaataaaaaattggggaaaccctggtagattctccaaaacctcaccttgaaatttgtccaagtgtgtccgttgcttgactatccaatcaagctgaaatgttgacagtaatctgtaaaatcctattcacatttgtagctacttagaccatcgcttaggcagattgatggttttattatgaagtcttgattgattttgttcatagtgcagctcacacataaaaaaaaactctgcacgaattgaaggctggggctaattagtacacgttgaatatagaaatcacccttcctaaatcggcgcggtctctttcgattatatgaggctgtattctacaattgtgtgtatgatctaatgatggcagagatctagtaatactagttaagatgataaattcctggtgtgcggttgagagcagggaaatgcactagtgggaacaaaccagttcaggtcactagtttgatcgcatgataatatagagtgtatgcattcatgtagcttccgtatgataaggtcttgtacaagtgcttttttttttcgccgggcctgtgaagagacaccagccgatttcattggattggaaggaaacaaattacaaagattgttcaggttatatgacaacagtcagggcagttggaagggaagccattccccagtaggggggacaagctacgagtataaagcagagaaacgtataagtgcatttgcaggaaacagtggacctgctatcttatcttatactccatccgtcccataatataatggattttgagtttttgcttgtaacgtttgaccactcgtcttattcaaaattttttgaaattattaattattttatttgtgacttactttattatctacggtactttaagcacaacttttcgttttttatatttgcaaaagaaaattgaataagacgagtggtcaaatgttgaaagcgaaaatcccttatattgtgggacggagggagtagtataatagcgtaagcatttccagaacgtttgtttgagaaggtcttatacatgcgcatttcacaataggaagcaatggaactgctagcccagatggtttgtcctcacttgagttagtttgtaggtgccgggctcaaaaccagctgtgtgggctatttctagcatttgtgagtaactgcgggttgggttgcctcggccacccaggcaaatcaaaaatctccaggccagttgtaacttctatctgatggacggactggcccaagtgatgctttttttctgttcaaactgcggggtggtccaagtctgatagcaatatgctgctgcgcaagggtttgagattttcttatttcccttgtttctcctggacaatagagcacagctctcttggtagatccttttttaaaaaaggaaaatcataagcgtccttttctacgcctactgtatgtctgtatgtggtgcatattggtagatatctttaataccgaaatcagggctatggatctggctttttattgggccacgtggctccctaaaaatttggttacacccctccaaaaatttgccacgtgtcaaagcgacggtattcactctccgagagatcgggaaaacgttcgcctatatacgcttgcaacgtgggccaggcatctcgcaaggccatgcgagcttgggcctggcgccgcacggcctttctccgcaatgtacctgcgctgctgcgcatggtcctcatgcagcgtgaagctagcacatacaggtacagattactaagccagtttagaataaaataatatgtataaaaaaaaggagaaaaaaataataggatttttagccttttcataataatcttttaacaaatgcaatttactacagattactcggaatgaggaaaagtcacttcatgttaatatcatgtgtttcaagagaataaaataaataaatagttaaatcaaatggaaaaaaaatagtgacagcaaggattgcgttaggacaattaaaaatcttcagataagatttacttgaaacgaggaaaataccttaatttctatagaatggaaggaatagaagtgaaatttccatgtgaaccgagaagtttataactactttcctattaattcagagtatttttgtttttttttctcctcacattatacttttttatgttaggaattcatttattttagaacattggtaagtaacaacaatcatattgctatttttttattgcgaaacacaatagatatagatgttcatatacacgtgtgtatacatacctgtaaacgcacacatacaaacccaatcactacaagcacctccgaagattgggccgtcaggcatatcttaggagtgatgaagaatggtgggtttcctaccattgaaaaaacaaatagccgtaaatacaagcgtctatgctaagtttagaacttaactcgtataggtagagaacctgaccagctgagctctacatagtagtatatctggatatatgaaatcaaaataagtgtctttaccatgtcatcgtcctttatttctaaatgaaattagtataaaatttaggtaatcgaagacacgtttatttcggatatgtatttcctactaatacgaactcaatggcttacatctatatgttggatattaataaaacatatatttttactaatgttcagcatgacaataccactaatctagatgattttactattctaccttattttgttcacaaacataaaaataaaagggaatggactttcaacaatccttttcgatgtatgatttctgaagggaaatacacacatgctataaactaacttagctagcgtgacaactggcacgctcattttctagttacattcttaaaaatgtgtactagcatagaattaaggataccattaaattgaactttaattaagtgcatatgcctaaaattgttggatcacggttttacatgatgggttacaagaccgaggcttattatatcctatcatttccagcatgtacttgcattatccattttttctttaccatttaattttttgctccttagtgtttatatgctgaattgttggtgcaaacatgagaaaatttggtttatatgtccttgaaaatatctgcaaaattttatattctttgtatcagcacagtaagtatgcatatttatgcccttgatagcataagacacaacattcctagctttgtgcagtaatctcttaagcatttgtggatgttattctgattcaaagattgacacaaccacataggctgacatcttgtatattgggacctttggcaggcaatcggccatggttttccttaaggtggatatgtcttggaatgtgttgatctcacctagcgagctgagccccaagggtctcttgctccgcaaggctgtcattgttagtcttctggaggagatagcaaacaggaaggcctccaaggatcatggttactacattgctgtcagtgagctgaaggcgatatcagaagggaaagtgcgcgagctgaccggagatgttcttttcccagtgacattcacctgcatcacacagaagcctacgaagggcgagatcttagttggctctgtggataagatcctcaagcatggcgtgttcctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaacaccattagctatgttttcttgtgctttgtactactgcttttatgcctttatcatcctcctttctacctcccatgccgaagaattcatctacaatggattcactgatgctgatcagctaacactcgaaggtgaagcttcaattgacaggaatcgcttagggctaacaagtcgccttaacataggaggttttggccatgccttctacaagtatcctctaaactttagaaagaactcaaatagtcccaatgacccctcctttgctacaacattcgtgttcactattactacttggagagatcagcctcaagaagcaggaagtgatggtattgcctttgtgctttcttccaccaacaagttgataaaccactccttgggaggtcagtacctaggccttttcaatgcgtcgaatacttcacaaaatatattagctatcgagcttgataccttcatgaatcctgatttgaacgacatggatgataaccatgttggaatagatgtcaacagcttgatttcaatcaactcccataccgctgggttctacacctctgatggtggattccaactccttaggcttgccaatggtagatctccaatattgcagctatgggtggactatgatggcaaagctcaccaactaaatgtcaccttaggtcttccctattcccctaaacctgaatatccgctactttcgagcatcgtcaatctctcatccttgttaccaagttcttcgtacattgggttttccgcgtcggtaaattcaccgaaaactagacattttattctaggttggagcttcaaggaaaatgggagagtcccaccccttccttcagtcccagtcacagacccagaaacatatggatggggaggcaacttctttgcgccaccaccacctccacagcttaacacacaccaagttcacaaacactccttgcaaattctcctaccaatagttatgacttcagttatcttgcttcttcttgttgctttccttggttggcggaaaaaagctgggccacaagaagactgggaaatgaagtgcaggccaccatctttcatatacaaagatttatataatgcaacttctgggttcagtgacaaaatgctccttgggaagggagggtttgggaaagtttacagaggatttcttcctgcctctaagcggaatgtcgcgatcaagcgcatctccccagagtcgaagcaagggatgaaggagtttatgtctgaagttgcaatactaggcaatgttcgtcaccggagtctttcagttacttggctatcgcaggaacaagcacgagctcctcttggtttatgattatatgcccaatggcagccttgataaatatttgtatggtcgacacaaattggctttaggttggtctcaaagatttcgcaccatcaaaggtgtcgcgtgtggactcgcttacctccatgaggaatgggagcgtgtgatcatccatcgagatatcaagtcaagcaacgtattgcttgacgaggaaatgaatggaaggttgggtgattttggccttgcaagattacatgatcacagagttgatgcctacaccacacatgtagcaggcacatatggttacattgctccagagctagctaggcttggaaaatcaaccaagggtaccgatgttttcgcatttggggtgttcatgatggaggctgcacgtggaaataggccaattgaggtgaattcctgtggagaacctcaagcgctagcagatcatgtgctcaatgcgtggcaacgcagttcaatcataaactccatagatccaagtctggaagatcacgttgcagaggaggtagtattagttttaaagcttgggcttctatgttcacattcatcgcccaaggtgaggcctagcatgcgcttagtgatgcaatacctggaaagggaagcaacgctccaggacttcgcatttagtttcttcagcatcaatgaagctaataatgaagtttatggtcagcatgttgtatcaaatccctctgtagcaaccaccataaccactctttctggaggaagatgacggttgttgcagcatgtattttctatatgatcatatacaattttacatcattgtgtcgactgtaatacaatgttgaaaaaatactaataattgttaatccgtgctcctgttccttgtgaaatacaccaaagagctgttcaaattgttttcgctagcacattacgaaacaattgtagactttgttcacaaaccagaaggagaaatctatatcgtgatgcaggaataatccgattgttaatcaattttacaaaaatcctcgtactatccaattaacaaaacgagattaatcacatcatggaataatctatcacgcaatagattaattttgttccattggaaatctgcagctcaatgtagattattgaagtcgttacatttgtgttcatcgctggctaacacaacaacaggtaagatgatgtccatacattttattttcctaatcatctaacttgtacatacattcttttacactacaacataggctcccgatatgagtcactacacttgccctatggaatccttctaattaactagtgtggtggatgtcacaactactgtaaatcaaggaatgattttgctacaacaaacagctgatcatcagattggggaacccagattccttgatctgatcccaacagataaatggcatgtcctaactcctaatgctattcactattcacgagaaagggtggcaacaagaagaggagcagcttttgtagcagagcattaatgtagatggtgaatttcaatcaaaccaacgagggaaggaactcaaatttgtgccttctgacaagggtgtttgactaggcaaaccctcttaagtcatgggagaatgcaaagttgggcggcagcaacataaggggatcgtctccagacttcttcaggtaggccatcgccagggcgtatccaagtgctcgtccaacaggtacggccaccgcatttccaatctggcgatacctgcagccaggctcatcacgtgtaacctgtgctaaagaaggctcaaaaactaccagtagctatacatattatcactcctctttgggcaagaggaccgtgatctgcacgtggacatactgtcaaccttggccacctgatccaagttctaattatagggtcgactactcagggtatctgaatgcattgactgctagaaaagaaaaggcgcatccaaccttggcccccaggaatggaccccaaccctgaactacaaaccctgaactactaatcatgtgaggccactgaaccatggattttagctgaagcggtgcaggtgttccactggttttgacatgtgtcgtgaattaaattttggctaacatagcaccccaattggaagaattagcaaagttatagccctcacccatcagtccgtatcttctacttctagcatcctcgactacatgcaactcctctctgcacgcaaccacccatcgatctctctgaaagccctaattgataagctcatcctttttcaccatgcacatgatgaccaacagtaacagaatcttaatgatgacagcagtagtgagctcactactgttggccacgcaacaaatgttgctggcggagtggcgatagtggaccttgaggatggtgacaatggaaatggtaggcttcagggatgacagcagcagcggaggaccttggtgagggaggttcttcaggaagagggcaggagaaaggaaagtaaacaagggctgctttggccactgacgtggactccaaatcaaacaactaaactatccatgtatatgccacctcagctaattccagcttcaaatagcattgagtgggtaagttacttgatattgaaagttatcaatggtcatcctgtcttgcagtacagggtctttagtcgagggatcaaaagtacccaaatgatattatttaagaaaacctcatacgtgcactaacaataaatcgcagaattcaatagtttagatatgccaattcatagagcaacatggaaaaaattgagcccttcatcactcaaaataaaaaaggtaaagacaaacaagtacctgtctttgactgttccacgaaacctgtaattgtcaggaaagccttgcaaccgagcactttcacgaatagtaagcagtctgtcttgtgcaggatgtatcaaggcctgaaacataccctcagtaattattttgaatcacaaccaaagtggataaaagaaatgagagaatcaaagataacctgcatacgggcatttggaactgtcagcacggttcccactacctcatcccaccatactcgaccaaaaggtctaaaaataaattatagaacgaacatataaagcataaagaagaacaaatatgtctacgaacaacacaactagataaactgaagtttggaaccaaccttaaagatttaccattctcataagctagtatgcaatcaagcacctgacatgaaaaacaagaacccatagcatggtaagctaatcaaaatttgcacaaacagaggtatagttccacataggggagttttgtggtttcttgttaaatgtcttaccagaggacgaccagatggcaaaagtactctttctttcgttggatctaatctagccacattgtcaggaccaactatgactcctgaaaggtctctaaaattagctccctgaaataagacagatgagactataaggtttaacctaccaaacttaaatctgaatgtaaaaagcatttcagccaacctttctcttgggaatttgcaatatcctttggtagttatcattatccagtaccaatggtcgatgatcatacaattttgaggatttggaatcttttgtaacatgagctctgggaccatgcacttctgcataaaatttcattcgtgagtttctgatatagctacaagaaacataaatataattggtcaacaaaaggtgtattagttaattcttggaaaaaaaatggaacaccatatagagaaaattaacacctaaaatgttaaattattacacccatcatatgctgtttttcaatatttcgccaattgaatgcataactccttgttccatattttacaataattgctattaaacagacttataaatgatcatgggaaaataaactgaactctgcaacttagtttctttctttctctttgctaagaaaactaatctagttattattatctgcccccatgatttggacattttaatattcggtgtgtatgggaatacatattccttgttacaaaaccttaattttattatccaggttcaggaggaaaatccaagtttttttaccagaggggaaggcgatcaactcaccaacattaaatgaccgaatgtatctttggaattcagtttgaggaccctttacatacagcatttcatcacggctttccccatttgccacctaataattcaacttaagtatcaaaatgccattcaaattagatatttcaaagatataatgttgtcagttacttctgggagatcagaaagaatgtcttcaaggacaattggtcttgctagttgcattggtgtgtcattgggccaaccaaccaaattacgctacaacgagaaagaggaa

SEQ ID NO: 26329 - DNA, 1237 bp, Oryza sativa
cttgataatgcattgcaactagccgacttaaagcatatcttgcaagtgttgcatcagcaaatttcaatatatcaaggacgttttccatgtacacatatttgggcttcaaaaattgcacaacatccataaaaactatgatctgcttgtttttctcacatttaaatggtgcctcgaattctctattgcggttgtagccactaattccttggcatggtggacccccacatacaacgtccacatcaccctgaacacatgataaacatgacatggaaatgaatatcaaagagtccaactgtagcaagtatatgtaaaattaaaataattactcttatttcctaaaataattcttagtagttgtcgatatgagataaagtatatttgtcaaagactgaattgatacgctggtattaccggttggcacctataccatagtaatcaaaatgttaagtacatgtacccttgaaaaaagctacattatattgatttaatttgttttcatgaatgctaactgtgtatggaagcattttccttcccatttatttgtttttctgtgtggacacataacatttacatgtcttagtctaatatatgatgatccaagaaattaacaaatacaggtaacagaaatatgtgcttcaccaataagctgagggttgttcgtatctcgggtatatgggttaatctagtattggagccaaattcaggttcattgtgtttgagtggattaactgatatgtactctatatggtcaaaaccaatgtttctgacatcaaaaccaccctaaaacataatttaaccaacgatttatatgctacctaaaaaaaatttgagtttatctcatataggaaatttatttttatacaagaggtctatttgaggatgtctttgtccatatttcacaaatataaacatgacctatcttaatacttccccattaacattttaattttagaataatttaggtcgttgataaatataatatgtaatctaatcattaatgcaatgcatattgttttatggaacaaccagtcctgcagcaattcgcgtaacaactcctagtaacttaaaaactgctactcaacctgaaagaaattaatgaaaccaacataaaatctgccatgatgccatcaaagaccacttggaatctacatttgtggctttgccatcgatactttttgtcctttttctctatttagttagtcaagagaccaatttaaccttctactaaaattaattc

SEQ ID NO: 26330 - DNA, 1578 bp, Oryza sativa
ctgtggtgtagaaaacaactgaacactttcaaccgtttgaaccaggtggttttgtggtgaaccagaattaaaccaagactggctggaccagctggtgtagaagagtcaagttattgcctcaaaggctcgctacaccatttttaacccaaaaatgcctcaaaatcgttggtggaggtttgatcccagactggcaagctacaccattccaagtggtttttgtgttgaaagtggaatatagaatatatcgtctttgactgaacgacgggccaaacatccaatcggacggtcagacaacttgaccatggaaccgaaagctcagccggttggctcaccagagggaacttcgatggtcgaagcaagaacacagctatgtttcttcgctaaaggaaattaataatcaaacacagagtagacttctcaatgttaatggaaactaaaaattggaaaaggaaatccatataagccccatcaaatgcaagtgcacttctcaaattctgactacacaaaggtttaatctaccacaactattaagacagtaaagaaataacaaacacttacagggcgtggtagtattctttgcctgtggccttcaataacaaaatccctaattgcctctttgcagttcctgcactttaaaagtcaaactgttcaaactttggtggaggcaagttatttgggaatgcagtcttcacatattttgcataccttaatccttcaactggctcccatgtgtcatgatgagggccataacccttccaacggacctacatgcatgataaatcaacccattaacttagcataaaacagtaaaaacaatgaacacgaacaaagaaaagggcagtgcaaccatggattgaccatttgtaattttttttcttttcttttgtacataaaccttgaaattaatatctaccatgggggcttcctccactgtgctttcttcaaaaaaagaaatgggcagtgcatgatctatggaaataaatagataattacatgatatgcaaataatataacatcaaatgatcaaaaagagcttgtaccaaggttaaggcaagaaaatgaacttatttaataacatgaatgcacaatccgaaattctccatacttaatatcaataagatttagcctacaattacatgaatgatagatagaatcaaagacattcatcatttcaacgagggctgagactcaaagttgaatccttatcttataatcactcctacacaattaagatgccattaacatagggattctttattactacgtcctgcagtgttaactgttaatgaagagtagtactttttgtttaactcttagcaattctatagacattatgctggactatggagttatattatttctttggttgctatggcatcgatcaatggtcaaagtattttactacattacacagttgttattaatggataacatatgttcctggtcacccgaatatttattcaaatgtccatttgtatttcagcagtctaaacaccttggcattcctagatgtaaaaacatatttcactacaaaagccatatcactcttgtgttcagctcctttataatagaaactac

SEQ ID NO: 26331 - DNA, 24674 bp, Oryza sativa
  unsure (1)..(24674): unsure at all n locations
accacaatacaggtctagcaaagagagctccatcttctctagcacaggagacttgtgcttcttattgacatctatcttcttcattttgtcattgattctactagtgtaacatgactgcattaaatcatctgtgtcttctgcttttcaagaaatttaatcagaataataggcacctaaaagaaattattacagatgaaagaacagaaaccatgcaaaatgtaatttacaagacagtacattacagaaaactatgatcaataaaaaaaaatgctaattcaaacaactgcaagatgtagatatcagcttacaaacagacatgattggctctgtgaagcattcgttgttgagaatactaacccatttctatggtagagaatgtactatagtcgatagagtatttcatgtcatagtaatagtcggacgaaggaactgactttgattttccatctacctgtaaataaaatcagaatcatacgtctcaatggaaaatgtttcagtagaacacagccatcacaagacaatatcaaaactgcaacatcaagccttacactaggaggaacttgcacgattgtcactttcgagacaatgcagtccagtaaattgtcatctgtcaggtctgagtaaaagagcctcctcgggtcatgtgattgtgcttgctctcctatgacctgagatcagtttagaggtttaaaccttaaagcattaaggaaaagtaacataaacttgtctgtccgcttctatttttacaagctgagaaatgatgttatggttacagtactccaggtttgatgcataggcaatataaaacttgtcaaaacaagcataatgttttagtcaaccagaactaaccgtgtcttcagctgtgaaaaaccattgcactctgaagtaacattcaccagtttttgtttcgaagaactctagcaacctgccaatataatttggttttccctctggaccctgcaaaagttaaatctattaaacttgtgcaacaaaaatattttttgatagcaagataaacattacttcaatataagaaagcagtaaactcacaaaaaacataccctgaaatcaagcatctgtagataaacatacataaagactacacaaaaagatacggtaactagtctgcacaattgtacagaaggacaaaatgaacataagaatcatttaagttatttttcctcagggaagtcaattttatacaattgaattgaaatgcaatgtgtcactgatgtatcatatctgaatcaaggacctaaatataggcctcacaacgagtgttgtattgcggatatggatgaaactcagtgacagagggtggatttatcctttttgtgaactagtctgtcacgttggtcagttaaaagaatatcaaccaatgaagacgcaagtccataaaagctacagaaacgaaaaataaacatatatatctcaacttgcctttacaaatgcgcattctccaatgcaaaatgtgtatctggagactttggcttgtagataatgacatttgacatccaagacagctttgccagcactgtaatataaggtagtgcatatagctgttaccatgaatagcttcaattatttatctgatataaatattgaaaataaaatagtgcatttgggctcacttggcaaatgtttggctgctggtcctcttatccttcaagaaaacaagcaaaaaaaatgttactcacttaaatttaattgttataggcagcatacgggcagactatataataccattagcaaattaaatgtaaacccaggtgtagaatagcaattcagcacctcgcagtagtgccacaaggagacatccagtaacaaaaccagtcgtacagtcagtaaatagtaacatcagaaggggagtgcagtaacacaccactggaaactcattaatgagtgcactatgtttgaaacggcacacccttcatgctgttactccacgaggagaataactattctacacctggacgcaaaatagagtctaagtgtacaatagtgttgtccataaattctttatatacaaatatccaaaataacaaacttcagatgaaaccctataagctgacaaaaaatgtacaagcatgtttatgttcatgtacaactatgagtatggctccacatgtcgaagatttttgagattcacttagccacatctatgtggggaaacttcttgcaagatatcggtgtaatataatagataaaagaaaaagaggcaacagctttttcacacaacttctgtatttatgcgttattttatccttttacaccaaaatttactgccattcaatcttcaaattaaacctttcatctaaccaagttgagtatcctatccagattctagatattccttatcttctcttatttatatgttcatattttaatcacggccaaatttgctcctggcagctaatcaaggcaatcatttgttggttcacactgcaaaagtcaatctttgcagaacactgctatttcatgaccatttgacagaggttactgcagctgatatagcaccacttcttgtcacgagagagaatgaggtgaaatgacaaatttccccttcaaccatattgcacaaatattggctgaaccttaaggtgctacaacttgcaaggtgggtgagattaggcactcatcttgcaaaatgctcaaaaagtcacacaacttgagtctaacgcatgccacacagagtgattgcgtaaaattggacacaagattggttgcctgaagcacaaagcaatcgaaaatggacaaattgaacacaccattgctgttgggctcccggcagcctatactaggacatcaagtttatctagagaatgtaactgtaccatatgctgccatatgttgctcttaggccgacttgggcatgctcggatctcatcaatgatcaaactttcactttccgctcatgtcatgagcataggaaaacctttccagtacaggctagattcccaggtgaagcctgctatcaaatagctatgaaggccaggcgtaggcttgttggggatcgaaacatacccagtgtccatgtcagcgcccacatggcatgagttggacttcatttggttagcatttggcaagatgactaatacgatcactgtattttattcttaatataaaacattgaaaatcagaattttcaaatttgaacttaagaaacacttttacaggatattgacttatccgcattcaagttttctgagcttgaatttaaataattcaaatttcagaatttttattctattaaattttggatcacatttactattcaaatagtataattatttatattttaaaaatcataatttttggctaaaaatcagaaattagatagtttagaaatttatattgcctaaaattcaagttttgcattctttctttgaaatttcatatttttaatatccttcttagccttgtcagcgtcaaagcttttgatgttaaaagggatcatctatggacattacactctccaacaatggaatgatgtttccactggcaccaaggtcctctgggttctaggtaatgatcacacaataacagtgtcctatggcaaagatcaaagatggtgatgtaaacaaataaatgattgactagattagcttctgtgggcaagtgttacctaaaatcaattttcatttatttgaaccgttgttcaaactatgggtaagaaaatagattgactacataggagatgcagccttccaaacctaaaaccaatgcacgagttataatttttttcttgttattctttctgtttccaactgatgcatagcttctcattcccataacatacattggatgtcagagcttgaatatcatctaaaaggttgaaaccataagacacactggaacatatataggttgatattgatcgatggaaacaagtttattaatatagtcatatacttgtatttatatccaccatacaatttttatgttctaacatgtactatagtaaaatgaatgtgcaaacaattacatgtttacccatttcacatctatgctttctgacacttccttccatgcttgaacattattgttaggaatacaaactactccctgaattgtatctgcacgaatcagcagttctcactattgtattgcatgtacttccgtgacaaagacatgaatagatatttcaaagagaactcctactcctagggaaatatgaagatgatctacttgtatatctatttaactaatctgcaatagtccacatcttattgttatattgctacagaaatatggcgatgaagtcatgcagagagcagcaaaccagccaaatcacgtgcatacctttttcatgatttgatcatttatttcgtaacggtgaggccactgcttcctagcctcatcatcaggaactgcatcccccacaaagaaacaggaaccatcgtccgtttccaacatcactgaatcaaccatgtgcttgtccaaaacaagttcgtgcttagtgctcagttctggtattattggaactcttggtgatttggacattgagccattattttctggtatcattggaactcttggtgatttggacattgagccattattattattgttttctgccctctttaatttttccaagtatttaaccgacaacgtcctggccctctgtgtctttggaggttgaggggatcttcttcctctcccttgaggcgtcttgctgaccactcgtgattttgcacttttcaactttgagttgcacaacacaataccaccaccatccactccatccagacttgtcaagcactcttcaacagcaagcttatgctttttagtaggtatacaaacatctgatttctgcacaggaggtccaccatttaccactggtgatatagctgacaccctgtctgaattcaccaatacctttgaggctaacctagtcttccttcgaggaagaacagaagctcctttgtctttcaacaaactattactcgctgctggtaaagccaccacaacctgattgtagagaccacctgctttctgattattgtcgtaagaggaacttacgttttccacggcaacaatttcttgcaatccttgaaccttcaccccgttaatcaaatcaactgtgtttactgaaattggccctgtgaacgcagggagtttgctcccttcactgcttctactcttccttgaatccgcaactcgtcgcttggaagctctagatgagtctccattctgattcaaaggcatggagctcgccgctgacttgattttcatgatcctccgtgatctccgcagagctgtaccatttgcacaagtagcatccacctcgggatccttcgcatccatggttgttccccaagcaaccgaaggggaagaatccttgataggatcctcagcccccaaaccgacctcatatggggaagcaagaggtggcgatggcacggagttgagcgtacaatcgagcattctcccgtctaaattggcttccgaggaagcgacagacggcggtagtggagactccatcgccggggcggagtcggcgacggggtcaaacccccgcgcatcaaaatccaccggaggagacgacgatggcggcgggtcaggcgaacaatcaacgccggaatcgagcgcactcacctcaggaacgtcgcccaacgaagccgccgccgcccccgccggatacgaatcgatcggcgccgcgggctcgaactccgcgaaccccgcggcggccgtggggggaacgagcgcggtggccgcgccctcgccggcgacgaccccggaggacctccagggcgcgccgtcccatgggccccccgcgacgtccatgatctcgggctccacctccgccgcggcgaactcggcccccacgccgaaccccctcggcggggaccacatgggctccagctcctccggggagccgaacagggccgtccacagcgaatccagcccggcgctgaacccccccgcgtcctccgccccgtcgtcgcctcccggcgagccctcgtcggcggcgggcggcggaggcgagacggggtcggggggcggggtctccatgggaggaggagcaaagcacgggggcaattcctccccaaccaccaccaccaccagcgaaaggtagttggaagtcaatcggcgtgtccagtggcattcacttgctgacttcgcgttccacacgggagggagggagtcgcagttgccacgagtcgggggggctttgcccgaaagagaattgtggtttttcttttttcttttttcgattcgaggaggagagcggcggatttgagaaactgaagcttccatttctgacaaattcatgtttgttttagggccaattttttttttcagcttgatccccgggaggggaaatctttggggaaaaaatttgaaattatactgtttatcgattgaccggatagcgaaggatttgcggaaataaaccatcggtggaagagcgataccgatgttcgctcctgaaaagtgcaatagcgtggcgaaatcgctatctgaaaaagcgatagcgaagttgagctggcgctctcgcgccaacgagacgcgagaccatagcggtatcgcttttccctcacgtgacagcgccacgtggagaaatccccgcgactacgttgggcggagccatcgctctcgcactttcgttgcgcgagaccgaggtcggtatcgtaatatgaaatcgcgagaccgattatgacgcgacgggagagacgtgggcacgcggtatcgcgctttgcgtgcgcgagactggtgacgcggcatgcgcgagagagagaaagcctgggggagggcagtgggaccgcggcgtcacgctttgggattgcgagaccgatcgcagtgtcgctatacgcgtgcgcgagagcgaggagcgcaatggggcagcgttgtcgcgctttgcacgcgcgagaccgtaggcggtctcgctctacgcgtgcgcgagagcgagggtatcgagagagcggcaatgggttcagtctcgcggtgtctcgcggtccgcatgcgcgagaccgtcctcggtatcgcgctccacatgtgcgagagcgacggcgctttccgcatccgacgccaccgacacctttatttcccatctctatttctttttgctttttgcacgggttctagccatctaccttagctttttagggaggggtggaagagctctgtgcactctcttatcagtttactgttgtagtcacatcatgccggccatttgtaaccgctgtagcgttcgaatccaatgcgctcacgggttaaattgagaggagaggagatggtcctcacagaggaagatagaagggactgaactaaggaggagaggaagagcaagagatgcaggcagtggagagaaggaaaaaaagacacgtaagttgattagttttctattagcacaaattcgtatgaggatttagaaaatattagttcacgtagttaatatttgtttttaattatgtcatagaaaaatttaggtatgtattagttactactacattatgggtgtgtttgaggagaaagagattggggagattgggaagatacgcaaaacaaggtgagtcattagcgcatgattaattgagtattaactattttaaatttcaaaaatggattaatatgattttttaaagcaacttccctatagaaaatatttgtaaaaaacgcaccgtttagtagtttgggaagcgtgcgcgcgaaaaacgaggtgctttctcatcctatcttacacaatcgaacgcaacctatattttgttaggttgcatataaaaatagaaatgtagaagttgatagagtcgattcgggttaaaaaataggtagacataattaatttataaggtacaaaagtataatataagttacaattaatttgtacctagtagtaattataagttataattaattagtagttcatgtgatgtttaattttatatatacggccaatattatatgtaacaaatgaaaaaaaaactgaaatattaatagttatatttgtagttattgatattgatattaatagtattgataattattaaatatggtacaaaaattaaattaaagttgtaattaattcgtagtaattttaagttacaattacttagtagttcatgcagttatttatttcgtaagaaatggaaaaggtataaatattcgttaagtagcgggaaatatatggtgtgcttaaacatatgcttatatagcatattgtaggtagttacgaacgaacaaagaaatgcgcggtactacgaagaactttgaaattggaacttttatatgagcaaattggttgaaaagaagaaggcaagacaaggtatggtactataatggaagatgtagtaaattttttaatagacagtttgtattttatttggtattgtaattaaagtccagttatataaatttatgtcgctgcaactagttttatactataataaattggtagttatgattaatttgattgattatgtaattaatcaagtgaagttgaacttagttctattaatttatcatgttatgattaatttatagataattttgtactaactgatagttacaaatattttgtatttaagtaaagttacggtccgttagataatttatagttaaagttgtaatatattaaaagtactaatccaaaattgcaatagtagtattgtttcagaggtcatatctaagtaggtacaaacaatccgtagcaaagaatatgatgcggctcaatgagtgtcattgtcctagataaagaatagaaagagctaaccaaaatgatttttaacttagcttccgtcaatgtttcttcggtgcacgtagtcatttgttgtattaaaattaattgatatgtataattaatttgttagttaaacatatggattatgcagtgaaataaactttgaggcagcaattgttatacgagcaagctggttaaaaaggagtaggcgggttctgataaacgcaggtaaatattttgtcatcatatttatgtacgatatgctatggttgtgttgttttaagtattacatactcttttacttaaattaattgccatagttatgtttaattacgtgttttaatcaattaatttgtattaaatttattgtcatgtgtctattttttatgtcaaagttgtagtaaaattataaataatgaattgcattgtcatgtattcgtaagtaaataatttatgtttacgtaattatttatttataattttcttattacaagtacatgaattttttataaataattagttattgataaagatttttttatcaaaaaaagtatgcgtgtaaactaattttagttgtgaataggacacgtttgttctgtaaatcttccttacggagtagtctgtgttgtctgcaatggcaggaatgtcggcatttagagtgtatttcggtgaaggtgaaattatggaaaatgaaagtgttaacgtgatctgagcaactttaggcaatgcacactataccatccaaatcctgacacccttaccatgcccgaagtttggtactggttaacatgcacattttctttagatctgggtatatatagtattaacgtgagggttatgtggagccgatcggccaacaaaataggcctggcaggattggctcgctggctataggagacggggatatgaatatgtcatgctggtgcaagcatgtcaaggaagagtccccacggagaacgcagcggggcaatccagcaaccgtgaggagttggggtctagttcacacgaagaagatgaagttgtagctccccatcgtggtggcgatgttggtcttgacattcaaaatctatccatacaaggagatgaagtggtcaaccgccatcctattggtgaaaccgatgaaggggaggacatacctgctatagctgaagaaattgagagggtggaccgacatgcagtcgaagatgaggaaaacctcgctgctgaagagaatgatgacgaagatgaacaagaagttgaggaactacctatgcctgcttcgtggaaccttgaagaccctggttatattgcagaaaactcttgtcatgattcaatatggttctacggggatggccaaatcaatctaggtgcaatgttccgtgacaaaactgggttgcaagacgcagtgaagtcatggtcattccagatgcaaaggcagttcagggttgtgaagtctaacaggactgagtacacgatcgtctgtgagacggaaggttgcaccttccgtcttcatagtcacgtgccaaagtacgagtgttattggattgtgtccaaactgcaggaacactcctgtctgattcggaacactagggagtcgcaccgcaacctgaccgcggcatacgtcgcgaacaagtactacgaggaaattattgaaggtgatgacactgcctgtgcggcacataataaaactggtggagaaaggtgaacaatacacaattagttaccacaaggcttggagggcgaagcagaaagccatggagaaaatatatgggacatttgaggaagcatatgacacactgccacatatgcttaacattctaaagagaaggaaccctgggacctatgttgcggtgcaggatcgggagtcaatttatcctccaaattatcttgtgatgcaacgggcattctttgcattcggagcatgcattcatgcgttccagtgctcgaggccggtgctgtgtgtcgacagtactttcctaactgggaagtaccgaggccagatattaacagccgttggtgcagatgcgaacaaccagataattccagtagcttttgcttttgttgaaagcgagaactacgaaagctggttgtggttcttgcaacatttaaagtggggagtggtgcaaaaacgcacatcgatatgcatcatccatgacgggaatgccggtctgttgaaggcaatcaaagagctccaggaggatggtgatggtgcatactactggcctgacatgcacagccgttggtgcatgcagcacatgggagacaattttttcaaacaattcaacagcccgcggctgatgaacatgttcaagcggttgtacaaggaaaatcagtctacaaagttcgatgagctttggaaacaacttgacgaggggacaaggacacatattcggtcaaagcagaccaataacaacccgcaggatgtacgtcccccaggccctggaaccaatggatgatcttattccatcaaatggaagaagcgtaggtcatcaaagaatatcaaatgttttacccattggattgagtgcgagccgaatgataagtgggcactcctgcatgacactaatgggctaggcatggcataatgaccactaatcttgcagaggcgtacaatgcgattcttcgcaaattaaggcctttacctctaactgctattgttgaaggcattatgtataggacaacgatgtggatgaggacgaggcgggccgtgacattgcaacaaatgtctaacgcacaaacacctttctgcaaaaagatggcagagtacctccaagagaaggctaacaaggcaagatttcacacggtcattaccactgggaacatcagacaaaggtgggaagtcacatgtcgcactaagggggggtttggatcttctactggggtcatcactcatgaagttactctagggcatgaatctgataacacatgttcgtgctcttgcaataagccgaagcttcttcataagccatgtagccatatcctggccgcgtgcgctaaaattaagtttgattcaacatcatacgtgtcgacattctacctaaaggatagagttctgaatgcatgaagtgctaagatcctcgggtggaggtccctccaacacctagtcgaaactgggggtgataaaaggatctatgtgccagatttggatttgttgaaggctggtaagggtagaagacaaacacgacgcttaagaaatgatatggatgcatccgaagcgggagggcctgtgaggcgatgtgaggactgtcttcaatacaggcaccgcactagagattgcaagaataacaaggagtgtacatcttcaagcatggaacctaggcaacaacgtgcgaggaggaatagaaggggctctcagggtgctcacgatagggaggaaggaaacctgcagtagttataacctacactgtccggttatttatgttcggtcatgatatgtttgctgcatgacgttgtatttcaataagtttgtaatatgttagtcaataagtatgtgtaatatttattttattatggtaatattgtaagattttattgtaaggtgttaccaagtttgtaacgtttgtaaacctattgttgtactatttatttcgtaaggtgtgctcgaatttgtacttgtactatgagaaaaatttattccttaatttaatgcattatgtactttttcgtatgtgcacttgatgaaatttctaatttacccttcatgatgtacatgcagatatggaagaggagtggccttacccgttgcttagcaaagagatcaatgcacgacatcgtgcaaataagatatctgatgaaaattcttgctctagtctagctgtcctgataccgcgtacagccggatggtggggtattgatccacgatggaagccgaggtgcataaatggttaaagtttgcaacatcatgatatcgtactataacattgcctaatgtgactaataaatttcctcataggttgtcagctacaggtcttcttacctttgttcagatgacgtaggcaaggaagcattacgatgctagagaacctaaacaaaaacaaatgggggcacaaagcaaacgacgacaaaatatcgacaagtccctacttatggcactggttgataggtggaggctagagacacatacattccatctaccgtgtggagaaatgaccataactttgcaggatgtgtccatgctcacggggctgcccctagccggccaggcaattgtacttccggaccctcagaagattggagagatgatattgtatcacgatatgcatgtattttgccacagtacgctaccggtgatacagacgatgatgaggacaaaatatttttctctgaaaaagaaactcatggccccacattgacgtggttgtcacagtttgaggtaattgaatatttttaattaaggcatattccgttcacattcacatatctcacaacacattgtttttttgttagctgagatatatgcccgacgatgtccaggagtaccaactgacgttgtaccttgaggcttatctactttggctgtttggttaggtcatgttcaccggctcgcacgggaacactgtggacgctagactaatcctccttgctcgccaaattgctgaaggtaatatagcgccttctgcacagtttagctggggatcagccgtccttgcagccacgtaccgtggattctgcaatgcttgtattaagaccggacaaagggaggcgattttcacggggtgtccacttttggtcatgttgtagtcgtacgagcacttctcgttcggacgttcatacatgagcatggccgtggcccaccaggacgattacaagggaagatattatagcatttcacccggaaatattccaaggtattgtatttatttaattccaagggaagatatgataagagagtactatgataataatttacatcacttgtatagatcaaagtctatacaggggttaagcaatatttatcggtagagatatgttgacacacagaagaagtaaccatatttttctcattaaaaataaagtctaagctaagtggagaaagaaaaagaaaagaatcatttctgtacttatagtatatagccattttaatatacacttgttagtatacaacaatgtagccaatacgccctaattatgccctcctggtgttttgagagaccacccctgattgtcgagtttcttacggcaatatgtcatggccatccaaccggtaatgaatacggaagaatacccacaccaggaatttgtcttagtactatatacccacgtggaggaataccctgccaccatcagcggcccacctctactgccccgtggcatataataccaattaatgatatctaataatctaagcaccacgcatacattactaaatactactccatatcgctgcagctgacatagagcaatcatcgaaagcaacattaaacccacaccaatgcatatctctaataagctagccaaatcattatatcgagacaagtaaaatataaagtcggtactcagatataaatgaagtaaatgaccgaagctatgtaaaaaagaatctttcattgataatggtatacgtcttacaaaagaaggaatagctactagagccatatccgaaatctcctgaagactcgaagaactaaggaaactattctattcctactctactagcactagaacaaataactaaacttgagagagctctttattcttcttcttgagtgtgtgttagagtggagtgaggcctcctccttaaataggttgccaatgacggttgtggcggttggaattgtctaaaatgcctcgcaaccgtcattggggagcaatcctggatgttcacgttgaaggccgagatgaagggcctcagctagggttcggcgaacctgggccgacccctctggcctccaattttggccgaggacttccttgttgggccttattctttgtggcatggtagttgggcttatttgcagatgttaaataagttttgtaagcccaaacatccataagtctgccactcggtggtcgtcgattgattgtttgattattttcgactgattctcatccgtatatgtagaaatctccgtgttcaaataaaattccaagtacaagtggaaatagattatttctaacaaaatatgcattgcaggtatagctagttctcctttattccgattatattgacggtcgaaattggtctataacgactgtcaatagattgcccccacaagcatgcctggttgaaaggttatagtagtaaagtatttagttaccaaggattagtttgtcctcccaaaactatgaattactttgttcttctgtgcatgatccaacgatctcacgatggtggaagggcaaccacactgggacacgtggatgtccaaatcgtctctagcacgagatcaaacatacgatagcggcgagaaccagtgcataattaacacgaagtgcgggggcttttttgcaaaaataactgatgacatggcacacgtaattctccagcaatcccacggaatttagagaagttaatatttgggatttgtctattcagagtattttaatttcaaatgaatgcttggcatccttgtagcgaagtgtaatcaatatatgttgtcatttctcagatattcttgagatgtatgtgttatatttcttgcactttatcattggaaaaaatgttattatctatgacgatgtctcaaggtggtggtaataattcagtgcatatggaaattagaactatatatggaaaataagcatatgaacatgaaaatatcgattatttttaatgcaaaactatacttatagaatatgcctctacatattatcttatcttatcttatatagtgaaagcagcaagcgttcttgcacgagaacacatgagaatacagcacatcatcaaaaacatatcaaccgttgaataaagagtttagataaataatggccattggatcacaaggttacatatgcattaaaaaacagcaatgggataaacgtatgggaatttctagaggtttctagtgccttctcttagacacatggtacaaagaaagcgggtgcaaagataatgaaggaaaaaaaacaaagaaggttctagtgatttatcatatagtacgactagctaaaccaacagatactttgtaaataaaataactcatcaaaaacctccagtaaactaatagatcctatacaacaaataattcttatacggaatcaaaagtcgcgcaacgcgcgactacgtggcttgttagtttgaatgtaccaataaagtatctctacagatacattagtttgaatgcaccaataatgtgtctctacatctgtagagacatgttaccagttcactgtaaaatgactccacctacagaaagtgccgctacatttgttttgacaaatgcagcgtctctatggcagccacatatctcatagaggcattttatagtgtcactatttgttataaaagttagtcgatatagtggaacgacgactaaccttcccgatcgcttcagtcattgatcatccaagacatgtcagatgacgacacaggaacacacgatatttgttaacgaggtttagccgaagcctacacccccggggctctgattatgggcgctcctcccgaaccaatatagctcctagccgctacaagtccatgcccacgccaccaccatctccctacgtgtctacgctacattgtagtcgccatggttacattgtggtgccccctctctacttaagagagatgccgggttacagagtccgactctaactccaccccgtaacacctattacaactccaagtccaactgtaaccaaataagactagtatattcgacacctattctaacaaacttcaccttggcgaatatatgccacctagaagttgtagaatcaccataccgatccaccggtcctccagacttgggttgtcttctttgcagcttcatcacaagccgcccgacgagtctgcaccaaacccgcgcctttaagagattctgctatccctgtaatttcttcctcttgactccacctgcaacagtgctccaccttctctcatatcaccacagtcgtcttgccaagcgaaattgaattcctttctagctgtcacatcatagacttcccgaaaaccatgttccactccatctaccatcttaaatttgacttgatctaatccatggctagataactgatgccatcaccaaatagataaatcaaactcaccagacatgaagaactgaaccctttcgtccttgtcgccctatgaaccgagctaataaatctaacatcctcgctttcccgcatccgcagactaaacccatgatactttgagaaaattcaccgttgccttgaatcacttgaagaattaccacgatagtgctcactcttcctcttcagtgacgtagattttcatatatccccatcatgtcgacccgcatatcctgaaccgccaaacagtatcgttgaccccatcaacgatatttgacccgctgttgtccggatcttttcttcagtcttggcttaactccatgtatctttaactcctcgccaagtcccagatatatcctgttttcgccagataattccatatgcaacctgactagcctgttgccgccagtctactcactctttacacttgcaaactatccatccgtagaaccttcttgtccttcttatgaatctgttaacaagttccagcaacgaaccacacgtccgttgaacccggtttaaccgtccaagctccatagtctaaccagtctgttggtctgaccaccctgccggcccaatttaaccgtcatacatgcacacctcacgcaccttctcctaagccatactcacacactgcaccaccttgatcacaacaaaaccgcaccatgcatgcctcactgtgcccagccacctgccgatgcaccgctgcgccaaattgactgcatggctcgcaactccactgcacaacatcctctcgtgcaccaccacgctgagtatacagcgtatctactggtgttggtttttcacgtgaccttggtctagtagtgtcattctcatgcatttaatggtccaccgtgtcacaatagcccatgcacttaattacactactaattacctcttgcatgcaacaagtaagctcagtaccaatccaaagtcagattgccacagaacctagccgagcctcctaagagattgattcagtttcgagcttgcactatcgaatccagattagactcctccatgcagtccaatcagaactatacgtgtcctgatccaagtcacgactccatcttcgacacgacgacacccctgcaatctccgtttgcgatcgttctctttgctcgctagttctgctcatggcttcctgctcagtcaccgcgccctcgtgtactgttagagtatatggtagttaggatcatattaggatatgattgatttgtgtggactccttccatatatgtaatccttccttatctcctcccccatgtactcctatatatatcgcccccctgaggctcaatacaattgtgatccacgttacacagtatctctctcatactatctaacatggtatcagagcgggcgatctagcgccgctcccacgcttccgccgccgccgcccccgggagtagcgatctcccaggggcggccacccgtttttttttctcttttcgtcgtcgccgttgtcctggagagatcaatctctgggcgttctgctcgtcgtcagatcgatctgaggccaatcttcagatcggtcatgcatcttcttctcgtcgtcgttcatcgtcacgtcaacatgaagcagctagcagaccaccatgccagcctcgccaggggaacccgttgccagtgccacgccggaagtcggcgctcctccggctcaccctccccctccatcgtcgtcagccggcccctgccttggcggcggcgatctggaggagtccgccgccctgacgacctccctgtcagccttccgcgaccaccgcccgtccgccggctcctccgcctaggctgccaccgcttgtcgtcgtctctccggctggggaccaccgccgcccggggggatctgtctctgccactgccagggggacagccgcctcttctcgacgcgtcaggccgccagccaccgatgctccgccgttgccgtcggggctacggggccgccgcctggccggcggtcggcgtcgccttcccggctcccgatctgaccgccgccgccggggggatggagctcgacccctccggccagccggccctgaggccccctgttggcgccggccagcctccgccgcacgacctcctcccgccgaggccatcggcttgtcggcgacccggacaacgcggcgtcctaccgctcctcggctcctgtcccctttgtctctctcgttgtggtaatgggagatgggagatgattggttggctggttgacttgcccgtgtggactgtggtgcattaatggacttggcccatgtgctgctagttgggctatctattaattgcaactgcattgctgctgctgcttgtatccgtgtatatctttcttttatcccgatcagtgaacgggtttgcgtcgcccgccgcctcgtcgacatcggcacgtctccgacattggcatcgactctgcttcgacttcatcgttccgcctcgcgcatcttcggcttgatcacccgttcaagcgtccggctacaacaacttctacaaccgatcatcatcgagcatgcatctacaccatcaagcttcgggctgccgctgcgtcgccctctcgggctgcagtgttgccgctcatggtccatctccactagttgttggaacgctgcaaggcgccctcctcagcgtggcctcaccaccggtgaacttctcgccgctgcatcgacatggagctgtagctgtgttgtgctctcgaaccgcagcttcgccgctttcatcgtcttcatcgccgttcgcgcatcgacaacctcgtcatccgcactggtcatcgtcagccgcttagggtcttcttcctctacttcgagcatcgccgccgcgtctccaagctgccactgtcgccgctctaggccggtgatccagctacctctacatggctaccgacgtcgccatctaggccgttggtcccgctacatcgccttatacttcatccaacatgattcatcgccagcgttgccgtatcttcctcgactacacttcgctcttctccgacaatcgtgtgctgctccggcaattctccctctacgccgttctcgcgccgcgaccgtcttggaggccttctctactagtctccttcgacattggcgtatgattcatggtggtcccctacctagcccgcgcggtattggcaacaccgttgcacgtgttcgtcccgagttgtccccgtgtctggcaaacccggcgtgacgtctcgtctttcacggttcgactacatcggctcttcggcgtcatctacctcaacgactgccgcgatcgtgtcaccgttatcgtcttccgtgtgtccttgcgcaccttcgtccacgacgccttcccgtgcgtccacgatcactctacgacgcctcatgcgctccctgcggctcggctacctcgacatcagcttcctaacttcggctacatcgaccacggctactctacgcacggcttcatcgatcacggctccctcgcatccatcgctttggctacgttgattatggcacaaagggctatcatccgtgttgagcactcttgccggtttcttctccagtccaagtgtccgcgctgctcacgcttgaactgcggggggatgttagagtatatggtaggtaggatcatattaggatatgattgatttgtgtggactccttccatatatgtaatccttccttatctcctcccccatgtactcctatatatatcggccccctgaggctcaacacaattgtgatccacgttacgcagtatctctctcatactatctaacatgtacgtgtatagcacatattctacatgcgctgtccgtgccttcgcacgcaccgcagtcgcagccctcgtgttcaccgttcacgaccccgtcgtcatcggccctacacgtccgccgcgccacaccacgctcgccggcttcgcccttccgtcactggcctccctgccgctgcggatccgcgatcgccgcgtgcgtcgggcacgccgtccattgcgttacccctccgatctctccggttgccttcagtcacggccggccccgtcttctagtcacgttccgccatcgccggtctaatcgcgagcgaggtcgtcgcctccgcaacgtcctcgttgtcgccatcgatctcatcgccacgactgacgatctcctgtagatgtgcgatccccacctcgtgtttcctcctccacatgtcttcttgatccaatgttgaaaccttcagctctgataccacttgttataaaagttagtcaatatagcggaataacgactaatcttcccgatcgcttcagtcattgatcatccaagacatgtcaaatgacgacacagtaacacacaatatttgttaacgaggttcagccgaagcctacatccccggggctctgattatggacgctccttcctaaccaatataactaatagctagctgctatgagtctatggccacgccgccaccatctccctgcgtgtctacgctacattgtagtcgccatggtgacattgtggttccccctctctacttaagagagatgttggattacagagtccgactctaactcaaccccctaacacatattataactccaagtccaactgtagctaaataggactagtatattcgacacctattctaacactattatctttaaggcagttcacagcaaggcacttacgggacgttttatatactgtctctacaactaactagcggcataacaaaagtgtctctactgtgcaaagaaaaaatctctacgaaccaattctgttgtagtggggattgttagcatgatcgaagctggaactaggatggccccgactcgacaatacaacaaaccatctctaataagatgtttggattaagccgttttattattcgtctctattttcagaatcacgattagaattaagacgtagtttgggacactttgaaattgaagcatgttgagacgttttggaacaaactgagacgtcttatggatgtttcatttctatggaagaatataatatatttttagttagaattaagacgtagtttgagacgctttgaaattgaatcgtgttgaagcttatgttgagacgtcttatggatgtctcatttctatggaagaatataatatattctttaaaaaataaaagcaacgtagtataaaaggaggaattataagatattttatagatggggtaaaagagaaaaaataacaatgcaaaaaaaacaggactcgagctctcaacctaacgcacacaacattaccagcttaaccaagtgatctagaagaggaacttgttggaaagttaagttactcaatatactgcaggtgtgtcgatttttttttgtttcctcctttttagagcaggggtctccgatcagatccgattaagagggaaccgtaggtccttttggtggcgggcaataccgcgacggcgacggaggccctgcccctcagccgccgtgcgccaacgcgcgtccgctgccattggcggcgtctccttgtctgtcgtccgcgacctctgatacttggcagttggcagcctctgcacttacgcatctggccatcgccgccggtggattcagcgtctccggccccccgcatctctactttggctcgaccctctcgtcgcgagacaccaacgcccctgccactgtgccagtctcaggccacagcacaaggcaaggattacttgtgaatgcctcaactattttctattattttatttttcgcgaacaccatcttttccattattttaattagatgataaattgttcactgttagggttagtgttagagtctttcttcgattaattatctgaagaataatctaagaaattggtttgagaaggcaccatatcggacgtcaattttcttgggaacatgccttggaggatttggctagttttccttatttctgaaggcacgttctcgtgcaagaaaacctgctgctttcactatataagatccctgcaggcaaacaacactaattcttaaaaaaaaattattaggtgaaattcagtagtttacacgtaatgttctagattaatatcatgtgtgttagtactgactgtaattcagatctgacaaacaagcgaatctcaatcatccaaatagagtaattttttaaacgaacatcacaaaaaagtgcgatgtttcaaatcgatatagcaggaaaaaattacaagactgcagtcttgaaaggctacaatcagggaaaataacagaaccactatcaaacaccagcaatacctgcacaaaccaaagacctagcaccgcatcgaccgccgctaagcaggatctgatgccgccaagcctagacatgaagccaccactgaaccgcccaccaatgcctccaactagctaaaacatgaggtcatctggaccaagcggaaaggtttgctgagagagaggaagagagataagaaggatccacttgtcccttaaacagacctgccaccgactaaaagcgtaattgaaattgtaaagttctggtatattgtaagcatgcccaatgggccaatgtgtacttcacaaatcaaaagaagattcagagcttgcctactcgatcagctcctcggctccgatagtccggactctagcttggcaaagcaggcaccgaggcatgccgcacgcagcgacctggtcgcttctatctacttggcacctccccaccggcctcctgctagtccccacccatgcgcctcctgaccgcttgtaggctccatgcaacaccactacgttgccctaggggtgataatgggatagggagcctgggccctttcataactaatctcagcccttaaaatagttttagctaaaatatctattaaatcttagaccaattgttttgggcctagccctcacattttgtaggctaaaatattggggcttattaccacccgtatgttgaccacgccgacattgctagttggagccacacttccgccggccactgccaagtctccctcgcccctcacttcgttgatgattcgtcaggcaggcaaccactttgcctcaccctcgacctcaactcctcaagctgactgatttgttgggagaaaagaaacaaaatgtgaacaagagagaggcgcttttgcaaaattactgagatggatgagtgacgtggaaaatattcctatgtggagccctttggatcaaagatgcaccgatcttgccattgaaccaatatatttaatttttaagttgttgcatcggaatgcgctcacagattaagttgttgtaccataagtgtaatttactctttaaaatatatgttatagcatgtccaaagaaaagaacctcctggggcctgggccaattactctggtggtgatgagaatataaaattcacatgagccaaaattctagcatagagaaagggccatagagcctatagaaagctcaaaaccattaccactatttatatctggttaagtagcaatgcaacaatgtttagcaccagtacatccatgcccagcatagaaatctacacttgactcaagattttgagcttgtttatttcgtggtcaaattctacgtaattttagcacattttgatattaccaatttttggaagcattgaattgtttggtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26332 - DNA, 717 bp, Oryza sativa
gaccggccgcctcgtccgccgccgactggtgcttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctgcgtcttcaccgaccggcttgccttcgccgccgccgactggtgtttccgcctgcacggctggcctttatgccgacgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgttttcaccgaccggcttgccttcgccgccgacgactggtgtttccgcctgcacggctggcctctatgccaccgttgttgggcgtctacgtcttcaccgaccgg

SEQ ID NO: 26333 - DNA, 675 bp, Oryza sativa
gacttcaccgccggcccgcctccgtcgccgccgagtggtgcctccgcctgcacggctggcctattatgccgccgctgttaggcgtctacgacttcaccgccggcctgcctcgtccgccgccgactggtgcctccgcctacacggctggcctattatgccgccgctgttgggcgtctacgacttcaccgaccggccgcctcgtccgccgccgactggtgtcctcgccggcacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttaggcgtctacgacttcaccgccggcctgcctccgtcgccgccgattggtgcctccgcctaca

SEQ ID NO: 26334 - DNA, 634 bp, Oryza sativa
cacggctggcctttatcaagacgatgttgggcgtctacgtattcaccgaccggacgcattgtcctcagccgaatggtgcttccgcctgcacggctggcctttatgccgccgttgttgggcgtatacgtcttcaccgactggcttgccttcgccgctgccgactggtgtttccgcctgcacggctggcctttatgccgccattgttgggcgtctacgtcttcatcgaccggcttgccttcgccgccaccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcctgccttcgaccgccgccgactggtgtttccgcctgcacggctggcctattatgccgccgttgttgggcgtctacgtcttcaccgaccggccgccgcatccgccgctgactggtgtcaccgcctgcacggctggcctgttatgccgccgttgttgggcgtctacgtcttcaccgaccggcttgccttcgccgccgccgactggtgtttccgcctgcacggctggc

SEQ ID NO: 26335 - DNA, 434 bp, Oryza sativa
ccgtataggcggggacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcgcggcgacggaggcaggccggcggtgaagtcgtagacgcctaacagcggcggcataatagccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcata

SEQ ID NO: 26336 - DNA, 591 bp, Oryza sativa
  unsure (1)..(591): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagttattgctactgcactattcctccgttaaatgcgcctaacttgttgtttcttgttcagtccgccgccacctccaccccaccatgggcttcctccgcactcgcccagccccgctatttctccacaagagctaccagggtaaaattactgctctaattgccttgcctatctgctacctctgtccccaaatccaaatatgagggagtttggctctgcattcgcattgccaaaatcccttgtatttcttttcggggacggatgaaatcgattctgcatttgcatccacgattcctaactggatgaaagaggagtgacctggagaagctacctgtgatgctggaagttttaccccctcgttgagattgagaaggatttattgttttgtgctgacaagcaacattttgaagcttttttggggccaaaaggtaataataagg

SEQ ID NO: 26337 - DNA, 415 bp, Oryza sativa
tcaagcggaagggcctccttggattccctgaagtttaaggggccggcggccaaactcatccccgtgtgtgccccggcaaatatgacgaacaggtccccctggacatgtgcgcggtcaccctgagttggtcacccctgtcaaaacatagtaactttgtcaaaacctaacctaaacaaacatgtttttttcacaaaatttttcatttcaagcatcgctaactcagttatagctgtctaacaaagcaaattagctttcgctgagctttgtgttgcttttggtctctaataggtttgtgaagcatgaagctcacggtagcaattgtctgtgccatggcgaccgcgcttcttgccgccgccccgttgtcggcggaggccggcgacggccaacttaaagtggggtaattcgaccaccaaat

SEQ ID NO: 26338 - DNA, 25245 bp, Oryza sativa
ctagtagaggtggagctgaaattgtgccaaatagacccttagtatatccatctctaagttctaataccatttattataaaaatagatgcacgactaatatatgacttttatgtgaaaaactcttaccggaaaagcctacatgcatagatcggcaatgattaatatagaggagttgggtacaaacgtatagaatacattgggttgtcgcatacttcttgtgaggtttacaagagatatataaagaaaaattctaagagtcttagtagaagaagatttagagacatattagaaaattaaccctgatagtcaagttttatatattagaaaactaatccaaatatgtttcatgccaaaatttgtagtagaagtatcatatatgtaacatatttaactatacctgcggtatagcactatagaacgtgtctttgccaggacacttcgattacttggtaatttgccaaaacattccatgatcattatttcaacattttactcatttgggcagataaaattttaaaaaggtgcttttacgccctttcgcaaattgaaaattttggaatttcagcgcctcacttcctaaaaggacatctttaattagaaaaaaaaaattaaatctgaaaaaaatcaaaatatatttttaactttttaagtattttagttttccatggaccccgtaaacattttctttatttttgcaatttggatgttttttaatttaaaaaatgtttaagtttaccaaaaaattattcaaatttcaattctttgtccgatattttttagaaaaattctatcaatcacctccaaaatgtttggagattttctgcaatttagtaaaagataaaaccaggctgaacatccaacttggcatgaggtaatttaaaacgtcatctctgtaattgtatctatctagtagttgagctgaaaaatgttaaaatattaaaattatggtcattttagaaaactaccatgaaagtgtctcgtagaaaatacattattgtataaaaataacaaatacatacatatctaataatatttcgtcgagcatgttatgccttttcgtacgaaatagtatatgtgccatggaaaaacacgtgagcatttgagtacttcagactttcactcgaagagaaaatgtatcaaatgttaattaattgtatatgtacgtacatcctaatttaaaaaagtacatgtcctatattgtatattcaaggtttcattttataagaagcaaaggctctaagaatctcccacgaataaaaaagaaggcgctaagaatcaaatttggacggccatatagttaattaattagcttgcagtttgccacaaccagtatatataagaatttaggtgttgtacatacgtaccttgatgatgtagatttgcaccgaactgaaaatgacgttagtacgcatgcattttctcctagagtgtaccggctgggcggctggcatttatatatactatgtaaaactccgcgtgttgctactgagttagcataataacaagtgaaaacaatgtgtaagatagctagctagacaatacaagcttacataaattgatgcatgtgatttatgataaattaaaattaaatagtgtatagaatgatgatttaaatgataaattaaatttaaatagtgtatagaatgatgatttaaatgtaaaagtaaaggtgatatggctttatgagagaagaaaaggagagagatattttggaccatagattatctaagactaaaaataattgatgtgatatggcttaatgagagaagagagaaataacattaactaagtgagaatgaactatatatagaatattataaaaaaggatgaagagataaattgaaataatatttgaattatgtgggatgatgatttaacatgcttacattttaaaaactctaaaattcaataaatcataaaattacaaataatatagcatgcttcataatgtttaaatgtaataattattattgaatgatgatgtagcatattgttagaggatgatgatgttgcatctttttatttcaactactcccacattcctttatatatattgtaaaattaactggggcactatggtgtccaggcaccaagatttaaattgagtacatatattcaatttaaatgagtatgaatttttttaaaaaaatgtttagatatgatggttgtaaggtggttttcagtcggttcatctgtaaccgtgatcaccatctaatagggcgctgccatgtgcaaagggaaagctgggggacggtaagtctggttcggctcccaccgcctctagccatcgacttcatccagtgaatgacaggtaggcctctatggtgactgaggttggtttggccctactttagatcggtttcaactgtcatgtgagccctccaatctttttactcacgtatgattgaccggaggttcattttatggcatgacatatgtatttttattcataaatgacctgcataaatatatttatcaaaactagtgaaaatggttagcaataaactcctaccatcaagttttgatataatattttatattctttatacaggagttgacggttaaagtttacacttaatgaccgtcaacaataagcgataccgtggcagtttcgcgtagccgcgtgctaacctcggtataccggtattgcactcctaccccgcgataccgatggaatatttcttccaaacaaatttcaaccggtatatttctttcaaaaaaaatcaatatcagtattcatgcaatttttgttcaaagcactactttcgctacagtacaatctctaaggaacagcccctacatcaagtgccactgtactattgtcgtatactatttctttcttttccaccgttgacgttttagaacggagggagtatgtatatatcgtctgtacattagatttgctattttggtactttcagtgtcctttttctgagtactagctgaataattttgtgttcgctattggagggtacactaagttgaaaaaagaatttaaaatagttttgtaagatgatttaaaatataagtatttatatgattattaacaaaactaaggcagagtgaaaaaaatatcttttagtggttaaattttaaattgtttatatatccctttcaagcatcggatgaaaatgtacagaacgatttttgtgcactggactgagtgtcccataaatacttatattgtggcataaatttttgaatactcaaaatattttgaaacaaaagaagtatatggaaagtgtgtaccattaatccaatctttcatatgactgtcaacgccgtaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagcatgaagctcacggtagcaattgtctgtgccatggcgaccgcgcttctcgccgccgccccgtcgtcggcggaggccggcgacggcgagctgaaggtgggctactacgacaacaaatgcagcggcatcgaggacatcgtcaggtcgcacgtcatcaaggctatctgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaagaaatccgagtggtttacactctaaaaagttcacgaatgaacacacttgacaggcatccgaatataaaaactctaaagattacccatcaagtattataaagattatggtaataaataagtcaaatagcctaggccatgactatttaccatgaaaacaggcatataatacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacagctccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgccatccgacgtgacggaggaaaatcttaaggagatggtggcgcacggcgttctccctgccaaggagatcatcgggtggcggccagcgcacggtgaggttttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcatccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactagcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgctgagttgactaactatggaagcatcttgttcaggaatatgcattgatgaagtcagatccaccagtcactcagcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgcaccatgcccaggaaaaaactggctggccgtgcgatgccaaagatcagaacatcttccaggtattagatctctcggtatgatttccgcttcggcatgttttccaatgaagataatgctaaatactgaaagaacactctgcaggaaaccatctgatatagatccatctggaaaggaccccgatcctgccatgacagagcaaaatatacccaaggaccccgagccgactgctgaaaaccagccgaccgctgaaagccagccaactggcgcccatgcttcgggcgatagggccgatccgagtgacctgccgccgactagaaatcagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaacgtcttggaaatacatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgacccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcatccagatctgtttcatcggtttaaactggcataacggtatcctcaaccatctgaatttcaaacagcgcaagctgccaggatggaacagatggtgaagcaaattgaagccctggagagagacaagacagaactagctgcgcaaagggactcagccttgaaggaagtcgaaggtaacgccagctaacaatctgagcttctctccttataatgcaacagatgctcatcataaatgtgttttgcagaacgcaagatcaaatctcaagctcagtttgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgataccattgatggatttgcagacgggacaagtgaagaggctgcccttgatcttatcagcaatgctcagagtgcggctgacaagattgcaagtgatgttgtagaacaattccgcaacaatgatcttcagccgagcgatgataactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccgagtaagcaaactgaattgataaaaaatcacactccattattatgatgatagcccccgactgacaacttcaaggagaaaacttgatgtttgacagtcaaaatagggaaatacaatgataaagttaagcgtagaagcgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccattagctcgctccacctgtccattgctcattgggtgtgctactgaggcatagcaaatcttgattccaaaatcttcacaaaagtctttgaaaactccgccggtgaattgtgtgccattatcggtgatgatccgattgggtactccgaatctgtacacaatgttgatgaagaaatcgcgagcattatctgctgtaatcgtggcaacaggcttagcttcgatccacttggaaaatttgtcaatggccacaaagaggtgcgtgtaaccgccgactgcctttttaaacgggccgaccatgtcgagcccccaaaccgcaaacggccaagacagcgggatagtctgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtacgcgctgcagcatggtttccgcatatcccagaatgtatgtccttcaacaattgtctcccttcctctaaagatacgcagcgttgcagaattcctgaagggcttttcttgtataactcggcttcatgcataacataaagtttgctccgccttgaaatccgctcggcttcatctttatcttgagggagctcttgggaagttaaaaatcgtatgaggggctctcgccagtcagcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctatcggcagcttcattgttgtgtcgaagaacatggctgagctcaagcccgtcgaacttatcctccagtttgcgtacctcttgtcgatatgccatcatgttgtcgtcaatgcaggaccactctttcataacttggttgacaaccagctgtgaatcacctcggacaattagacgctttatccctagggaaattgcaatccgtagcccatgaaggagcgcctcgtactcggcgacgttgtgagacgccgaaaaatgtatccaaagcacataacttagtctttctccagttggggaaatcagaaccactccagctccagtgcctgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggttaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaagccttctgtgcttcgggtccccattggaaattatctgttttcttcagtagcttgaagaagggcatcccccgctcgccaagtcttgaaacgaatcggctgagcgccgccatgcatccagtcagcttctgaacgtctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacgtcatccacataggcttcaacgttgcggccgatctgcgttgagaagcatctttggatcatacgttgataagttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgagaagttcgcagccggcggttgagtcaactacctggtcaatgcgaggcaacccgaaaggatcttttgggaaagatttgttaaggtcagtgtaatcgacacacatgcgccattgccctgtctttttccgaaccaggactgggttagccagccagtcgggatgaaggacttctttgatgaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcggaaggatctaagggaatctttttagtctcggcttcggtttccccactttttgaaatcttggcagctggcacttctccttcgctcaccgtggttgcagccagtcggatttcctctcgggcagacgccatctcgcgggtttgggccatatcacaactctccttgtcacatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggtgtgtcgggctgaacagcattgatctcccgttcggtcagcttttgcttccttttagactcataagccatggggccgccgaaaatatgattgagctccttacggtggtcttgaaatccagccggggtgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttgcgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatgatagcctcgagctgctcggcgctgcgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccagtaatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgttgacgtcgatcctcagcctccttcgcggtccgctcacggtcctgctgctcacgccgtagccgttcttgttcttgcgcttgatgctcctcctccagtcggcgacgttcttcgttctccctggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcctgatctggtatcgttggagaagatgcgatctcggccgagtggtttgaagccgactcggttgaggtggtcttgaaatagctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagatggaacccattgcactgatcggcgaaaaagcttgacgctacccctacctggcgcgccaactgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacactatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgtttcgggttttaaatggatttatgagtgaattcatttatattacctctatttctcattataagtcattctattttttttcctagtcaaactttcaatttatagaaaaatatagtaactttttcagcacaaagaaaatattatattatcaaaatgtattaaatgttaatcttaatgatattaatttggtgttgtaaatgttgctaaaatttttcataaacttaatcaaacttaaaaaggtttgaaaaaaaattaaaatgagttataatactctctccatcatattccaaatctaaaaaatttacttttgataggcatatttcaatccaaccacctatttttttaatgactttcttggatttcatgggggtggctaattggcgcgcgcccgcctgttggccccggcccggaagcccatcaggcttctttttttcttttttttcgcaagatttttttgcgatttttttgcctttttcttttatcttttttttcgcttttgtcttattacttttttaatctttagcacacatattttttcaaaaaatgttttgagttgaaaatttttaaatctttaacttgaaaattttaaattttgatttgaaagttatcaaatcttaagttgaaagttttcgaatctgagttgaaagtttttaatctcaagttgaaaacttttaaatctgagttgaaagttttcaaatcagagttgaaagttttcaagtcgaagttgaaagttttcaaatcagagttgaaagttttcaaatctgggttgaaaatttttcaaatttaagatgaaaagttgaaagttccaaaatttgactttaaaaaatttaaattttgagttaaaagtttttaaatctgggttgaaaattttcaaatctagattgaaagtttcaaattttgagtggaaagtttttaaatttgagatgaaagttttcaaatatggattgaaaacgtttcaaatttgaattgaaagtattcaaatatcagttaaaagtttaaaattttgagttcaaagtaataacacaaaaatagaaaataactaaaaaaacaaaacgtgaaaaaaaagggaaaaagatgtgggcctaacagaaaaaacacaaacgacgagtcctttctcaataaaaaaagtgcgcgctatttgcttaactcgcgcagcttttccggaatttaatgcgtgactctccattcttccacgcaatattggctatataggcatcgagaaatgtaaatatattaataaatcgcttgtttacgagaaataactagtagcatatttaaatggatgataagtaaaattacttatctttgatcggtgtattaagataaaatataactataaaaagtaatgaagggagtacgaaacagaggaccaaaacaacttatatagtgaaaaggagtagtagttttgaagcactaaggaggtactagtagctttgaagcacttgggactaatgagtggttgcacaatgcatgcatgcatgcatgagtattgcagggttgcgatggttccgtcctccttaacgcgtccgacgagaaccctcgtcctgagacggcagcgccggtgagcatcgggctggaaggattcgacatcctggaggagatcaaggccgatctcgagaggaggtgccccggcgtggtctcctgcgccgacatcctcatcttcgccgcccgcgacgccagcagcatcctcagcaacggccgcgtccgcttcgacgtccccgcgggccgcctcgacggcgtcgtctcctccgcctacgaggcccaggcggagctcccggatcccaccttcaccatccggcagctcatcgacaacttcgcccgcaagaacttcaccgtcgaggagctcgtcgtcctctccggcgcgcactccgtcggcgacggccactgctcctccttcaccgcccgcctcgccgcgccgcccgaccagatcaccccgtcctaccgcaacctgctcaactacaggtgctcccgcggcggcggcgccgaccctgcggtggtgaacaacgcccgcgacgaggacctcgccaccgtggcgaggttcatgccggcgttcgtcggcaagctgcggccggtcagcgccctggacaacacctactaccgcaacaacctcgacaaggtggtcaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaaaagactactccagtataatataaagtatttgtatttgtggttacccatatatttacctgttatgaattgttactaccttcgtccctgattttgcatctgttagtgcatagactaaatcccatacatatttagtactcgtggattgtcatgtaactgggctgaatcggtatacatattgagcccatggctagctaggctcaatccgctgcgataagccaatcattcaagccgttacaaaaggagcagatccaacagatgggaggatcgaacaaaatagatgaaacctgagttcttccttccgatgctctctcttcttcaacctctgtatctctcttctcttcaatccctggctatctcttcttctccaatctactgctaattctcagtcttgattccatttctcccatttgtatccccaaatactcgtgtatcaagtgttggaggaagaattgtgtgcttgtgctggaattcactaaatcacatagagtgggttcgtaacaatatggtattaaagccaacaatccatgggttccaagccaggagatgagatggatgacatacgtggcagccgcgacttccatagactggatctaagaatttggggtggttgcacttgaggcgtctaagaacacacatgaacatctaagaacacaagaacacaacatgaatatctaagaacacacatgaacatcaagaacacaagatgaacacacataaacaaaccagcatctatagtatagttgtcggacttttttcaaaatcggcacttataaatacttaaaggtgccaatttttccctttagcgccccccgcgggcgctccggtgggtgggaaaagcataataggtgccggttttagttattccggcacctataatactgacttttatgtgtctttttgtagtactgatttgcagttgacatgattatcatcgaacacttatgggagaaaaaaataaatttgttctagccaaatcaatagagagtgcagatgagaacttttgaaaaatggggtccaaaaacatgttgaaacacatttgtttagatccatgcatgtacatggaaattttcggggttgctagtctattggtcgctcgctttgcacctgccaattgataggcccagtagttgacgtgatctgacacacggctgggatgaacgtaggttagctgcttcccaaccagtcaacaggacctcttaaacaaaagggaagtcaaataagaaaatgtttaattaatctagcctggttcggatgctagataacagtaatggagtgattaaatattgatgagaccactataatctcgattatatttgagctagcgaacatgcctgctatagttccctcaaaatcctaaagatatgtatggcgttagcgtcctttccagtggatacgcttaacacaagcttttgacgtgaaagttaattaatttactactgtacatggaaagaaattctacaaatacatcgctcttaggtaacagcatttgaattgaaataaagatacatgttgtcaaatcgaccaaataaactgacctccttcataggggcggaactagccaccgggcggctgcttgggctcgttagcgaaaactacacaaaattttaatattaatgagtaaatagatgatgaaatttctatagcaaatatcagttatattgaaatttgtctgggctcaaaaatctttctagctccgccatgcatccttccatcaaatactgtgcttcggttgacacatgcatgatgcatctggacggccaattaatttactctatatagctccagccgaatttaaattaagttcaccgtcacaacgccaggtatggatcgatgtcaacgcctacacgttttatcagttactagctgttttgctccccatgttgttagacaacaagaactggcaaataactattctgatgattgctctccaaatattcctcaaatctcttatttaatcaatctcctcattcaaaaggagtagctcaattatcaatgatcaatttgcacatccatttgtacctataaatacatcgaatgtttgcctgtcacatcatcaaacatcaaccaatcctttgaggtagcgatcactacacatatattcattcggtttcaggcgtttctttgctgtctcctagtgaacaaccttgtcagaattcagaatgttcagcagggggatgaagctaattctcatggtagccttccaggctatgagcctcatctccatatcaactgcaagtctgcagtacaatttctacggctcgtcgtgcccaaatgccgagcagacgatcagcaatgtcgtctacggcttgatcgatgctgacccttccatggccccggcgctgctgcgtttgcatttccatgattgctttgtcatggtaatgtaattgctaaccacaagttaatttagtttttcaactatgaattgatagcagttttaatttctcacaagatatattactgcaagcaaagcttagatattgatggttaattacttcattttgtccccaaaaaaaatgtaaacgaagtttttttttttttgttttttgatcatgcagggttgtgatgcgtccatccttcttgatcccacgaaggcaaacggctcgccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagtccggcggcttcgtctacccggtccccgccggcagccgcgacggcaacgtgtcgtccgccttctccgtcttctccagcatcccgtcgccgttcttggacgccggggagctcgtccagagcttcgccgccaaggggctcaccgtcgacgacctggtggcgctctcgggtgcgcactccatcggcaccgcgcactgctccgggttcaagaaccggctgtacccgacggtggacgcgtccctggacgcgagctacgcggcggcgctgagggcggcgtgccctgacggcagcgccgccgacgacggcgtggtgaacaacagccccgtgtcgccggcgacgctgggcaaccagtacttcaagaacgcgctcgccgggcgggtgctgttcacgtcggacgcggcgctgctgaccggccagaacgacacggcggagaaggtcagggagaacgccggcgacctgaccgcgtggatggcgcggtttgcggcgtcgatggtgaagatgggcggcatcgaggtgctcaccggggcgcggggggaggtcaggaggttctgcaacgtcaccaacagctaaaaagctatactggctggctcgagtgaagaacgcacttgtgccattggtgtgcgtgccgtttttgcttagtggcaagtttgcaccttgtgctaattaaacgtttttgttctccaatctacaccatgcacacacaccattcatgttgcaattttttattgccaccttgttctataagaggaggaaaattaaccaccttaatttgttattcactctggttatagtattttggttgtatggctcatgtaaaagatttggggcttttttttttagaattacacagtgcaatgtagatactcacaacgcacacgcactcacatctatgaatacacgcacgcaaaccctacccctataagcatcttcgaaaactgggccggcaaatccttgagattgacgaagtcaccataggcacctcgttgtcgacggatatgtcgcctaccactaaaagcacaacgccgttatatcttagaaaatccgctcccatggggagtcgaacccaagacctcaggtgctactgaggctcttgtaaccactaagcgaaaacgccgttattattattatttttggagaatttgtgatttggatctgagatttgtgtgtgatgtgaatatgtgatgcatttgtgatgaattttgtagaagttgtgatgtaattttttttaagattttatgatgtatttggagatgatcgatttgaggatttggaggcaattcggggatgattgatttgggatttttgggatgggatggagtgaaatcaatatattaaaaacaacaatgaagaaaagaaaagaataaaggagcaactgaatctaacctctttagtcccggttggtaacaccaatcgggactaaagatagccgggactaaagatagcgatctttagtcccggattcgtagtcccggttaaaaaatcaggtctacaaaaggttacgaatcaggactaaaaagcacttctctactagtgtgcaaatgtgtgagcccccattgaccaagtgtaggagcaaaccctctaaaagtgtccagcctctctggccttgatcagtcaattgatcgacatcggtttgtcgtttcgcaaatggtagaaatgatgatgggtttttgatactgaattgagtctctgagcgaattctgatgagtaggaaaagcatcttcataatgaaggtcctaaatctcgtatgtgaattcctgttgataaagaaaatgatggttcacttggaactatacttgtgcaaaagaatcctattctttttttttggtgcccttatggtgtatatgttgtgatagtaaacaaagaaaggaggtgttttgttttcggaaatggtggaaaaggaacttttgctcatctcaagttccctttctagctggccattttgcggagggggaaaaaccaactttccctgtaaaacagtgtgctttgatccttctatgttattcgttttgttcgtgaaattctttcgaggttgctgacatttttgtgttttccacatggaacaaagatctgccaccaagaatacagcaggccaacatgcatctttctgggtgttcaagcaggattgtccttgttgacatcagaattgacgatggtattttcagcctcttctcttttcgatatttaatatgagatctgagcctgagaaatttcagccataaatgctgcatgttttgcacatgctttgttctgattgtaatatctggcaatttcagatttttgggatagcacttggattcaatcttctatttgaatatgatgatctcatcactgggatatgttttgcaaccgttgttcctaatctgctaccatatgctatatcacacctggtaaagaagaagattatctcatatagaaaacttcaaacctatattgtaatctgatttggagttaatatttgtcaattactttcatatacctattctagggaaagaagatggtggggacattaaatgcttgcattgcaggctttgcgcttctttgctacgttcttggtttattggtcagccaaccacaaattcctctgacaacgaatgtaattttccccaagctcagtggtgaaagtgcttattctctgatggctcttcttggtgcaaacgtaatggcacacaacttttacatccattcatcagttgttcaggtaaattatgatgcttctttgtgcccattacatagttagaattatatttgatttgatgcatttggggtgaggggggtttgggcatttggtggacaatggtcaatggcatgccacaattatttacaccacacaatgacacatgttgctagctttgctagtgtttcgaacagttcagaaattccaaactgatagcaagggtcactatattagactagttataccagtctaatatcggatgtagtggagaatgtttttgttctaatagatccagtggtttgtgggtacgctgtatccaactgaaaaagatatggtttgtcctatttcaattgtttgcgcagagttgaagtgatgttcattgacttaatttcaaaacaccaagatacatcttctagcgaattgcagcattatgttaggcatgctcatcgttagttagtgaaagaatttgttctcacttaatccagtttggagcttaactaacaattatggccaatgaaactatagtatttaataagctattgtgccacatgcggaatactatttctgattgacaagcacaaatctagaatgttccttgagtaaatgtttgttccctaaaactgtggcctatttctatttgttttcttttttactttcgcgtgtacatattttggttcactaatggtaaatgtctagtgttcatgaggtctttgccttaggtttgctagtatatgatatatatattacctaaagtgtataaaaatggatagcattagtgagtttgacagcaaaaccagctacatttcattgccctttgtgtcttatgcttttggttgtctttttttttcagcttgtatccatgtttgctaatcaaataatctcttttcagggtcagaaaagatctgcctttgccgttggtgccttatttcatgatcacttgttttcagtattatttatttttactggaatttttctggtgaatcatgttctaatgaactctgcagcagctgattccactaacacccttcttctcaccttccaagatgttgtagaactaatgaaccaggttagtactatagttcctactacttcaccctgtgatatgctaagctggtgctgaagaaatcttgtttcagtagcaatcctaaagtgatatacactacctaacatttatcattttgcagatatttgtaaaccctatggctccaactatatttctagtggttcttctcttctctagccacatcatctcgttgacatctgctattggtagccaagtgatttcgcagcatttgtttggcattaatcttcctctctctggacatcatctgatactgaaggcttttgccatagttcctgctctgtactgtgctaaggttgcaggtgctgaaggaatataccaattactgataatctgccagattatccaggccatgctccttacatcatcagtcgtgccactcttccgtgttgcctcatcaagattgataatgggtgcccacagagtgtctttgcatctggagataatacatttcttgcatttctcctcatgctgttttcgaatatcatctttatggcaaaaatgctggttggtgacagtggtgggctgaccactctgaaagggaatactgaaacccctgtggtgtttccatctacggttctcatcacggtggcttgtgtctctgttgcattttcactctacatggctgttacaccactgaaatcaggaagccatgaagctgaattgcagcaggaatggtctgtgccttctcagaaagagctcttgaatactactcaagacagagaagagacttgtgcgggcaatgttacctatgaggaagatcagagatctgatgttgtcccttctcctaggattcagcctgtggattgtctgaaatcagctctggactacattgatagttcggacacagctatagaatctgatcatgattctcaacattccactgctcatacatctaccgctcctgaatcctgtcactctccatcattcattcctgaagagtcaaaatcagttgttgctgttgactggccagagcctctggagccaatttctaatgctattgtggctgaggaaagtacagtagagagtgtggactccaagagcacaggcgaaagggatattgaagtagaaccagctctt

SEQ ID NO: 26339 - DNA, 18831 bp, Oryza sativa
cagggggaaaggctcagatgcaggcaatggcagcgggagtctctcgaggttatctggtttgggccgtgcagcaaggaggcaactagcagccatacttgatgagttctgggggcatctctttgattaccatgggaaactcactcaagaagctagctctaaaaggtttgacatcttgcttgggctagacgtaagaacacctagctcaactgtaagagcagacagtcaagctaatgaaatcccgaagagtcccatggtacgagacaatttacaagggtctgccttcttgggaagttcaagggatctgatgtctactaagaatgagatgtcgaatttggatctgacatatgggcttcagatgggcaataacattgggtcatcagcctggtctcagggcatgcagttaccaagtacccaactgcagagttcaagcaacagcttactcgatcaaggtgcaagattaaattcaaattttagcacgccatcatacgcagacaacaaccaattctaccaacctgcaacgattcatgggtatcagctcgcatcatacctaaaacagatgaatgctaatcgaaatccttactctagcatgccattggacccacagcgacttccaaaatcttctgcatcggctgtgccaacctatgtcgattctgtcatgcatgctcgtaaccagaacttgcttgcttcattgggagctactccttcacagatcgcagcaacatcccggataggtactatgatggcagaaagatcctattatgtcccttccactcttgacgggaatgaaaatgctggttcatcagcttactcaaagaagtaccacagctcaccagacatatctgcactgattgctgcaagcaggagtgctctgttgaatgaatcaaagttgggtggtggtaccattggatcccagtcgtaccttagcaggcttgcatcggaaagatctcagtatacaaactcggtggccaggcctgcagctcccttggcgtttgatgagctctctccacctaagctcccaggggatatcttctcaatgcaacaaagcccaaacccaagtgcaagatccctttgggctaagcaaccttttgagcagctgtttggtgtgtcgagtgcggagctcactaaaagcgagttcaaccctgcaggcagatcgggtggcatgaccaaggatgatttctcttacaaggagtctgaggcgaagcttcttcagtctcttagattctgcatctcgaagctcctgaagctagaaggatcagggtggctgttcaagcaaaatggtggcagcgacgaagatctgattgatcaagttgctgcggtagagaagctattgcaacaaggaaccagtgacaaccaactgctgcttggtgatactcagcaaccaccatgtgataaggcagacatccagtacatgcgcgtactgcctaactgcggagacgactgcatctggcgcgcctccctcgttgtcagcttcggtgtctggtgcatccgccgggtgctagacctgtctctggtggaaagcaggccagaactttggggcaagtatacctatgttctcaaccgtcttcaggtgagctatttcagtcctgaactagtctgaatttgagtgttgtttttcagtgcccaagacttgactgcaaacctgaaactgctcattttcaacgtacaagactaactctgtcaatcatttttttcgctcaaatgtaatgcagggcatcctggatcctgcattctccaagcctcggagtgctctcagcgcgtgtgcgtgccttcacagagatatccgggtgctcaacagcctgcgccacagtagcctggtagcaacaaactccattccaaggcaaatccgaggttccttcaccaccgcatctgtggtcctggagatgatcaaggatgtggagaccgcagtctcagggcgcaagggcaggagtggcaccgcagctggggatgtcgccttccccaaggggaaggagaacctggcctccgtgctgaagcgatacaagcggaggctctcgagcaagggacaacaataataaggcatctgggcagcgtgatcctgtcgcgttttagggggactttgaccattgttcttcaaggatggcagccagccatggtggcttgccctccctgagccctggattttttcgttgcacaacgtttgcagggacctgaggaattggccaacacttctggtcccttccatcatatttcgtttttttttgtttctttcttgtttttttttttttttttgcatgtgatgtgttgtataatggtaactgttcatgtgccagaagaacaaccaccaaaatgtacaacagatgtagtcagctgatgcaccattgtaaagtttagtctctgcattttaaccttttttttgggggtcattgacaaactgaatgaatgccctgtgtaatctctcttcagagaggatgccaagactgagaaaaagcttttgccagatttccagattccttgtgttcatctaatatctgtcatgtctctcacattttctccagcttatgatctttttgtctcgttggcatttgatagcgtgtgctggagatgtctaccgtatatgtggattactgtattaagcttctgggaccggtgtatatatataatttgtatggatagagataaagaaatactaactcgatatggattagttatatcctaatgtttctctaaacaccaggcgtagtggcactgtactgcaacctcacccaagaacatgtttttggggttcagacttgagagtatccattgctgaatttgcctcaccgcaagtttagtcttgcatttcacaaaattgcaaggatagctaacaattttatcacaaaaccataaactttgtggccgtgcaattggatatgctctctttgctcagaagcttttgaggatactgatcacctgttcagaaactgtgcctttggacttgatttgtaccgggaaacttgacaacccggccgacacagtattctcgattagatgttgggaaaacaagatagccaaaacaaatacggcacaaaaggcaaaggagacctctgggaatactaatcaggagagagaaacttaggtggtgtttgaatcttcctttaagatgaagattaagtgtttcacgtaaaacgaggtgataatattatgtgattaattaagttctaatcattacaaacttgaaaaatatattaatttgatattttagaacaacttttatatagaaagtgttcacatgaaactaccgtttagcagtttagaaaagcgtgccacgagtatccaaaagcttatcaattttgttggagaaaagaatagggttagtcttccaaggttcttttattcggcagagctcccgctgtcggttctttaaagaaaaactcgtagattaggccacccatcaaatataaatgtaatactccattacacaaatttaattttacataagggttcaaaattacattatagtttatttacactacgaattacatctgggtaaatttttagaaatttggaagcaaaaccgtgaacacgtcatcaaaaactggatgtgggctccacgagttcagaggatgttccgaacccgttttgatcgcccacggcccgccgccccgccgtggagccgatccccgccaccgccggcgagcagctgttccggacggcgtcctgctgctccctgcgccgcccccatcccctcggcctccgccgagctcgttcctgcgcggtgagcatccttgccgacgcaccagaaccctcttttttttctctctctctctcgttgtacccacacacctctactcgaatttgctctatcttctcttgtagatctgaaagctaggttttcttttttacttgtcttaacctttagttacataacaggttttttcccacatcaggtccacatcgatctataatagccaagagcccaagacctgcagggcttcccgggggtggtgcatcttctcaggcggaggggcctccttggattccttgaagtttatggcgccggcgaccaaactcatcaccgtgtgtgcaccggcaaatatgacgaacaggtccccctgtacatgtgcgcggtcaccttgagttggtcacccctgtcaaaacatagtaactttgtcaaaacctaacctaaacaaacatgtttttttcacaaaattcttcattcttacctcatgtctgattttaacaaatctagcctgtggtttgccttcagatgagcaatacgccatccatgcatacttcctgccgccctctcctgtttcctaatgcgctgctcaaggcgcctcatcataaccttttgcaccagaaaagcatcaaaatgttgcttgtcagcacaaaacaataaatccttctcaagtctcaacgagggggtaaaacttccagcatcacaggtagcttctccaggtcactcctctctcatccagttaggaatcgtggatgcaaatgcagaatcgatttcatccgtccccgaaaagaaatacaagggattttggcaatgcgaatgcagagccaaactccctcatatttggatttggggacagaggtagcagataggcaaggcaattagagcagtaattttaccctggtagctcttgtggagaaatagcggggctgggcgagtgcggaggaagcccatggtggggtggaggtggcggcggactgaacaagaaacaacaagttaggcgcatttaacggaggaatagtgcagtagcaataactaggaagcttgtgcaacaaaataagcaagcacacgcgacaacaaaatgatccaatccaattacttagaatcaactcaactcaatagtgcagtagtagcaaatcagaaaacaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaacatcatatagtactatcaaatcagtctagatttatactactagatagctagtgtctaatcgagtactaggagtatattttaaaacaagagtagtttgttattacttggtactagcacgtcagtgaatgtacgtgcacaagaaatcctcgtcgataatgaaaactagcatggtattggagaatccatctcttaaacccatcaagtcgaaatcctgaagcaccaaaatccccctacttgatacgcaactatcgacgtttgatgtcgcaattctggtatttgcatagtatggggatcgtcggtgctaggatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatttaactgttgtcgacatgtcggtctgaaggtctgactcgtagtcgacaacagggtagccttcctcctcgaatccgtgtccggcgagatcagagatagcgctttcgtctctcctgacggtatccggagacaccgtaggggaatagccatgcctatccctaaagtcgatatccggcggcttgtcttggcatatgttggcttgtatgttgtggcttctgttattccgtatattgtggtggttgttgattgaggtggtcgtctgtgtcgatcgtggtgactgtgttgatcctgtcatggtgggtgtcccactgtcctcctaggggggcttgtatttatacccataggtgtcccattgtccaagtagaactagggaaaccaatatggatacaatccgagtagtccttgtcgtttccatgtaaaactctggttgtctttccttatccggaactccctccataactgaagttagtttctgtataagacatggtatgtggtgggtcctgccgagatttagtcaactactattaggtatgtggtatccataaccctgacagtagcccccgacttcaatgcaaatgaacgaattcatattctcaaccgcagaccctggagtaactgttgtcgtgctcacgttaccgttctcggtgagtttagagataacgttagactttctttatcagcctcgtgcgggcaccaaaagggtttgtctaagtcaatctctgatgtcaaccaaggaagtacagagcgtacgactaagtctcccgtcttgctgtaatcgagaatttggattgaagtcaagaaattctatctcggctggtacaccatctcttcattccgtattccttgtcgagatccagcaaccgttctcgagcgatcgagaaggcgtagagtctgcgacggagccttgtcaacatttgtcgtactcgccatagtcgatcttggtgtagaaccatagagacatagagtcttcgtcaatgtcgaatagaattttcctgaaatcaatactcagaaaagaatattagatagaaatagcccccgagcgaatgcccaaagggtgataatgttataatatgtatggtaaattgaaaatgaattaaatttaccgaccaatgttttgtgtatgagcgtcttctctcttaccgacttcgatcagtcagtttgtagagtcatacactctccctagcccccagccttgtcatcggagaatcgttctcggaggataaggctcttggacccttgacctgccttggttgaacaaacactgatcctagcccccagccgtgaagttggaaagctcagtttccgattacacggcttggttaatacgcacggcgagaactcttacacgaccagatcttacatggtcttttgtctctacaggatccgacaaggccttatcggctctgggcgtccccagccgaagttcccttaggttcctcggaggccttgtcaagacggcgtaatgggacagtaggataggtttcaacgctaggtgtcgtcgtggtaagggatctctgggtaaaacacttggcgatattgtataccagctatcaactttgttgaaatagaggtagtaggagagtcgttacaccgctggtcgagaaccaggcagtagtcataactcgaccacttaaagtggaaatagtgggagaaacgctacatcgctggtcgagaaccaggcagtagtcgtatctcgaccacttaaagtggaaatagtgggagaaacgctacatcgctggtcgaggaccaggcagtagttgtaactcgaccaattaaagtggaagtagtgggagagacgctacagcgctggtcgaggaccaggcagtagtcgtaactcgaccacttaaagtggaaatagtgggagaaacgctacatcgctggtcgaggaccaggcagtagtcgtaactcgaccacttaaagtggaagtagtgggagaaacgctacatcgctggtcgaggaccaggcagtagtcgtcactcaaccacttaaagtggaagtggtgggagaaacgctacatcgctggtcgaggaccaggcagtagtcgtcactcgaccacttaaagtggaagtggtgggagaaacgctacatcgctggtcgaggaccaggcagtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtactggtgcgagaaccagcgtgcgagcagaattatctctcgaacaccaatggaagttgcggtgtgagagattgctacgtattggtgcgagaaccagtgagcgagcagaattacctctcgaacaccaatggaagttgcggtgtgagagattgctacgtactggtgcgataaccagtgagcgagcaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcctgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccactgtcgacgtttgatgtcgcaattctggtatttgcatagtatggggatcatcggtgctagaatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatctaactgttgtcgacatgtcggtctgaaggtctgactcgtagtcgacaacagggtagccttcctcctcgaatctgtgtccggcgagatcagagatagcgctttcgtctctcctgacggtatccggagacaccgtaggggaatagccatgctatccctgaagtcgatatccggcggcttgtcttagcatgtgttggcttgtatgttgtggcttctgttgttccgtatattgtggtggttgttgattgaggtggtcgtctgtgtcgatcgtggtgactgtgttgatcctgtcatggtgggtgtccccctgtcctcctagggggcttgtatttatacccataggtgtcccattgtccaagtagaaatagggaaaccaatatggatacaatccgagtagtccttgtcgtttccatgtaaaacttttgttgtctttccttatccggaactctctccataactgaagtcagtttccgtataagacatggtatgtggtgggtcctgccgagatttagtcaactactattaggtatgtggtatccataaccctgacaatagtatgttttctcattatattattcaaatatattaaaatgacaacttaattttaaattttgcaataactttacaaaactactaatatgtaatatccatattgtattttatatacgtgttagttattaattatttttaatatcaaattttagttatttgtaaattatatatattgactcattttttaatatatttttttaattccgaattttctgtaaattgtatttctatatagactctatgctcttcttccaatattatttatttttatttcagaatttttattatttctaattgtatttctatgtggactctaaactaatttttaatttcgaatttcagttacttataaattgtattcctatattgactttaaactctttttcccatatttttcttaatttcgaattttagttatttgtaaattgtatttttaattatttttaatatcaaattttagttatttgtaaatatatatatatattgactcgtttttaatatttcttttttaatttccgaattttctgtaaattgtatttctatatagactctatgctcttcttccaatattatttatttttatttcagaatttttattatttctaattgtatttctatgtggactctaaactaatttttaattttgaatttcagttacttctaaattgtattcctatattgactttaaactcttcttcaaatgtttttcttaattttgaattttagttatttgtaaaatgtatttttatacggactctaaactctacttttaattttattatgtttattccaaattttagttagttttaaattcctatatggactctatactctacttctaatattccttattttttaattccaaatttctatttttttcttaattgtatttatatatagactctatactctacttctaatattccttatttttaattccaaatttctattatttactaattgtatttctatatagactatactctacttctaatatttcttatttttaattctgaatttcagttatttcctaattgtatttctatatggactctatactctacttctaatattccttatttttaattctgaattgctgctattccctaattgtatttctatatgtactctatactctagttctaatattcttatttttaattccgaatttcagttattttctaattgtatttctatatggactctagtctcctcttctaatattccttattttttaattccgaatttcaactatttttaaattgtatttctatatggactctgccttttctttttctccgattaatgtgagaatttctaggccatgaaagcgaacgtggagacttccttttctattcctttaataatataatagaagatataagtaacaaaaaaaatacaatttgacatgaattatatcaaaacaattagtatttgtgatcaaacgggcatgcatgtggggtcagcccaccctagcccatggcttgatgggtacatcctgattattatgcactgctcgacaaggatatgccgtggcggctcacgtggtaaggccagaaccaagatatggccgaagaggagccaggacgtgcacgtgtgacccatgaaatatttttttcatgaaattgcacgttagtatattagaaaaaaaatagagttttagttatacagcgtaatcgaccaaactggtcgctgtcggttacaaggaaaaagattgcggaagggaaaagagtcaaaactagaagttgttgctcgtatctagcggcactactacgaaaaccatctttcgttgcggccattttgggttttcgctggtggtttttggtaccgtcacaaagcaaaggccagtgaagatcaagatcttcgctagcggttatcggccgccagtgataattgatttttgctggcggttgtgttatactggccgccagcgataaacgattttcgctggcggttgagttataccaaccgcctgtgaaaatagtggcccaggttaaaaaaaaatgacaaagcaacactgctccgttcgcctccgtcaacaccggttcaaattattcccaaatccactcctcgattcacaaattcacataaatttacacgaacaatttataataaaaaatttccattcacagtcaaaattttccattcacaatccacagaaatccacaaaaatgcacacaaatccacacaaatctacagaaatctgagcaccaccgcccgtgacctggcggcgtcggcttcacgctccccacggcgcagcgtcgatcgtgacgaggtcaaggccgacggtcgtgctccaccgcccgaggccccgcggccgtgcgccccgcgccgccgccggggcggatctgtccttcccggcggcagcctcctcccctcggacagatctaggagagggtagaggaggggatgggagggcgcggcgccaccgcttccttcgtggtcatcatcgtcaccgcttccgtcgtagtcgctgttgtcgccgtgcacatccgcgccgcgcccctcccgcccgtcgtcggcgccgcgcccctcccagatctcggtcgtcgacaagaggtggaagctggaggagcagggaaggaggaggggagagaggtgggggaggaggaggagagggaggtggatgggtgggtggagaggaggagatagaggagagagaggcagtgggtgggtgaaaggaaaatatctcagcacgcgcgtgattttaaatgatgccaaatttttttagcgggctctgttttttcgctagcggaagtgtttagtaaccactagcgaaaaccgacgcgaaaacgtcggttttcgctggcggacatttaagagatccaccacgaaaaatagagtatgttttatggcggacgtcttaacgtggccaccagagaaaatcggttttcgctggcagtcctataccccccacccctcatgtttttgctggcgattttagcatataaccgccagtgaaaattatagtgtgacgccatgaaaaattgtttttctagtagtgcgggagggggtggcggaggagcctcctaatctcccaaaaggctcccaaacgagacaggaccagcgagagaccagagacgaacctcctagtgaatgtattggaaaaccatcgagaccggcgaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcagtgaccacgtcaagggagatttcacgtcagaggatcttcttctgtggccgaccgggcggagcttgttcttggtccttgctgtgccaggtctggccatgcacgacatggccaaatgggacgtgtggaagaaatatgtgcatgcacatgatgaaacatgaatgtgtggaataaatactatgtcgttttgactgtttgttgacttttggacgagcttttcggcacctatatgaagttatgaacaatgaaacatgcagatctatagagatactagtgcatagcgtttattggatggtaattcgttgtcctaaaaataaaatggaactataccagtccaggcgaccaaacaacagtttttttacaagtgtttctgggcagtcgttcggcagtgtgacaacaatgacgaagagttgacagtcggcaatgtggcaattaacgagcaacaatctgaggcactccctccatcctaaagaaaatcaaatcatactaaaggggccgaatggcctgggccgcctatttgccaatcaaagtacacccaaggtccctcaacttgtcatcgagttacaaaatcatcccccaatcgcaaaaccaaatatatgacatccctcaacttataaaaaccattcactttaggtcattcggtggttttgaccctggttttatcctacatgagcagagtcagtgtgggacccacatgagcccacatgtcaggatgccacgtccgcaccctctctcttccccctcctctcccttcctcctctctctctctctcttactcttctcttctcttctctgggcaaaccggccagtggctgaggaggaggccgccagggcgaggcgcaagaggaggaggcgacggcggctgcgacgcgggagaaggcgagggtggcggacggtcgcgaatggcattgacggtgctgcgtcgcctccgccccgtgcgggcaggcgccgcggcattgggcacagaggcggagacagggccgggtgccgtggaggtggactcggcggacttggagccccggcctgctcttgcgccgcatcctccctctctccgtgtgctggctgtccctccctacctcctccctattcgcgtgcgctcgccgccggccggcgggcatgggagcaagcgagccgtccgtggcgtcggcagcaatggtggtgcgatgcatgaggatggggaggaccagcgtcatcgtcacgtcacgtcctcgtcggcgcgaagatgaaggagacggggaagaggaagaggtggtgcgcgtcctcctccttctcgtcgaactcgtcgcaatcgtcgttgtcattcgccgataccccgctccgcgctggcggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggcggtgctggcgatcaccgattagccagtcgcgacacaaggaagaggggcttgctgtggcaagagaaaagccgatccagatatttaggagaagacgataactatgcgtgatcactgttatgtggcggttttgcaatgactacttcctgaagattcgcttctctacgttctgtaacaatttaatgcgcatagagtaaaaaaataactcaagatgctgacatcgttagagtacaacaagaaactatctcactgttagtaaaaaaaattatttggactataggagtgggggcagggggcgcaggggtgggatcgagattggtcgttagtgagtaaaattttaactgcatgctataaacttggtgggggacagggttgggagcggcagtggtggggggttgagcagtgggtggggctgggggctgtatcacgtgccatttaatacgtagcaccttaaggtgccacatagtagttctatacacacacgcacacatatacacaaatttttacgtggaaaatccttacgggaaaaaaccacggacaccgactagcaatgatcgatatagagaagttgaatacaaacgcacgacacactgggttgtcgcacccttctcgtgtagcttacaagagacatgtaaaagagaaatctataagtcctagtaggaaaagacttacaatcataataagaaactaatcaagtgttttattataaaactaatccgaacatattgcatgctatttttttttgaaaggaaagcggcaagagtattgccgaatatattagaaggagagaaaagtatggtttacacgattaatgcggaaaaacaacttagaatcatctcagaaccatagatcctggtttgagaagggaagagatacactcatgacggttggaattcaaaactgctttcttgaatatcttggatgatctggtgtgaagtcttttgcatgtccggttcttctcctctgaagatctttgcgttcctttgtagccaaatgtaccaccaagttttgacaatctgaacatattgcatgctgaaatttggatcacatatttaacaatctccatcttaagacgaattttccttgtagcataaaaatccgaaacgctcctgtccagacgcctgattgtagggaaaacaatcggattctcatgcgtctctcctcaaaccgtgtgatgttataatggatttttttactgttccaatgggtatttaatgatgtttcactaggtcattttgaaatgttacacgggatgtttttttgatgtttaaggaggtattttgtgatgtcctcggctgatgtttcactgtatcattttttaatgttgcacgtggtgttctttgaatgtttcaggaggtattttgtgatgtttcagctaatgtttcactaggtcattttgaagtgttgcacacatggtattattttgatgtttttctaggtattttgtgatgtttcactatgtcatttggaatgttgcatgtcgtgttctttggatgtttcagaaggcattttgtgatgttttagaacgtatttcactagctcattcggaatgttgcacgtgatgttatttgaatgtgttagaaggttttttgtgatgtttcacaagatacttcactagcttattcggaatgttgtacatggtgttctttggatgtttcagcatgtattttgtgatgtttcactgggtattttactagctcatttgaaattttacacgtggtattttttggacatttcagcagatgtttcactagatcatttaggatcttgcacgtattgttctttcaatatttcaatgtatattttgtattgttttagaggtcacaaatcaatgtcccacttataataaaaatgtttcaattagtaatataattacatatgttttatttctccaaaatataatcatgtgagatctctttgtaaagatttaattgcaacaaattcaacggtgcaattgaatcacaaattggataagtatttcataagaaaaaatggtttataatttgctaattaagagtatgggagaagagacaaggggatgggagaagtttgcatgtacctcacatgtggaagagaagaaatgactgcgtgcatgcatgtggaggtttcccagaagaaaagattgcatgcatgcttagggggcccaatttttttctccaaaaatcgggcacccgttccgtagtgtcctccataaaaatcttcaatctccaaacaacatcatgtagtaccctcgatagaaaagagatgaaccatacttcaaacttaccattggtgtgaacttagcatagacacgaaacatgatgcacaaacttcaaactcgctattggaataaaatcctgaatatgctgccataaatttatgtaaccctagtagaaatgcaaaactctagtgcacaagacaaagtacttggatctcccaataacctactggtatgttgggtatgatggtagcaaaatttgtcagaaaattggatcaccttgtgatctagacaggagtgaggctccctctcgtcgactcaaatattcttcttcttttttctgtgcttttcctcttaggtaaataccccacttcaaatatttacttatcataatgagaatatgtactcaatctagacgtggtagattatcttcaaactcgtcataagaattaatcctaaatctgctcgcagtactacatgaatgctcattggtgccggttcttgaaccaacacaccttcgttttttatttttcaggtgctaaaaagtcgaaaaaaatatttggtatttttattaggcacctatacaatcacactctcattcccaaaagtcacataatttttgaatccatattcatacaaatgtgtcaagaaaaattcaaattcaagacatctcacttcacacaaagtcaccttgccatatcacctacaaacacttcttgtcttggaaacaaatgctattgttttgagaccactatcatttgaacttataatccatatttaacaccatagataagataaaatgaaaagtgtagaaaaatgtagatcttatctatatctacaacttttatataggttttgtgtctatctgatatcgtttagaaattttaaatatccactcatgcaaataggtttgagacattgtaacacattttcggacattcaaacaaact

SEQ ID NO: 26340 - DNA, 701 bp, Oryza sativa
  unsure (1)..(701): unsure at all n locations
aaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 26341 - DNA, 977 bp, Oryza sativa
ggactgagtgtcccataaatacttatattggggcataaatttttgaacactcaaaatatttgtgaaccaaaagaagtatatggagaggtgtgtaccattaatccattctttcatatgactgtcaacgccgtaaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagcatgaagctcacggtagcaattgtctgtgccatggcgaccgcgcttctcgccgccgccccgtcgtcggcggaggccggcgacggcgagctgaaggtgggctactacgacaacaaatgcagcggcgtcgaggacatcgtcaggtcgcacgtcatcaaggctatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgggccgggttttaaatggatttatgagtgaattcatttatattacctctatttctcattataaggcattctattttttttcctagacaaacttttaatttatagaaaaatatagtaactttttcagcacaaagaaaatattttattatcaaaatggataaaaggttaatcttaatgaaattaaattgggt

SEQ ID NO: 26342 - DNA, 1508 bp, Oryza sativa
aacgaacaaaaggagaggggttagagggagagaggagagtgcgagagagcgagggcgccggccgaaggcgggggccatggcgtcactcaccagcgcacgacggggatggggctccggcggcgaatctctacggaggaggggtggacggggtggatctcggccacccgaacccgacggcggctacggcgcggtgcggcggtgagcctagcggcggctagcggcggccggagtagcggagacggcggcggcgggtggttgcacggcgcgggagcgatggagagcacgagggagttcggcgagaaaaggaaaaagcgagagggagtgacggggaagcttaaataggggaggggagggccggacgtggccgggagaggcgggatttcgccggccaacgtgggagaagtgggggaggagagagaggcgggattcgaaaatcgaatcccggccatctcgggcgcgggcgcgagcgggagagagaggggagtgggcgcggggaacgcggcgcacgcgcgggcgtggtcgacgtggcccggaggaggcggaggcgacgcggcggcggttgcgggcgcggcggttgcgggcgcggcgtcggctggaggagggagacgggcccgacaggtgggccccacctgtcggcgaccccgagagaggagggaggcgggacggcctggatgggcctcggcctgcggctggcccaacaaggaggagggggaagaaaggagagaatgggccggcggcccattcggaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgccaaatccgattattatttgcattactttcttagggttttctcttgatttgcacctgcattttcttggggttgtttacaaattaaatttggcttgggaggagaacttcggggtgtgacatccactgccgcccactgagttgcacctccggcatcaccgtgttgtgctcctcttcctccgccgcccaaccctagggcagtctccacgtacacgcgccgccatggccgaccaattggaagccgaggccgcgccgtccccttctcctccacgcagccgtcgccgtgtactcctcgccgttctcctccgcagccgacttactccaccgcctctctccgcctataaatggccagcaagctcgccatccctctccacaactaagctcctcgagctctctcttctctctccaccatggccggctaccacaaagtcaccggccgatctcctcctccatagcaactcttccaattccctctcaccaccagcctcgcctcgccgaggagagcccatttcaccattttcccctcctttcccccctccgaaacaagccaccaccaccacctctttttgtcgccaaagctgagctcct

SEQ ID NO: 26343 - DNA, 2580 bp, Oryza sativa
taaacaaaaatatatgtaattaataatatttttaatttctaatttttggtgttaccaaatagtaggtgtagtgtttatccgaacatttataatagcataggttcaatattgctccttttcattaatcctttttctaagttaatcttataagttatagaaaagtatagcaatatctataataataaataaatgcactatggagacatatttcatgataaatctaactcaattagtttggtgttgtagttttattattctttttatgaagtcagccaaagctatagaagtttaacttgagataaatttaaatagtttacaatgtgaacatgaaatgctaacaattttctatttcctatgtatattgtttatgccacatttatcttttatccttgtgtacttaatcttttctgaaacaccaaatatggtaaaatctgttattggattttgcgacttcgtggtttagttgtagcgtaaaagtaaatatttatttagagaaacacactgttataatgtggctccttgctactggacatcatcccactattttactccctccatttctaaatatttgacgccgttgacttttttaaatatgtttgaccatttgtcttattcaaacaatttaagtaattattaatttttttcatttcatttgattcattgttaaatatatttttatgtagacatatagttttacatattttacaaaagtttttgaataatacgaaaggtcaaacatgttcttaaaaagttaacggtgccaaatatttagaaacggagggagtattagttttggtgttggacggaaagagagaacacgggaaatatatcaaatgctcctgagtattctaattaggccaaatggcatgctggccggttaatcagtacatgcatatatgtagtgatcaaggtgggtatgtagtaacactatgcatgcggatgtcacaaatacatcaaactaatcgatcagtgatagttataattaacttaatattttggataattgattctttatctaaatttttgttttagatgtaatttagacgattgtaagttatagcaaaatttgtcagtgtggtattgcgtatttgcgtatatagtgatgtgtacatgtgtggctctgtcgtgtaatctagaaaaatagcattaagttatattgacgctgttttaggacagcacgactaatctacctagtcggactggtcacttggtctaattgttaaggagacccattgtattctagattcttctaaatgaaattgtattttagacaatcttttttcccccaagcccccctagcgttggggtttgcaatatgttgaaaatcttggcgaacaaatcgagttagaaataaatcacacatagtactactgccatatccaacctacctctctttgggctcttggcccatatcgttttgcccatgctgataaagctcatagagaaatcaccgagatgaaagtcgaaaaaaaggagaaaagaataaaactagtcttattctcgctcattccccgtcgttggcgcactgcggattccgtcgccaccaatcctccatgatcccctattcctgttgctcacatgggccacgacatgttcgtccgctagattcggtgctgtgcaaccgctagccatagcgggcctaatccggcgtggatagggattagggaggtgacggccgacggtaggtggctggccgcatctgagaggaaacagagaaagtgagctgagctatagctcgttgttggcagccggtcaagctctagttcatccgtctagctaaccaccggtactgatttttcttttttgggcatctgatattttttctttctttttttctccttcacaatcctggatgtatattcaatcgaataggacggagcaacagattttttttccttgcctaagggagcagatagttgggaagtactccttggagatgtattgcttaaattgtttttcctggttttttgctttccttgttttttttcccaattctgatcggcgttatagaaagctgatatcaaagaactgaagaagtcaagcaatatgcaaggagattgtgttcaatttttttcaccaattacttctgccgtgctttttaatcttcttagatttttttttagttttctcaatgtggatttagggtagatatgctatttttttttcacacatgacctgatttatatcgatctgatgatcttagcatgaggctcttgatgtttcaggagggggaacgaatcatgtggaagatagggatcgtaccttttgcattcaactccctttgaatagcaaaatttacagttaggtcctttgcaccatctctacctttgaaggctttgatgcgtcggagcaaatcctagaatcagagaaggggacacgtggcagattttcagatgggccctaacgaaatttataagttggcatgtggcccaatgaaaaacttgatcctgaaccctgcaattggtagtattagagatgtcgatgtccaaagaatagggaccttaaatagacttatttagctatttatatatcacagcccaaagaagagagacataaaatagacttggtgaccctcaaaag

SEQ ID NO: 26344 - DNA, 8392 bp, Oryza sativa
tagggtcgtgctccaccagcttggggcgcaccccacatgggccccacatgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgtttatccatgatgtgagcaacggatgtatccgtagtagccatggtcatatcaccctagtagttgagcgtgaggaaggcaaacaggaggcccctccggcttgcgatggcccctcgtcccccgaaggcctagcgcccaaagcttccagcccccgggaggaccccgaggcccccaagggaggaggggaggctttggcaggtggccctgaaccttatgatcccgaggcagtccgggatccccccgggacctccgaacaggcgtgccccggatcatctgcccctgacaacacgaacctgccccgccgaaaggtgcagcggcccgtctactttgtcagcgaggcacttcgagatgcgaaaacccggtatccgcaggccaagaaaatgctttatgccgttttgatggcctcaaggaagttgtgttactacttccaagcgcatcgggtttccatggtgacgtaataccctcttggccaaattttgcacaaccgagagggtactggacgggtggtaaaatgggccatcgagctggctgagttcgatctgcacttcgaaccgcggcacgcgatcaaaagtcaagaagtcctggctgatttcatcgcagaatggaccccggtggatgaacctattccgtccaacaatcgtacctgcggggagggcggttgaaggtccacttcgggggctcgatgaagctcccctggcatggctccgtttgccctatcttccggagccgcttctttttccgtccagcctcgggcccggcaggtcgcttgtggcccgctggcgaacgatccgtcgcgcgctcggcacctcctccacgtgggggagagggcgaccgggaataggccaccttccgcttcccctttgggtcaccggcggaatcgtctccgggtccgcggctcggtccgggcgcccttgaaccaccgccgcatggaccgccggcccggctcccacccgcggtcgcaccaccaccacccgcgccgacggcgctaccgctggcgccgcctcggctggaccggctcctgccggcgccgacggctgacatcacggccaggatgctctcccggtcacggtcgcagcagaagggaagaatcccatctgggattagtgttggctcggcggagtctaggcccagcacctgccgagtcaccctcttcgcgtcctcctcaccccagtcccagcgctcgcccacatgcgtccgcatggggtcgttgggaccagtgtattcccacgctccacgggatcgttcctggagaggtgcgatgcggcggcggaagtaatcgccaaagaccatcgcccccgtgaggcccaggctccgcaggcccttgaggcagtcccacaccgcgtcgtattcctcgcccagctccgaagccgccagccatgcagcagacctttcaggagggccagtaggaactcgaagtcgtggatggtccggtaacgcggtgtagaaccagtccttcttccagtcctcccatttcttgcggagatggctctcgatgtactgacccgctgtgcctggccggggctggaagtagcatccccccaccaccgcgccttgcagcagctgcgggatgaagaaggcctggaacaaccgcatcgtcggtcgtaccccaatgaacatctcgcacaaatgcgcgaagatggccagcatcatcacggcattgggtgcgagatgcaaggcatgaatttcgtagaaatccagaacctcatggaagaatctggagaacggcagaatcaagcccgccatggcgaaggacaagaggtgcacggatcgctccggatatcgcggccgtggccgcgactctcccgcccgcacgatggcaccgtccggcatgatcttgcggggaaggctaaggtgcttgtctgctgtgatgcgggaggaaaggagcactgcatcgccggtgtcttgagccatggcgaccggcggagaagtggcggagagcgtggcgcgcgagacagtgtgaagtggcgagaatgttagggttcgagaagcgaaaggacgagtgggcagttggcgaaaggaaggaggcagagtctccgcctccgcccccttttatcctcgcctcatccgtgctcacctcctcgtgtcacgcccccataattgcccccatgatcctcgcgcccgcatatgtctcttcgttttccgcgcccactcatcacgtcgcccgttgtatctgcttcccgcctttagtgcgcctgtcagtggcacactcgaggtggagtgcgcaacggccatgagcgcaagttgagaaaaccgtcgccactaccgccgcaggagactgaccccccccccccccccggttatcgcgcctcaagcatcttcttcatgatcgcggtcagtgctggtcaaaccgctgttatggttggcacgccaacctggccacgcggcgatatccctttgatttccctgccgggcccacaaccccagctcgagaagtcatgaggcaccatgtcagaccgatctcaggaaatcgatatctgatatagcgccgggggctactgtcggagatatgggcccgggggtatgtgaagtagaggggagttactttccctccggccacgtgactctgcaagttggccccactcacgcgtcacgcgagtcgtgaaaacggcgggggggggggggggggggctcggggcatggcgtcaccccctcgggctctcccgcagcttcgccccgaggccctcccccggctgccacgcggcggagggagagagagagagggtagctcaggctaaacatccataaatgtgcgacgccccaactgtccctcaccgcattaaatgtggtaagggcagacgtgcggcgcgcctagctgactcctgtccatcggatgtgaccggtctgtgaccggcctgttaccgtcacatccaatggatagggcaatcatgtcctcacgtcgcctctgtacccggcggagtgggggtgggtatgacccgtcacatccgagcgtcacacgaggaagggctgtcgcaagtcatcgctcatttatgaggaaatgacagggctgtcccccgtgtcaggcggggggcggcgctgggttccactcgagaaccggttgttgcttagcttccgggagaaggcacgggttgaagcccagtaaaagtggagtgggatccccctcctatggagggtaggtagaggcggcgcatgtggtatccccttgagctataaaaggaggacccggcccactgaaacggggggacgacgcccagaaaacctgaactccagaagaaagaaagcgagtgcgctctctggagtgaagaaaacctttgtaaaactcatccataatcccaaacacaggagtagggtgttacgctccatagcggcccgaacctgtataatccgactatgtgcaagcttgtcggtagtcttagggacgagcgagtgatttccaagagacgagcctctgcccccggccgaactcacgagaaggggggtctcacgactcctcgctattgaggatctttcctcgatagtatcgatggtgttgatgtcctcatcactttaaattcgatgcatcgagtttggatggcttggataacgtatcaattatcccacattctctcttttttttttctcatagtacaatctatttgtatttgtaactcataggtactaaatctaggaagacaactagagtgttagaaaagatatatcaagccaaataaactgtaatattacttgtgagctgataaaatagtgattaaccaatttttcattatatttgtaggtagatttaaaatagatttcatatatctctactatataaaaattgaaaatgtttttgccggtattttgatacgtcatccgtatttgagtcggtttttaagttcattcccttttggaaatacagatccgtgtatgagccggattttaagtacgtttgcttttaaaaatacaaaagaagtcgtatgagaaatttctttaaaaaaacttacatgctaaacttgagataaaagtcgaactccttattgcatctcatgatttttttaaaaaaatattcaagcgaattctcacagtgaatttcatcttagctaaaccatataacaataataagattaaaaaaatagcattcacccattgcaacgcatatgcatttttttctagtgtttgataatatagaatatacacgagtatataactcttcgtatatcctaatattttttttgggggatttggattcaaactcaactcttctcatattctaatctatattttttggagttatgattcaaactcgaatattaccgtgtatctctttttactctccaatatgctttgcggattcagattcaaactctgatactaccaggtatcccatttttctctcccatatcctttccatgagtctcgggttgagcgagcgtaaaaatactcttctcgttttcacttctaaaatcacccattttttccacattagtcgccacatcaccattgcagacttattacaagaagcaacacatcacattgaagcatatgacgtgatcatgtgaataagctcttactcatacttccctctccttgaaaatacgatggaacagaaattcgtataaaatcgagaacagttcttttcatacgaccctaaccatgatgaatacttacacatttattttactgggaatgcttaaacatctttgtctcaagaccagaaatgcttagtcggggagaaaaggctagaaatatattctaggcacacattttagccggaccttgggattcaatagcatcaatcccgtattgcatgcaggaaatttagcatgtggatctttggattgagatcaaccgcagatctgcatgcaatctcatagctctatgtttccaattaaaaaagctgcaccttacatcggagaacactaatacgacagctagttggaaggactgcacagtaactggattcccctatcttctgttcaaacgcctgagcggcctgttgttatcatcaaatccaccacttttaacccaatttcttcttgcgttactctgtagatctcttgagccatcatgtagttcagtagtacctcttgtacgagtcctatcaaagggcgggtgaccatcacgcatatcagaactcttgaatcgttcattcattttcttcctatttgagttggaggccctggcatggaattcatcactgaactttgttgagaacctgttcctcctatctgactgaacacagccacctatgtcacaatccatatctgaaaatggtacatcatcaagttcattatgcctaacaacaactcttctaggataatgcttgttatggcctcctttacatttcaatccttcattaatatccccatccaaatcagaaataatcccatcatcactctccgagccaaaagattcccttctgtggttgttggaaccattgcagcttacaggtttcctccaagaagcagcaagatgactagatctcagggaagggtgatcaaattcctcatcctcaggagaccctattatatcctcctcttcaccgtgcttagagttcctaattttagcacgcccatttaggtctgccgagtcacaagcatcttcaaagtccaaataactcatccttgacattccatctgtctgaccaccctttgataaatcaagctcgtaactatcaatatcatcctcttcgtcatcaaagtcatcaaaaccaactctttctctttctgaaaaccttctctctgttccctctctccatgtttcattaattccaaattcgttgtcctcagagaacttagaaccacctctagaagacgtgttgtccacagacaagctattcctggcctttgatgaatcagcaaactcaaatgctgcaacatcagcaccatctgattcattgtcatcaaaatcaaagttccatgcattacaaacttcagatttgtgagcaggtctttccaatcgctttcgtggaacagattgattagcttccatttggctgttggtgtattcatctggtggacggttgtttcacaatggaagcacgacatattccgcctgtagttcaaaaagttgcacctgaaatttgaaggacacattagcttatgtggataataccatgcacatctaccgttgaaacatataaattccatcatttttccttccatgattaccagaatgtttcttcagaataatgacaatacagaaatattttaaccacggttatgtaatgaaaaagatggtcacgatatcacctttaccagaaacaacacaatggcaaaaactctttctactgactgggtttattttaaattcagaacaactttgttagggtaccggttgatagcttcataagataaataatgaatgccagtcaattcttctaacagtgagaaagaaaaataagatgaaaggatggcaatttcactgtcagatccttctacagaggtctgaaaaatagcttttcccttcaagaaaacgtggaaatataaaatgctgttgaaagttaaaaaaataactctgttctgcctcacaagcagtattctgaccaaggataacttatacaaaagaggctggaggaaagcggacaataaatgtcagtttttgtagcaaattaacacaattgatcacttgtttatacactattctctagcctgacttaatatgcctttgatattggtcccatagataatatgaataatctttttggcccttggcttaagaagtttgatgcagaaacacagaacatggtggtggtaggatagctacagttatttgggccacctggaaaactaggaatagaacttgtttcaggaatacactacccaaagaccatgtgggtgtatcttctatgtttgtcattggatttctacttggcccattttgcaagggttggagggaaaggaaggaaaactgcaggagggagtaactctactcaagcaggtggcaaaggaggtatatgatgctcagcatggttggcagctttagactggaagacttgaaggaataaagattagggccggtgaaccaaccagaatgaaggatgaaatagtgtggtagaatatatttggcttcgtgttgccttttgcagaagatttgttttgttggcaaccttgaccagtaaaacctagcttagacctgcaagtgagatggatggcatctcagtttgcaaatgccatggaagatgatcgtctctaggaagttactgtttgaacaccggttttgttgccatttctgataatagaaatgggggttctcaaaaagaaaaagacgatggtcaaacaagtaaagacttgtttcaattcacaggtaataaaacaagggtgtggaaaaatatatgttaaaatgtattaggggtcactagtgtgtcttgcatgatgtagtagataataatttgacaaagttgtggttgatcaaactaaccgaggacactcccattctccagggagaagttgccttttgggacgtttagcatcgcattgcaagcaaatagtgttttttgcaaagttcatgaagtcacacctgcagccaaattccaaaaaatgagaacacaattctgagctcaataagattctacagatcacaggaggaagttgctataagtactttgggcagagccaatctcctttcttcatctctacatcatcacgtcccactcgtttctttggtggtggaggtggttgtttcaccttaggtggtggctttctgattatagggggcggaagattgggatcaatggggacagcgctcagcttggcaatgtcatgtatcaatttacgaacaactgtcttcacagatttcagtttgaggagtggcttgttctccacagtttcctttacatgatcaaaaccatagaacaacaaaatacgcataacatcaagagttcgagcttcatcttctttgcgtgtaagaatatagccccttgagcatagatttcgtaaattacaagaactgcatacctgcaaagtaggaggaaaacaagaaattcagaatgtcacatgttcctagtgttaccatcttcactaatatttaaagattttaggttagcattggattatttaactaaacaaattgtctagcttagcttttacaagctacttggaacctgagaagataaggctgcaagaatttgtatcagtaaaactgagg

SEQ ID NO: 26345 - DNA, 12823 bp, Oryza sativa
agcatagaaagacacctgacatttagtattggcaacagttttacatggcagaatcttagttatctataatataaatgtatatggctatgcctcagaaaaatttgaaattggcccaagctacttccacagcaagcagggtggtgtcaactatacctgcctttcatttccatgtgttttatagaaccaagtggggtgttcctaccaacagtaactcaatcaattcaggtaaaaacaatttggtctggaatccattgataagcagcacagaaaggtagcaccagtttactgtactggagcaagttaggtctagatgaatatttattttgttaagaagtctagtttgttttaggtaatggtttattagtaagtcaatatatgttgcacaattatttgttgctggtgtcatctctgcagcagtgaacgcacacagcttgtacagcccatacaaggatgcagacgttattggacaggtcatatcccagactgcatttatatggtgaggccgacctctccttcagtgctacatggtttttctgttgcccttcctgcacagttcattcatgcacatttgaatagggagatagagaatagggtcgggggagtgggggatgaggttcaggtacactaacaaaacatcatagcagctcatgcctcctaaatgctagcagctgacttcaagatgtgttctccaacgttccagaccaaagactaatgttgtttccaaagcagccaaataagatttgtgtattcatggacttccaaccgataggcagcaggcatactgggcatagttatctatcgattagttgtaacgcctatttcattaatttctatattatttagtatccttatctgttagggagtttatttaacaaactgggaaactatgcatggataagaatctgagagcctcaacataatcacataacatgaaaggatgagtctccactaccatgtaggttctcatctggaatcagaccacctggccatcccttacttcacattcaactgagcatagaaaagagagaatggataattgatgctaatggaaaagaaggccaagaaaaatggagatcaagtgggacttaatgtgattatgctacccatgatcattaccacagcccactacaaacatgcagtaaagatacttttactgttccagaaaaacaacaaaaaacaagcagttttgtttccttatgaacttcagttgaattgctacctaaagtcagatatgcatgtctttatatgtttagatgttatatagatgtgcatggtgtcgtacatggagtgtgaacatgtcacacgtggtcctagtggagctagagataatctgtgttctggaatctaatttggactttggagaccagtcatactttggtcagtggtaccaacgaggcaacaaggcagagatagtaaaggccttcgtggcaggcaagcatgtccaaactgtcctcatcgatgtgggctcatgctaaccatgtttagctccacatctcaactttcaagctggcagatctgccatcactgcctatgggtatgtttcacctcctggtactgagtacacctcagacatacaaacttgcgcccaatgaacaccattaattttgcatgaacaccactggttccataactgtacttcacagacaccaaactccagctctattgcatccatacaccagcctccagatattcccttccctgccttcctgcatgtgcccattccctgattgccagcatgcaaatcggtcaactaggtggaactcttcttggcgcctagctacctagtgtctttactttaggaaaaattaccaggtagcaaaggtgatgatagtgaggctagcaacattatcatcttcttacaacctcttcaaatcttgtcctgggtgaatcattaaattatattggacacaaacatggccaagaagaggcaaaaaactacaggacggcttgagaaaacatttcaggtagctatgcaagggagaaattacacttgtccctaaaaactcaacagtgactctatttatattgataaattgagaaaatcgatcctccccagtttgtttttcctatttctgttactttccatgccatatcgactggccaaaacattttttttctcaaccagcaataaaaaaagcagcaatatggtaatttttgaacgataggaaatgaaattttggtttaggagcaacttacatccccctcatcaagatggacaagttttcttatcagctttgcagaaaacacaactttcggatccatgctagggcacccatggccaaccaatacctgaagatccttcctaggcaatgacctggattgataagattaaggaaccattaataatggtgttaatacaatattatttgattatttgttattacatctattggctgccattccagtaccatttttccatgtttaaggaaattaattgccttttttccagaaaatggaatggaacttctcttagattttcaaaacaaaattccaaattctgttcaagtggtctttactaattctcaagtaggaaagatttgtatgtctgtttgcctgtgctttaggcaagaatatacacaacaaaatttatataatttgcatgcgtttccagcagtctttggagtctgtttatcacaagtacttcacacaaccacatagaaatttatacagcggaaagtataataatggttatagagggttgtgaactcgtgatcaagtgcagtccttgcttttactgcgatttaagcagtaggagcccatctatgtcatccaaaaatcatctaggattcactgtccacaccttttcccccctttgttcaccaccctcaaagttccacaagcaccaaactcagccgtgattttgacgctcaagccgagccctgcaaggtgcaagcatcttgaagccagtggccgtgaagtcgtcatcaacatacagttcagagtcgtatccttgaggggctcgtcgatgccacgttcaacacactgttaccagaactcagactcgagagtcggaatcttactcggactcgggtgtccaactcggcaaactctagaaaataggatccgggaactcgtctaacatatataatttttttattaaaaatattacatagtaataccaaataccaacaccatagttggtcaaacacttaaaactttaatatcagtagtcttgtgcacaaaggatccaattgctttgtatcttgtgccgctgaacagtgacgtattgcaaaaaaggagaaaagatggtgcatatgctacagcctacagatactctcttctctctagcctgcggctatccctcttccagagcctgaaaaagctacaacttgactctctttcccagcccttctcttactttacctcctacaccaagtcatcttccctactagaacaactagagttttctctaccatacagcggctgcagagcccctgcaactcctctctcccaccttgggactcgccaacccacgtcagatgcgtgtcgtcccgagtcggacgcgagtcgacacgcagatacacgtcgacgcggcaaatttttttcctgacacgtgtgtcccggtaacactggttcaacactaaggccagacaagcacttgccagtggcagcaaggtgctcattgatatgaagctcattgacctgcgcttgaaactgtctctgcatcgcagcagccattgtgagctccttcaagagatcagataatgctggttaaggctgcgtggcattgggtttgctgcctgacagagctctctggagtggaccaggtgggattgacatgttgtccctaaggaaggacttgccgtttgatctcttttggaaggggctacttctaaagttgactgcacctgatgtcctgatccccatccgtgtagggacatggagaactcaattagtgtttaatatttgttctgtgttttgagaataggacgctgtccagaattttaagcaaactataagaaaaatcaaggagataatttcaaagggaatgaattgctagtaccgagcatggtaggaggggttatccacacgtaaaaaaagggacgactcagtgaagacgttcaagaattatgctttcgtggaagtatcttgttagtttcaacagattgcaatgtacagattttcttatgcctacgatctagaggtaagcagagggcgttgagggttcgccggcttacgttggcgccgcggccagcggcagcgaaggcgtcgacggcctgagacagcgtcgtcttcgtgacaggaacaggaagatcgcgatgctcggactcggcaaaaactttcacggttcgtcgagatggccggctacaccaaccaaaccaaagactacttacatggatcccctttttcaccactgtgggcagacagcgataaagaatccgtctggtcctcgtcttcgtactcgacggcggtgttcataagggaggctaacgagactggcttcatggtggaaaagctcctacaggcagaataagatatttctcttttagggcacaagatgggtttgacggcaaggcgagtgaacgaattgatggtcagtcatcgcttggcttgtcttccttggcgtggtcggctgccagtgcccagggtttcatcgtcgctaaccattggggacgtcattgcttcggccaagcaaccaaaggtacgtcaactcttagtttcgatgcagcataattctccggtgatgtattccgcatcggcgagacttcagtctttgccggcggtgaggtatgctcgatccgatgatgtcagtgagtatccgagtcttctgggggatatgcaaatttcaaaatttggtttgttttcacgtgcaaaccaggcccattctcctccaaagcccaacataccctttaggcccatgctcgcattagtttccctactcgctagaacggggacttctcaacttgtggctcctagggttatcgccacacaatcgccatacacggacgttgtgcgcgagaaacaacatcaataatggagagaattgatgaagagacctatcgaggtggtgcaagaggtggaggtcaaggttcgtttgcggcaggcggaaggggtggtttccagggctttaatcacggctatgcaaccggtggtggctggtcatatggagtcggcgatcgtggtagatcgatggtggcagaggcaacaaagatcgtggcttctacgacggtcgccatggaggtgggagatacggtggccacttccaggggaattggcaaggcggtagaacggtcagcgctttccgatgttcacaggcaacatgccgccggtgtcgccaacgattggagtcgctggggcagcaagtgcaactggagtggctaggactggtgccgtagcttcgaagggtttggctacaacagctagtggcgtcgtcccaccgatggctacagcatcaggtggtcttcgtccactggctggagtgaccggcaaatggagcagtgtttggagtggccagagggcctaccttggccaacaatatggcaggaataggcagcatggctggcaacattgccggcggcatggcaagcatgggtggaggcatggtcagtggcgtggcgggcatggctggcggcaatgtggatggagggatgggatcgcaaggtgcagcaggtggggcacctagctctttgcctgcagctatcttgttcgcttagccaggtatgggcataataggtaatggggcagctgctgtcgtggcccaactgaggtctttgacagtggtggcgcatggaggttcaacacctatggttctaactgggattgagacaggaaagaagacaggtttgatagaggtccatgcaggaggtgtgacgagttcaggacagccgggagtgatgccagaagcgattgtgtcgcatggtggatcaatggctcaggtacatatgacaagtatggcaggggagaacattaatggtgatgtggacgttaaggctaaaatcccatattggtaccgttgctacacaaagggtcatacccttaaggagtgtgtaactcagcttttctgtaacatatgtgaaagtgctgaccatgtaacatctagtgtcctgtttttaaatcagcaaacaagcacatggcgtctttgtgtggttatgcggtggatggcttgggattctattatatccctcttcctgcaggtcagaaggtgaagcatgagtctaatgtagctttgatacatattacaaaaggggttctaacagtgatgaatgtgacatcggagttagataggttgattccaagtaaatggaaatgggaggtttatgataatggtaacaatacttttagaactatctttccttctaaggtggaattgcagagaatggtagaatgggggcaagtgaatactaagtttgtgaaagctaagatggaaatgaaggagagagatgttgggaatgagataaaatatgctattccaaaggtgtggatacagtggattaactaaaggagctaagggaatactagatcatatgggctgttgggttcattcttggtgtcaccgagatagtggatatgaagttgaccaagagatatgatgcagcccatttgcaagttctggttctagatcattctttaattcctgaatctgttgatgtgataattggagatttcttatacgaacttcaatttaaagttgggcctaagaatgatgatgaaccggtgcctatggagatggataattttgatggtcctaatgatgacacaaagaaagagggggatgatttggatggaaagaatggtaagaaatcattatggtaagggaaaggagttatctaagtccaatgatggaaaatcttctggagttaaaattggggcacctacacagatatgggactgacggtttctgatgagtatgatggacttagaaaacacaatgatggtggagactggccagcaaccttcggcacttgtgctagcgacggttccgtaggtagtgggcaaatgattcggagcaggattctcttgagatggcagataagcttaaggtgatgtgcaacctagagattctatcttcaaaaggtaatagcttagttcataattcttttttgcaattttctgatgagcaattaactagtaaggtcactaaattgggaattatgttgggggtgatgatacttgtgttaggactatactacatgatagtaaatcttcagaacttttacgggttacaaaatgttaacatgcaagaaaattgacatgttaatgttgaagtggaagaggatgaaatgctagttgaacaggaatgtcatgatattatggaggaggtaatggatgtgggtggtgatcacttgtgtgattttaaagccataccatcttcagaactttcttgcctttttgtttaatgtcattatagatggtttaagtctaagagagttatatatgtctggaacgatatatacttgtgctaataatttgaatgtgcctacttatgaaaaacttgatagaattcttatgtctaccgaatgggagcataagtttcctctttctactgtcaatgttcttactagagacatttcagcaagcaaactcacatctgtctctaaagaaagatccattttgttcgtgctgaaggtttctccgtggaacaatccacgacttaatccatatatatctgatactatgtggtttccaactaacaaacaaacaatgcatgcaagctccacgagatgcggctaaggaagagcaaacttacttgacgatgtcgaaacggtcacggccgaagttcatacaggcattcttgacagtggtccagtccctagagaagtcaaaaccagtctcttgagtgacttccgctaggtccattggcacggcggcggcgacgcagccctcgtcagcgccgccggtgcccccaaggtcgaagtatttctgctgcgccagccgatccatcagctcgatccactccggccagggatgcacgagctccacttccctccttagcacctccgccacgctcatcctctccagctcctcctttccggcaacgtccaccgcctcaggttccttcttcaccggctcgccaggttcgggtgccggtcgcggctccgcctccgccggcagcacgtccggaagcgcggcggggcggcgccaggactggatgcggcggagggccgcgtcgcgggcggagtggtcggagaagcgggagcggtcgagggcatcgagttggtcgaacacgaacgagaggcgggcggagagggaagggggcttcgccggtgagagggacgaagggcaatgggaaaaggaggaggaaaggaggcgggggaggagcggggggagggtggggatggtgcagcggcggcggcggcggcggagaagcgatagaacgtaggaagaagccatgatgtgatttcgtggtctccgtggtccgtggtataggtggccaaacaggctgcgcacggcccgccccactcaccactaaaccccgtgaggtggtggaataagtccacttaacctcccttaaccagtggccaaatctaattcttatccctgaactacaaaatattagatatctctaatcctagctattaaaactagtgcaatttgactttctctctctctcaactgttttgaagggtaatttctttaacatggcactttaactaggtccaacctgttgagtcaccctgtgagacccacccgtcagtgttagaataggtgtcgaatatactagtcctaattggttacagttggacttggagttataataggtggtgggggtgaagttagagtcggactctataacccggcaactctcttaaatagagaggaggcaccacaatataaccatggtgactacaatatagcgtaggcacgcagggagatgatggtgcgcggctatagactcgtagcagctatgagctatattgattggggaggcgcgcccataaccagagccccgaggatgtaagcttcggctgaacctcgttaacaaatatcgtgggttcctgtgttgccatctggcatgtcttagctgatcaatgactgaagcgatcgagaaagttagtcgtcgttccgctatattgactaacttttataacaagtggtatcatagcagaagttttcaacattggaccaagaagacatgtggaggaggaaacacaaggtgaggatcgcacatcgacagaagatcgtcagccatggcgatgagatcgatgacgacaacgaggacgtcgcggagacgatgacctcactcacgattagacaggtccaggtgtggctgaaggcgaccagagagattggaggggtagcgctatggacgacgcgcccaacgcacgcggcgatcgcggatccgcgactgatgtgaccatggctactacggatacatccgttgctcacatcatagatgaacaacaagatatcaagttcgagtcctccaagtgctagaatccaattcggccaccgctacactgctgacttcaaacggccgtcgaatctgcatacgacctccgtttttggcccatgagtacttgatggaaagctctcggagtcctctttgatctagcctcattgccaaattccatctcagtcggcagaaactgaagaaacaaggtgctgcgacacctgtaatggccctatgggcttgtaacttcgtctgggactccgcccaagtggggcccatgtggggtgcgcaccaacccagtggaggatgacctagaggacctcccacctacttaaataggtaggtagccctttagagttttttgggttttgatagattaaagtttagctattgctacttggttgcagggcacgtgtcggctagaccgtccgtttggttgtttttcggaaccccaacttatcatttgtattaaattcctatttgcaatatcagattgcttttatcttgttcttgcttgtttcttcgatttgcttgcaggaaaagggttgatctgcaccggcaagatcaacaacccacggagaggtgtatcgatcgctaaggcgcaacacaacgtctcgtacggttgtagtcgggtcgtcaacgtgtctcccaaatcgtagttatctcaactcaccgaaagatcgggccaacaacagccttgagtgtcgagtggaactcagggttcatcagcgacggcagggaggccagtgatggaagggtgaagtcagcgagcgcggcatggcgcggcggacatgcagggccgggacgatggggtcgtggacggtgaccacgagggctgcggactgcgatgcgtaagagaggcacggacggcgtacacaaagtgcacgtcatatgcacacaagctacaccaatgagcaatgcaacggatagagaacagaggagttgctggcacattgtattggaagcacggcaaggatacatgcatgcacttgccatgcatattccgaggtggcaatctgatgcatgtacagggagacatcaatagctctgctctagcgccgtgtagcctagtgccgccgtcaccgccgttcgtccagccgtgtgccaccgtcgctctggtcgtcgtcgtcgctcgggaaagccgccgtcgtgatcgtcaagtcgtcgccgacctcgtccacccctccgtcgtcgctgtagatcgccggagccccgccgtcgtcgtcaagctgaaggtcgccgccgcttcttcctcgtcgccgtcgccgtccgttgaccttccgccgctgttttggtcaccggtgagttttccacgtcgcccgcaacccgtaggtgtccttcgttcgcgccgccgcgccgtcgttcgccggcgagcatgcgaggccgagccgccgtcggtgatgacgtcatcgctgacgtcatcgacgccgtccgtcgtagatcggtcgtagaccgttagatcttggccatccgttttggatagatcgatcacggccgtttgtttccgtgaaccgccgccatgcacccggtccaccgtgagccgacccgctgacgcaataatcccctttttccttttcaaaaataattcattattgcgtcataattcaattaaaatctatataaatgttttaatccgattaaatctttgaaaattcataactaattcatcttagctcggatttagttggttcaagtctctaatttttctaaaattgagatctacatgttaaaaatatccacatatactgttcatgcttgtttatgtgctgttttggtgattttgttcttttctctttagattccgacgttcccgagagtctgaatttgcaagagaagactttgaagagttccaaggccagcaaggcaagtcacacagatcccaaacaatcctttgagcatgttgatcccgtttaaagctattgtttctattcaactattgcatttatttttgaatgtcattgggtggaaataacctattgctttgttatagcccttttgttcttgattaccctattctttgataccttgggttattataacttgactagttgagctttatatatatggattcagctggatattagatataattgcttagccatgcttagaaacattggcacactactgggataacttatgcttcactattatttaatgatggcttaatggtagctcattatggttaatcatgattggttaattaattaatttgccaactaaaacctgataatggtgggttgtgagcatatggttttgatggttgtgctcatgacaattaaggaccggttcacgatttttgattgtgaaacatttaccgtgccaaccacaagccagcgtgggcaacggctttactttatgtatagtatggttcatagtagagcaccagactgtgaagtggcggagataagcccacgggggtcgctggggagtccataccttgtttataagggggtgattatgatctaggaacggtacactgctttgaattgtattatatagagggtattgttacaatctctattcgggtacttgtcaagtatcgtgacgcatggttgacatgatgttaaggttgtgtcttgtgggtacagtggtacacctctggccagagtttaaactattcgaatagccgtgcccgtggttatgggcgggtctaacaatgtctttcgtgattagtcttacatttctcaccatattaatttatgatgttaataacttgtttagctcctggtttggaatggttaattcctggtttggagatagaactgtgtagccgggattggttgttcagaatggttgggcctatgcaacagggtatgttgtatagcattggattaatattgtttaattattatttaactgttttattaaattctgaaatatttgttaaatgctatttatgcaaatgagactatactatgccatcctttgttatcctgtgcacttgcatatttgctgcgtggcttgctgagtatgtcatatactcaccttgcaatcattcatcagaggaggagttctacagtgatactgatggtgtggaggattaggcctagtcctggtcaagctgcctgtggagaggagtcgcttgcgctgtttcttttattttccgctgcttagaactttattgattgagaggaactatctacctctgtaatgacattttattcgcttattaattagagtaataattgtactctattatcaatttgttattgtgtgcctcggctgattcctggacgagggtttacacacatgtaagcgtttggaattttggatagaaattctgggcgtgacaagttggtatcagagcctccttgaccctaggttatgccaaatggttacctatagaagccctctaaaaatgttgaaaagtagaattgttctcctctctttctcttttatttaaaccaaactaatggcacatgcagtttataattcctttaattgttctcattcaaaatttatttattattccggtgttgttagtactgtaca

SEQ ID NO: 26346 - DNA, 38778 bp, Oryza sativa
ctcccttcactgtctttaatgccgtgctacaagcctgagtacttgtttggtactgaaggatttgtccaggatttgtccaggagttgcgtacgatgtctttcctcataggatttgggactgcccctttgtatgcccagattcctcatgattgtgatgaagagaagtgccgtgtcaaagtcactttgaacagtaatcgtgaagatatcccttcggtgatgttcgaggctggagggggaagctacattcatgcttgtcaggaggtggcaaggatcgccataggagagctccacgaaagctacaacgatcggttggctgacaccgagtatcgctaccatcctcgtcaaccccagggaagtgaccgtggcagctaccttgaacctgcagagattgagaatgatgctaccacaaggcatttggttgagatgctgtgggccatggatgaaacccgtgctgagattgtgatagcagctcaagattgtgaagaccggaatcgcgggaagatttgcaagctggaggacaaggtggatcgtttggagaaggagctagcagcattgaagggagaagcaccaccgcagaaggccagggttcgtcttacagcaaggaagagagctctattcgtccctcgctaccagttggcgccaaaggttcgtgtggtggaaaaagaagctaccccagccccagtggatcctccggtcgtcaacgtgagtgatgatgatgaagaagaatccaagcgcacccattccaaggtcgagtggggagctactcaagatgatggggatgtgcgaacgagccttcaatcaactctgatgcccggaagacctagaacgccttgtcaagtcgttgccttagatcgttgtgttagtttgtttgtttaagtttggttgtgtgtgtgggtcttgcatgtgatttaatcattggtgggatgtaaatgcatgcgtttgtttgctttcgtgtgttagggagctggtgagtttaatggtgtgagagtcttcagttttgtaataatgaaactcagttaagatcaataaaagttaaactagtaaattccctgtcctaagtagtttttcccctgtttctcttcttgtgctcctatctatgccagatggtgcttactcgcagcaacgggaatggccccaaccccaacaaaaacaacaacaatgcagagaatcccacgcttgctcaagtcctggcccaacaggcacagcttaagaatctgatgatgcagcaactccagaaccagcagaaccagggaaacaaccatgcacctcccccgaataagctggtagaatttcttcgcgtgaggccgcctactttatctagcaccaccaatcctattgaagctggtgattggctgcacgccatagagaagaagttggacctacttcagtgcactgatcaagagaaagtctcttttgcttcacatcggcttcatggccctgcctctgaatggtgggatcacttccgtctcaacaggactacagctgaaccaatcacttggcttgagttcactgctgcttttcgtaagacgcatataccctcgggagtagtgtctctcaagaagaaggagttcagggcgctcactcagggatctcgctctgtcactaaatatctgcatgaatttaatcgtctggctcgttatgctccggaagatgtgcgcattgatgaagagcgccaagagaagttcttagaagggctgaatgatgagctttctaacccactcatgactggggattatcatgatttccagaagttggtggataaggctattcgccaggaggacaagtacaaccgcatggagcagaagaaacgccggattgctcacttcaaggctcagcaggggaatagtcagaggccgcgtcttgctatgggaccttagtcagtgccacagggaggttcttcgtctgttgttcgtccgcagcgtcagttcttcaacaacaatgctggcaacaacaaccgcaaccaagctccacgccctgttgcagctccgacacagcatcagcctgccaagagggagcaaggcagtaagcccggggtgtgcttcaactgtggagacccaggacattatgctgacaagtgtccgaagccccaccgcgcgaaggttgtccctgctcagaacaacccctccgcaccagcgacaaaggctcgtgtcaaccatgttgctgccgcagaagcccaaggtgctccagatgtgattttgggtacgttccctgttaactcagttcctgcaacagtgcttttcgattctggtgctacgcattcctttttatctttgagttttgcgggaaatcatgagatggaagtagaagatcttagacgtcctttgatggttagtacaccgagtaaccaagcactctcatcacaacgtagcccctctgtcagaatagagattcaaggagtaccatttttggccaaccttattctgttagaatccaaagaccttgatgtcatcctagggatggactggttagccaaatataaaggtgtgatagactgtgccaatagaaaagtaactctcaccagcaatgatggtcaagttgtaactgttcatgcattgccttctgagcctttaaggtcaagtctgaaccaaataactttggaagagattcctatagtacaggagtacccggatgtgttcccggatgatttacctggtatgccgcccaagagagatatagaattcagaatagatctggtaccaggaacaactccgatccataagagaccttatagaatggcagccaatgaattagcagaagtcaagaggaaagtagatgatttgcttcagaaaggatatatcagaccgagttcgtctccgtggggagctccagtgatctttgtggaaaagaaagatcatacccagaggatgtgtgtggactatcgtgaactaaatgatgtgactatcaagaataagtacccgctgcccagaattgatgatttgtttgatcagcttaaaggtgccaccgttttctccaagatagatcttcgatcagggtatcatcagttgaggattaaagaggaagacatacctaagatagcttttaccactacgtatgggttgtttgaatgtactgttatgtcttttggacttaccaatgcccccgctttcttcatgaacttgatgaacaaggtgtttatggaatacctagacaagttcgtggtagtctttattgatgacattctcatttactcccgaaccaaagaagagcatgaagaacatcttcgtcttgcactagagaagctgcgagaacatcagttgtatgccaagtttagcaaatgtgaattctggttgtctgaagtgaagttccttgatcacgtcatctcagccgggggagttgccgttgatcctagtaatgtggaatccgtaaccaactagaaacaaccgaagacagtttcagagattcgtagttttctgggtctcgcaggttattactggaggttcatagagaatttttccaagattgccaagcccatgacacgactgcttcagaaagatgtgaagtacaagtggtcagaagagtgcgagcagtgttttcaagagttgaaaagtcgcctaatatcagcacccattttgattttgcctgatccaaagaagggtttccaagtgtattgcgatgcatccaagcttgggttaggttgtgttctgatgcaagatgggaaggtggttgcctatgcatctcgtcagttacgcccgcatgagaagaactaccctactcatgatcttgagttagccgcagtggttcatgcgttgaagatttggcgtcactatctttttggtactcgtacggaggtgtatacggatcacaaaagtttgaagtatattttcacccagccggatctgaacatgagacagcggagatggttggaattgattaaggattatgatatgggaattcattattgtaacatcctgaaaatgtgtcattttctaatcttgcatcatgctgattcttatgttcttaataaccttttaaacctaggaaaatatacttagcgggacttcctaaaattaactcgcataaaacctctctggtatttaatcccttttgtgtttttcatttaaaaacatatttggtatttcttgttggaattctattttcgaatattaaaccttctttcgactaaaactcttttattcaaatttagtttgaaaaccatttttactattgcaaattatggtccaagaaatcctccaatttttgtccttgaacctagaccaaagtaattccaatctcattggaattaattgttagcccatcctttgatcctaaacccatcctttgattctcgatccaaatatccaaattcctccttttgatctagccaccaatttaatttatgtggcttgatttcctcttcggcacaagaatagtattattgcaaatattgtgaataattgctcttgtgctaagaaaattccaacttatactcttcattcaactttctcttttagccacaaatacacatcacaccaattttagaattcaaatcctatttattgccttcaactaattcccttcaatattcccaaaaatattttgaggaatattattaacttcccttcctatttgagtgcttccaaataaattccctcaaactccacctctaaatattgcactcaaataaattaggaaatctcttttgtgaattctttccaaattcaaattctttgcaaaacctagttatccaaatcaggtattcaaattagacttctttctttttgtcatcgggccgaaactccattctttcttcctttttggccaaattccttttcttttatcttctattttcctcctccttcttgggctgccggcccagctaagccgagccggcccaaaccagcccacaccccaaccgagccgccccctcctcccgtgcgcgtgtcgtgcacggctcacgccgccgccaactcctcttccttcgccgctaaggaaacgaagccggccgccgtagttcgaatcttcacgccatcgtcgcccgtgcacttctcgatctcctcctccacaaccgcctttcaccaccgcctctctcccctataaatagctggccatccctccccttctctacatacaatcagagctccatctctctctctttctctcccatgtccggccatggtcgccaccacccgatctccctcaccggagcttcgcaagccaaaccatcgcgccatcgagttcgcctcgacgaggtgattccatttttcccgttttccccttcccccccactccatagcaaccaccaccgccacctctctttgccgccgaagacaagctcttgactgcgccgttccggccaactccttcactctctccgccagccaccgccctccccgggtgtgtcttgctcgggaacacgcgtggacgccgacgtcgccgccctccagccaccggagcgccgccgccccgctcgccttctcctctctcttctctcggctctctctctggaacagagaagagaagaagaagaagacgagagaaggagagagaaaaagaaaaggagatcgacaggtgggcccatcaacagtaacttttcgtattttctagatttaattcaaatcccaatctttagaagcctatgtctcctaaaccgtagatccgattccagtgaaatttggacctaaattcatctaatttcaaactcttcattttgatgtcaaattttctattttaagattttatttgaattttcttaatttattcaaataccatttgaataaatatttgatttaatgttataattgaatttacaacttaaacttatatttgcttttcaaatattttcttttatttccaaaataccctgtagccactaaaaagccgccggttggaactttacgccttccatggggacgtttgcgcagtctacggacctcaacgtcggatcgttggttgtaaagcccggcatcaaccaaacccaaggtcgaagtgctgctcctggcaccccacgccttgatgcgtacagcggtcggagcttcactatcccctcgacctccattgcacgccgcactgttagctcttgagctctgtgtgatcctagccgctctgctgccactcacggttgtcggagtaacacttccgtcccactaaacctgcacccacctcctatcttctagccgatatgctgtctatcgcacggttagaaatgataccaaacctagtcgtcatgctgcccaactctagcgacgactagcaaacacctaaaaccctagccgatatttatcctacctcgaaatcggcataaacaactaaatcctagccactatctatcaaagccaaccttgacccatgttagccacatgcctatttaaccatatcaactatctagtgtatttcctatcgtccaaaccacgagagcctccacataaaatatagagcctagccgatatgctatcctactccacaaacgactcccatacaactaaaccctaggtattataccacctaaacctaccactagcaaatactagccccataatccctataccctataaaagagataggttataccttaaaccctagccctcttaaccgtttatcgttttcttattattttatggcttttattgaaattagttcttcctctttctcagtagagtctattgtcttttggatggcaacctatggtatttcgagaatcggataatcaggttgcctatgttggatttattgcgttggagcaaggcaagttattattcctcccctttgaacataaatgtcctgtattctatatttctattctatgcattagtcattcatgatttggaatgcataatctaaacatatagcaaatcggttatatgctagcttttgcttagccctgcctagttagactgcataaaacataatgaacttagattgggacagtacgtaagatttggttgatttccgggtggctagtactgtctcggtcgatataagtttaccaagtacttatgtcaaacgaacgagtacgaccgcagcttctagaatggggacagacctagatattatgttaattaacaatgtggtacctctgtacagtggttcttatgtaagtcctcgcgaaggaggcaaatatatgccgcgaagggcaaatgtgatatttaccgaggcgcaggtaaatatcttgattatcgcgcgatgtgtgtgtgaatttatgagaacctggttgagatgacgtggggtctctcatccagttctctctaaaaaccctgggaacgccagaacttctctcgctgctgataacgttactttcagagcgcatggggactagagttcatggaacaggtgccacaattgttaacaacataatactgggccatgactaagctaatgattattggcaagtcgtggactgcgggtaaagcgtacatctactgcagtatgaatatccttgaatctattcgaatagccgtgcttacggattgagcatcgggactcatatggtactttggttagaaatataattcaagattttcttaaatactgttgcatatcaaacatttcaggagttctacctctttattctcagccttctgcaagtaaatctagctctacacagatattacctctcatgcattcattgttgaataatataatagcttgctgagtacgttgtactcacccttgcttcaacccctctttttcagagtttaattggagtttttgccgaagctgggagttcaatcacataagttagttccctttaaacctagtcttcaagtctagtagtatagttagatggtttaattctatagtaaaacgacagagttgagtcatcatatagcttctgctgtaatagttagccacaaacttgtaaatgtcctattattttatataaagatatctcctttggagtctttaccaaatgtatgcgatgaagatctagattgttgaacctgtatcaatctactgatccagggcttgaaacagttaaacatgtcggtttccgaatcattagttttgggagccgacaattatcacccgggaaaggctaatgttgtagcagatgctctcagcaggaaaggctattgtaatgctacagaaggacgacagttgccgttggagttatgcaaggaatttgaaagattaaatttgggaattgtcagtagaggtttcgttgcagccttagaagcgaagcccaccctcattgattgtcacaccccgaagttctttcccaagcctaaattggagttttaaatggtctcaagaaaataccagtgtaaagcaagagtaaaccttaataaattaataaaaataataatcggaattagcatgtggaatttttcttgagttctacatgtcgaaatacgctaacaagatttttagtggaattttcagagccctcgaaataattttaaccaattaaaattgagcacatgcaattttaaatcctagggaaaatcttttcctccttttctttttcttttccctccttttcctcttcttgggccgtcggcctagtccatcagccgccgccgcgcacgccctcctccttgtgggccggcccaagccgccttccctctctccccgggacgtcgacaggtgggccccacctgttggggtcgtccccttcctccggccgcccgtccccacgtcgccaccaccgccgaaaccgccgccgctcccacgtcccgcctcctccgggccacgtcggccacgcccgtgtatgcgccgcgtctcctgcacccactcccccctctctcccgctcgctcccgcgcccgagatggccgggattcgaattccgaatcccgcctctctctctacctccacctcccccacgtcggccggcgaatcccgcccctaccggccacgtccgagttccccctcccctatttaagctccaccgccaccccctctctctttttctccatctcgctgaactctctcgtgctccccatcgctcccgcacggtgcatccacccgccgccgcctttcccgccactccggccgcctctagccgccgttaggctcgccgccacaccgcgccgtcgccgccgttgggttcgagtggccgagatccaccccgtccacccctcctcagtcgaggtttgccgccggagcgccattcccgccgtgcgacggtgagagccgccatgtccgccgccttcggccagcgttcccgccttctatggcccctctctccctctctaatcttttccttttcgttctttaggtcgtcccggaccccgtccgacgcttgtcgacctccttacgtcactcctcgtctccggtcatcgccgccccctccggtgaggactccctcccctttcctttccttccccgtttccccgtgcgccgccgccacccgtgttcgccgtcgccttcggtcgtcgccgctgctggggcaccgtccgctgccgccgcccgcgccgccgcttgccgtcgccggtcgacgcgcgcgcgccgccgcccttgccatggccggccggccagctttgtgccgagccgagccgagccaggccgccgccgcaccgtccgatcggccccgggccgatccgggccgtcgatcccgtggaccggcggtggaccacccgcgtggtcccggtccacggtataccggccaccccttgcgccactgacatgcgggtcccgcctgtcggcgccgacccccccttgatgatgtcagccctgggacttattgcgcaataaatgatttaaggactttttttatagtaataaacacagtgaatcttctaaaaatcataactaattcatccgtgctccgtttaagcccattgaagtctcagtaaatcaagaaaaatgtgtagaatccattaaaaatggttttgttctctatttcagtagtcttatagcctgtttgcattgtttgccttgtatgtcgcttagattccggttcttctgacgctccggtgtacttcgagatagttgccgaggttcctccagcagcagagcaaggcaagtcatgtttgtcacttgaacatgttgatcctatattgcaaatgctctattgtttttcttcaaatactgcattgttttataatgttactatgggatgttcacctattgttacagccatgctattttggtaccatgctccttgttagcttgggttataacatgaatagactttggactaggaattgcttagccatgcttagttcaactagcacacaatgagggagatcctattaatgtttagactgtaggttctaatggtaatgttggattagtaccaccgctttggtgttgattaattaaaatgaatcacatggtgggctgtgggtgcatggttttgctagtcgcacccatggcaattaaggaccggttcatgggatgccctggaagaacttatcgtacttaccacaagccagcgtgggcaacagctgggcttgtagtgtagctttcctctagctgacgcatccaggcaagggtgggcgtgatggagcgggacgggccctgcgacggcctctgtcacttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggcacacggaaacgtgtcgtggggctgtgtcttgtgggtacagttgtacacctctgatcagagtaaaactattcgaatagccgtgcaggcggttatgggcggtcaaccagattcaccgtgattagtttcaccctagtgtagtctaatgaaattggatagtttaggtggatggttgggcctgttgcaacgtgggatagcgttggacagtggatgattaatattgattaattattacaactgtttacttctttaaacttctgtttataaatgcctgctttatgcaaatgaaccaatatagctaccccttgataattccctgcatcatacccctattccggtatgacttgctgagtacagtgggtagtactcagtcttgctctattttccccaaccccagagtatgagtatgtgtcagatggtggtttctccaaggagtaggcttcgtccgtgccgtcgaggatgcctgtggagtggtgttcccgctgcagatcaagtcaaggcttagctccagttatctctcgtttttctgctgcatttatgtaagactttgataatgtttgtaagacgtggatctaaatgtcaacattgtcgtttgtgtaccccggccggtcctggacggggattttaatgcacattctgcttggaattctattcgggaatttctgggcgtgacaagttggtatcagagccgaccttgaccataggacaagccaaatggaaaaacctaagagccctctgaatccttttcattgcatatgttttttgcaattggatttgtttcgggaaaattggggtctgttcttgtggttcaagggaaaaatcttggtcactcgtttaagtgagatttgtcaaaacaagttagtctagggtttcagtaaaattatttgagatattttcgacagtcagttgggatttgatgggtgaaatgcattaggtcctagctcaggaatatgggttgcaaggtatttatgcttttattgttattattagtatgtctctaatttccccattattttatcgttatgtaagtctgtcttatttattcgctctcatgcaaaatgatccatgcataaaatttcgttcttattcgcttctcttatttgagtttttattgctttgtttaaaattgggtttgagcatgcattgatcctactcctttgttttctctagatggccgaccacccacccaaccaccgcggagaaggcatggatgatttcgtggcagaattggctcgcatcacactggtggtgggctaccccaacgcgccagagtacacgactgttccaccgctcagtggcgagcttcctcaccgtgtccgcctggaggtccatggctttgtgggcacctgcctcgctaatatggtggttgaggcgtccggaggcacagcagatcacgcctgtcaggaggtagcatacctgatgatggccagactacaggagcaccacaactacatcttccacgacacggcgtaccgatttcaccctcgtcgagccagcggtgatgatgtcagtactttccatccgacagccggcgagaacgacaccacctttggtcacatgtgcgccgtgatgagggggatggacaggatgcactcggatctacacaaggcgtccaaggccttgaacgatgggaagctcgtgaggatcatagctctgaaggatgagatagcacgcctgaagaaggagaatgctcagttgaagggtctcccagcgccagcaggagtccggatccgcaccacgccccgcaagacgacgactgcacccgtgtgcattcagcttgcgcccaggaacccacctccgcccgcaattcctgcagctccagctctagccccagctccagttccagtgtcagctcccgcgttcgctctctccttcgctctagcgtcagcagccaggggcccagctagtggcaacgggggttggttgcctgctactcccagtggcagccgcgaccatagcagcagcagttctagtggcacagagccgggcagtggcgagacgtatctgccagactccaggagccgcttagagggacctggtgacgagcaggaggacgccttcgactccaccgaccgcaggagccgttccaagcattaggctcgctttccattagtttatcgactgtctagcttctgcttgttagtttgcgtatttaggttgcttgcttgtgggttagtcgacagtcgatatcatgtgcctatgatatggctgtcttaataaggatttttgcttgctttttaagtgttttaattcatatcagaacaattgtagtttaaattcctatataataaagcttagttcttgagcatctgcttttcttcttttccaccgtccgctcttcctccagatggtctacaccaggaatggtagccgtacaacaggcgagggcagcaacggcgaagagcgcactgatggtgtgcatcccaacagcgtttccggcaatggtccgccaccactccccgagaatccgacccttgcccaagtaatggctcatcagacgtagatgatgacagccatgatgcagcagatgcagcagcagcaccagcagatgtaccagaggatgcggcagcaagccgagcagcagcagcagcagtttggtccctctccccctcagtccaaactgccggagtttctacgcgtcagaccacccaccttttctagcaccaccaaccctatggaggcaaatgactggctccatgccatagagaagaagctaaatctcctgcagtgcaatgatcaggagaaggccgccttcaccacacaccagctccagggtcccgcatcagcttggtgggacaatcacatggccacacgtccgccaggcacggaagtcacttgggtggagttctgccgcagcttcaggaaggcgcaggtgccagatggggtcgtggcacaaaagaagagagaattccgagcactccaccagggcaacaggacggtgacggagtatctccatgagttcaatcgcctcgcgcgatatgcaccggaggatgtccgtactgacgccgagaagcaggagaaattcctagcaggtctggatgatgagctaaccaaccagttgatatctggagactacgccgacttcgagaggctggttgacaaggcaatccgtcaggaggatcagcgcaacaaaatggataggaagaggaaggcggcgcagttccggtccaaccaagggagccaccagcgaccgcgcttcactcccggacagcagggtggacctaccaccctgatcgtccactagcaccgccctttcaatgccagcaacttccatcagggcgctagtggcagccagaaccaccatggcggtcagcccaaccgcagtgcagctccacgcccaccaatggcaccagcacagtcagcttcgtccacgcaagccaagaaggagactgggacaaagccagggtcctgcttcaactgtggcgagcttggccacttcgctaacaaatgcccgaagcctaggcgtgctgggccaaggtttgtccaggctcgtgtcaaccacgcgtctgcggaggaggcacaagtagcaccagaggtcgtactgggtacgtttcctgttaactcaatccctgcaacagtactttttgattctggtgcaacgcattcattcatttcaaagaagtttgtcgggatgcatgggttaataagagaggaacttagtacaccaatgcgggttcataccccagggaatagctccactttggttcaattcagcccctcggtaacgatagaaattcaaagatcactctttctggccaacctcatccttctcgaatccaaagacctagatgtcattcttggtatggattggctgaccaggtttaagggtgtcattgattgtgcgaatcgcacagtcaccttgaccaatgagaagggagaaaccgtggtgtacaagtcactagtctcaccaaagcaaggggtttccttgaatcagattaaggtggaaaaccctgtgaccaccgaggagaagggttcgcggaaattggaggatatccccatagtctgcgagtatccagaagtgttccctgaagacctcactaccatgcacccaagagagagattgaattccggattgatttggcaccaggaactgcccctatttacaagagaccgtacagaatggcggccaacgagctagcagaggtcaagaagcaggtcgatgagcagctgcagaaagggtacattcgaccaagtacttcaccttggggtgcaccggtcatttttgtggagaaaaaggataagacgaagaggatgtgcgtcgactatcgcgcactcaatgaggtcacaatcaagaacaaatatcctttaccgcggatcgatgatttctttgataagctgaaaggagctaaagtgttttctaagatagacttgtgatcaggctaccaccagttgagaattcgggaagaggatattccaaagacggccttcaccactcggtacgggctatatgagtgcacggttatgtctttcagacttaccaacgcacccgcattcttcatgaatctgatgaacaaagtgttcatggaatttctcaacaagtttgttgtggtgttcatcgacgacatacttatctattcaaaatctgaagaagaacataagcaacatctccgtctggtactcgagaagttgaaggagcaccagttatatgccaagttcagcaagtgtgacttcttgttgtcggaagtcaaatttctgggtcacgtcatcacagctcagggcgtggcagtcgatccgtcgaatgtggagtcagttaccaaatggaccccaccgaagaccgtgtcgcaaattcggagttttcttggacttgcgggttattaccgtcgattcattgaaaacttctcgaggatcgcccgacccatgactcagttgcttaagaaagatgagaagtttaaatggacagctgagtgtgacaagagttttgaggagttcaagaagaaattagtatccgccccagttctgattctgcccgaccagatgaaagacttccaagtctattgcgacgcatcccgccacgggcttggatgtgttctaatgtaagagggcagagtggtcgcatatgcctcgcggcagttgcgtccacatgaagggaattatccaactcatgacctggaattggcagcagtggttcatgctttgaagatctggaggcactatttgattggcaaccgctgcgaagtatatacggaccacaagagtctgaaatacatcttcacccaaccggacctaaatctccgacaacgaagatggttggaactaatcaaagactatgacatgagcattcactaccacccgggtaaagtcaatgtggtggcaaatgcgcgaagcaggaaaagctactgcaatgccctatgcatcgagggcatgtgtggagaattgcagcaggagcttgagcgtctcaacttgcgacttgttgaacacgggtacgtggctgccctagaggcacgacctacgctcgtggatcaagtcagagtagcccaagtgaatgatcctgagatagctgaactgaaaaagaatatgagggtcggaaaagcctgggacttccacgaagatgaacacggcacaatttggatgggagaaagattgtgtgtacctgacgacaagtaactgaaggatctgatactcaccaaggctcatcagactcagtactccatccatccaggcagcaccaaaatgtatcaagacctcaaagaaaagttttggtgagtcagcatgagaagggaaatagccgaattcgtcgcgctctgcgatgtttgccaacgagtgaaggaagagcaccaaaggccagcaggtttactccaacctcttcaaatcccggaatggaaatgggaggagattggaatggactttataacaggactgccccggacatcatcgggtcacgattcaatctaggtagtcgtggatcgactcactaaggttgctcacttcataccagtacataccacgtatacgggcaaaaggttggcagagctctacctctcgagaatcatgtgtctacatggagtacccaaaaagatagtatctgatcgagggagccaattcacttcaaagttctggcagaaattgcaagaggaattgggaacccggctgaatttctgcacagcctaccatccgcagacagatggtcagaccgaaagggtcaaccaaatcttggaagatatgctacgagcatgtgcactcgactttggtggagcatgggataaaagtctgccttatgccgaattcttgtacaacaacagctatcaggccagtctacaaatggcgccgttcgaagcgttgtatggccggaagtgccgcacacctctcttctgggatcaaacaggcgaacgtcaactgttcggaacggaagtgttaacagaagcagaggagaaagtcaggattgtcagagagaggctgaggattgcccagtctcgacagaaaagctacgtggacaaccgccgacgagagctcacgttttaagcaggggactatgtgtaccttcgtgttactccgctccggggagtgcaccgttttcagacgaaaggcaagttggcaccacgcttcgtgggaccatacaaaatcttggaacgaagaggagaagttgcgtttcagctataacttccatccaatatgatcggtatccatgacgtgttccaagtatcccaattaaagaagtgcttgagggtacccgaagaacaagccaattcggagcacatcgatatccaacaagatctgatatatgtggagaagacagttcgtatccttgagaccagcgaaaggaggactagaaacaaggtcaccaggttttgccggattcagtggagtcaccatttagaggaggaagcaacctggataagggaagatgagttgaacgccgcccatccgcacctcttcgccagcccctccgaatctcggggccgagattccgtttaagggggagtaggtttgtcacaccccgaagttctttcccaagcctaaattggagttttaaatggtctcaagaaaataccagtgtaaagcaatagtaaaccttaataaattaatgcaaataataatcagaattggcatgtggaatttttcttgagttctacatgtcgaaatacgctaacaagatttttagttgaattttcagagccctcgaaataattttaactaattaaaattgagcacatgcaattttaaatcccagggaaaatcttttcctccttttctttttcttttccctccttttcctcttcttgggccgtcggcccagtccatccgccgccgccgcgcgcgccctcctccttgtgggccggcccaagccgccttccctctctccccgggacgccgacaggtgggccccacctgtcggggtcgtccccttcctccggccacccgtccccacgtcgccaccaccgccaaaaccgccgccgcgcccacgtcccgcctcctccgggccacgtcggccacgtccgtgtatgcgccgcatctcccacacccactcccccctctctcccgctcgtgcccgcgcccgagatggccgggattcgaattccgaatcccgcctctctctccacctccacctcccccacgtcggccggcgaatcatgcccctactggccatgtccgagttccccctcccctatataagctccaccgccatcccctctctctttttccccatctcgccgaactctctcgtggtccccatcgctcccgcaccgtgcatccacccgctgccgcctttcccgccactccggccgcctctagccgccgctaggctcgccgccacaccgcgccgtcgcctccgttggttcgagtggccgagatccaccccgtccacccctccttcgtcgaggttcgccgccggagcgccattcccgccgtgcgacggtgagagccgccatgtccgtcgccttcggccggcgttcccgccttctatggcccctctctccctctctaatcttgtccttttcgttctttaggtcgtctcggaccccgtccaccgcttgtcgacctccctccatcgcctctcgtcgccggtcgtcgccgccccctccggtgaggactccctcccctttcctttccttccccgtttccccgtgcgccgccgccacccgcacttgccgtcgccttcggtcgtcgccgccgccggggagccgtccgccgccgccgcccttgccatggccggccggccggctttgtgccgagtcgagccgagccaggcagccaccgcaccgtccgatcggccctgggccgatccggaccgtcgatcctgtggaccggtggtggaccacccgcgtggtcccggtccacggtagaccggccaccccttgcgccactgacatgcgggtcccgcctgtcggcgctgacccccccccttgatgacgtcagccctaggacttattgcgcaataaatgatttaaggactttttgttatagtaataaacacagtgaatcttctaaaaatcataactaattcatccgtgctccgtttaagcccaatcatgtcttagtaaatcaagaaaaaattgtagaatccattaaaaatggttttgttctctgtttcagtagtcttatagcctgtttgcattgtttgccttgtatgtcgcttagattctggttcttccgacgctccggtgtacttcgagatagtcgccgaggttcctccagcagcagagcaaggtaagtcatgcttgtcacttgaacatgttgatcctatattgcaaatgctctattgtttttcttcaaatactgcattgttttataatgttactatgggatgttcacctattgttacaaccatgctattttggtaccatgctccttgttagcttgggttataacatgaatagactttggactaggaattgcttagccatgcttagttcaactagcacacaatgagggagatcctattaatgtttagactgtaggttctaatggtaatgttggattagtaccaccgctttggtgttgattaattaaaatgaatcacatggtgggctgtgggtgcatggttttgctagtcgcacccatggcaattaaggaccggttcgcgggatgccttggaagaacttatcgtacttaccacaagccagcgtgggcaacggctgggcttatagtgtagttttcctctagctgacgcatccaggcaagggtgggcgtgatggagcggggcgggccctacgacggcctttgtcgcttccggattcacctaggcacgagaggggactgcccgctgccttgcaaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagtgtagtctaatgaaattggatagtttaggtagatggttgggcctgttgcaatgtgggatagcgttggacagtggatgattaatattgattaattattacaactgtttacttctttaaacttctgtttataaatgcctgctttatgcaaatgaaccattatagctaccccttgataattccctgcatcatacccctattccggtatgacttgctgagtacagtgggtagtactcagtcttgctctatttaccccaaccccagagtatgagtatgtgtcagatggtggtttctccgaggagtaggcttcgtccgtgccgtcgaggatgcctgtggagtggtgttcccgctgcagatcaagtcaaggctttgctccagttatatctcgtttttccgctgcatttatgtaagactttgataatgtttgtaagacgtggatctgaatgtcaacattgtcgtttgtgtaccccggccggtcctggacggggattttaatgcacattctgcttggaattctattcgggaatttctgggcgtgacattgatcaagttagagaagctcaaatcaatgatcctgatattcatgagatcaagaagaatatgagacgaggaaaagctatcggtttcttggaagatgagcaaggaactgtatggttgggtgagaggatctgtgtcccagacaacaaagatttgaaagatgcaattttgaaggaagctcatgatactttatactccattcaccctggtagtactaagatataccaagacctcaaggaatgattttggtgggcaagtatgaagcgtgagatagcagaatatgtagcagtatgtgatgtttgtcagcgagtcaaggcagaacatcagaaacccgcaggttttttgcagcctttgaagataccagaatggaagtgggaggaaatcggtatggatttcatcactggtctacccagaatgtcatcgggccatgactctatttgggtgatagtcgatagacttaccaaagtggctcatttcatcctggtgaggaccacctattccggaagtcggttggcagaattgtatatggcaaggattgtgtgtttgcatggtgttcctaagaagatagtatccgatcgaggtagccagtttacttcaaagttttggaagaagcttcaggaagagatgggttccaagctgaactttagtactgcttatctccgcagacagacggacaaactgaaagggtaaatcagattttagaagacatgttgagagcttgtgctttagacttcggtggaagttgggataagaatttgccttacgcggaattctcgtacaacaacagttatcaagctagtcttcaaatggctccttatgaagcattgtatggtcggaagtgccgcactccgcttttgtgggatcaaacgggagaacgtcaggttttcgggactgatatcctaagggaagcagaagagaaggtaaagatcattcaagaaagattgcgtgtggctcagtctcgtcataagagttatgccgacaatcgccgcagagatttaagttttgaagaaggagatcatgtgtaccttcgtgtcacgcctctccgaggggttcatcgttttcacaccaaaggaaaattggcaccgcgttttgtgggaccttataagattgtcagtagaagaggagaggtcgcttatcagttggagttacctcaatctttggcaggagtccataatgtgttccatgtgtcgcagttgaaaaagtgtttaagggtacctaccgaagaagctaatcttgaacagataggagtccaagaggatctgacatatgttgagaaaccaatccgtatcttggaaacagatgagagaagaaccaggaatagagttatccgtttttgcaaggttcaatggagtaatcacttagaggaagaatctacttgggaacgagaagatgaattaaagtcagctatccgcatttgttcgccagttcttccgaatctcgaggacgagattccgttttagggggataggtttgtcacaccctaaaaatcccaaatatataaattgttgtttaattagaattattagaattgattttaaaagcctagaagagaagatctaattttaaataataaattccaatataaaagtgggctagataaaattttattaaatactttgcttgattctatagttcctagatttttctgagatttatttgagccaaggaagtatttttaataaatggaattgcatttcatgaataatttaaattgaaaaaggttttaaaaagttctcttttggctttgggccgaaagtcggcccaaacctctctctctctctccccggcccaagccggcccgcagtcgagcgccgctcgcgcgtgctcgcgcgtcctcccgctgagagggccgtcgtcaacctccagccgtcgcccggctgaaccctagccgagccgcgccgccgccgcccttccaaattcgttcatccctttctcgatccggtgaaattgatagagggaaaatgatccccgagatccactctaccttttctcttttgaaatcgtcggctaaaatcgtttggaaatctgtggattcgatctcgaatcggattcgtctctctccccgaaccctagactttccttcacaccgccggtcgtcgtgggcctccgccgccacccctagccgctataaaaggaccccggtgtctcctctacccgccgccaccctcgctttcgtctctcgccgccggtagagctctagcgccgtgtagcctagcgccgccgtcgccgccgttcgtccagccgtgcgccgccgtcgctccggtcgtcgtcatcgctcgggaaagccgccgtcgtgatcatcaagtcgtcgccgacctcgtccgccccttcgtcgtcgctgtagatcgccggagccccgccgtcgtcgtcaagccgaaggtcgccgccgcttcttcctcatcgtcgtcgccatccgatgaccttctgccgttgttttggtcaccggtgagttcgccgcgtcgccagcaacccgtaggtgtccttcatttgcgtcgccacgccgtcgttcaccggcgagcacgcgaggccgagccgccgttggtgatgacgtcatcgctgacgtcatcgacgccgtccgtcgtagaccggtcgtagaccgttagatcttggccgcccgttttggatagattgatcacggccgttcgtttccgtgatccgccgccatgcacccggtccaccgtgagccgacccgctgacgcaataatcccctttttccttttcaaaaataattcattattgtgtcataattcaattaaaatctatataaatgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgttcttttctctttagattccgacgttcccggagagtccgaatttgcaggagaagactttgaagagttccaaggccagcaaggcaagtcacacagatcccaaacaatcctttgagcatgttgatctcgtttaaagctattgtttctattcaacaattgcatttatttttgaatgtcattgggtggaaataacctattgctttgttatttcttgattaccctattctttgataccttgggttattataacttgactagttgagctttatatatatgggttcagctggatattagataacttatgcttagaaacattagcacactactgggataacttatgcttcactattatttaatgatggcttaatggtagctcatgatggttaatcatgattggttaattaattaatttgccaactaaaaattgataatggtgggttgtgagcatatgattttgatggttgtgctcatgacaattaaggaccggttcacgattttcggttgtgaaacatttaccgtgccaaccacaagccggcgtgggcaacggctttactttatgtatagcatggttcatagtagagcaccagactgtgaagtggcagagataagcccacgggggtcgctggggagtccataccttgtttataagggggtgattatgatccgggaacggtgcactgctttgaattgtattatatagagggtattgtcacaatctctatttgggtacttgtcaagtatcgcgacacatggttgacatgatgttgaggttgtgtcttgtgggtacagtggtacacctctggccggagtttaaactattcgaatagccgtgcccgcggttatgggcgtgtctaacaatgtctttcgtaattagtctcacatttctcaccatattaatttatgatgttaataacttgtttagctcctggtttagaatggttaattcctggtttggagatagaactgtgcagccgggattggttgttcagaatggttgggcctatgcaacagggtatgttgtatagcgttggattaatattgtttaattattatttaactgttttattaaattctgaaatatttgttaaatgctatttatgcaaatgagactatactatgccatcctttgttatcctgtgcacttgtatatttgctgcgtggcttgctaagtatgtcatatacttaccttgcaatcattcatcagaggaggagttctatagtgatgctgatggtgttgaggattaggcctagtcctggtcaagctacctgtggagaggagtcgcctgcgctgtttcttttattttccgctgcttagaactttattgattgagaggaactatctacctctgtaatgatattttattcgcttattaattagagtaataattgtactttattatcaatttgttattgtgtgcctcggctgattcatggacgagggtttacacacatgtaagcgtttggaattttggatagaaattccgggcgtgacagaaaagaaggacaatatctagacaatcaagccgttggacgtttcatagggtggtggataccctatataatctaggtcaacgttaatatttaacctaatcggctgccttccagtaatatatgttagctaattaaggattaaataacaatattgccagagattatataggatatatgataactcgacgatttacataaataggattagagtgtcataaagatggaagcactaatcccgagaacgcaagccgtcatgacaagtttacctctagttgaagatcgaaacgatgcaactcaacccgaaagcaagaattcgtcgagatgaaacgaaagtaaaaagggtggcgatgcgtcgagattgtattgaatgtgtgttgtttgattacataggttcgagtcatatttatacccgagatacaaaacatgtccttgtcggacacgactcttatctttaacaaactctaagacaccataagtctttacggcagacttttgcccaaacttatctctaaggaagttacataaaatattctaattaatagatacaattgccttttcaggactcaatccgtgcatggcaatccatatgaagcacattaactcaacccgacaacgtgtaccgagtcacattgtcggaatcggctcaatcggctaccttgtccgactcgaactctgtcgattctggtcgtagccgattcggacttcggccgattcttgctctgtttccggaacgatctatctcttagattccgctttgattttatcttcaccttcgatacttgaattaccaaatttggtcgctaacaaggataaatgatttaagagtttactacatgctaataattttatatattacctctgtatgatcattgtcctttgtaggcaacccatatttgttttctcttttatgtgaaaacagggtagtgcatgactggtttggatttgctgatcaatttcaaagagaatccggaatcactcctgagaagagccagacccagagtcatctctcctcaagtgactttatcagcaaccagatcagtcataccagcgtcatcaacacttaacgatatggctaagaagacccttcacaagttcactgctccctctgctgacaacatgcccgttggactcccgaagtcagcatgggagatggtgaaaaccagcctaatcacgatggtgtaggctagcccattatgtggcaagcctaataaggatgcaagtgctcatctccagtaattcctagatatctgtagcacggagtcagtccagatactatcaggctccgactgtttccgttctccttccttggaggagcgaaatagtggttctacgccaaccgtgcaatggtgaataccagaaataagtgctcaacgacattcctctcaaaattcttcctaatgggcaaaaaccaacgctcttcgtggaagaatatccagctttcagcggatgagggatgaaaccaatcctgaagcttgggaaaggctgcagtagtacgtcaccactcgtcctcatcggatggacgagtggctcatcctgcaaaatttcttcaatggattaatcctctagtcctgggatcacatggacgctgctgctggaaagacattcttctcaaatatggttagaggtgccactaacctgattgagaagatgatctcaaacataggttggagcaaggaacgactcttaacccatcaacgcggcatgcacaccatcatggagacggaaatgctcgctgctaagttggatctccttaaaaagagactagacaacagtgagaaatacgccaagcagggtactgttaaggccctgggctctcacatgacatgtaaggtctgtggaaatgacggtcactctgggacagatcgtccggaaacccataaggatgtcatgttcatgaataacaacaacggtatcgtccacaaagagatgaaggatggtacattgctccatagggaatattacgtacgaaccaaaaccaacagaacatgaggaaggtcaaagtaaaaccctgacggatagcctcatcgatttcatggtgaacttcctggagcgggaagaaacgaggatccgtcgatacctcaagttggcattcaagaagccgggaatacaggccggtcaacctgcgttcccagtttcgaagaggtcaccgaccgcaccaaaaacaaagaaggtgtggcgagttaaggagaaggcacccgtccctgtatctctggaaccgggtacctcatcaagctaaaacgatggaggtacgatcatgctcgtcggacctaaaacgatgtcgcccttgccaacaggtaaatttgtagttatcccatatttattttccgcattgcattagcgcatatttacctttttagtttttccattcaaagttttgcattttaatatgaatttggagacaacaaatttaaaataaatttatgagcaaaaataaaataaaattttcagccgcatggctaggggggagacattcataccaattcaactcaattctaatactctcccccaaattcatttgctctcaagttcatttcaacttagcctatctcaatcttcatttgctgcatttagtttagacacttggcatatacaagtttgctttagttcggtgcaaggttaatcggcgggtacttgcttaacccccgctcgagtagtcttgtaaccttgctctttgtagccatgaagaaacaattttcgggcatattcaagagaggatcaagcacacagttaaggcgacacgatgagcccagcacaccctcttccgccgatacatcgatggaggaggcggacgttccaccaaggctatacgacaactccgatctcgacctcatgggcgaccgggaactgcaagcctattacatgctaaaataccgaatgcttgctcacacccaagcatacgacctggaccttctgaaaaggataggtatggatgctgagtttcatactgtttggcgtgctttaggatgggataaatttgcatgtgtagatgaaccggttcccgtttgcttaccatgcagtttttatgtaccttgctaaaggtaggcgatggtgttaatttccggttattctgcaaggaatatcacctttcttggaaagaccttagcttgcatctaggctttgacaaaacatgcaaagttaatttcagtaacgcatttcctaattttaacaaacgtatgttttggcaaagtattttgggtctcccattctgtaaaaagcctagaactaatgacacccataatcctactcttaggcttatgcataagtggcttggttttactttgttccctagagccgatgtccagatagttcgtaaagacgaacttatcctcttgtatgccatggttaagagaattaaggtttcacccgttcagtgcatgattagtcagtggttagaaaacataaggttgaccggtcctgttgagtgtacatctttggttacccgtctagcatgtagagttggggctttgattaatatgcaagtatcttatattactactccccgctcttatgttgatgaggcctatttggttcaaggccacatactcaagcatggtccaaatgatactcttgtgtttttcttcctcggttatacaaatgagatcccgctacctaacccggggttttatttgtataactgccaagaactaaccatttctctccaagaggagttgtatcgtgatgtcccacgcagggtaacacgacgaatggcgatagaagcaccccaggaggcgtcttcctcttcaccaccagtgcggatgtatagagacagttgggacccaaccgcggatgcccccggttggaccaaagtcctgcagtatgatgccggagtttcgacctggcagagtgccagtgacaaccggtggtatgcataggagcactgggggtactcgcgttcctctagttcaagtggtctacctcctgcctcccggatgcgtcgctcagtctcctctcgaggggatttgggtgaacttacccaaaggatgggcatacttgaactgcagacagggagcatgcagcacacgctggagggacatgtggtgcagacacgggagtggcagcaatctgttgatgcacaacttgcaaatctcaacaccacgatgcaacaacagtaagctgattggcaagcgtactaccgctaccagggattcaatccctaccatgagccatagcaagaagcaagcttggggggagatgtcccccctccccctctcactaaggtgacttgtatctttcctttcattgcatgtttaaatttttgcattgcatttatacacctaaaaacaacataaaattttgcaaaatcaaaaataccaaaaagatagggtaatatgctaggtaagacatgcttagttattcatattgaaatgatgaatagttattctgttttatatctctcatatatgggtcatggttaagtgctctctcaaaatttgagtaagaataaccaacaattatcaggaacctgaggtaagtgagctgcactttgttgatctgagtctagctgcactttgttgatctgagtctaggttgttgcgagatatgagatagtaaataagagtttctatgatcctgttctaagtttgacttgaattccgaatgttttattttccgaaatgataaatttcaaagttcctcatttgatatgagttcctactagagccaaaaaatatccatattgattaagccatatacattttggttacttgtaagtccattgaaatttgtcaaatctttgtgacttctgtagatacttttcatgctctatgatcaagatcatacacccacatatatgcatatgctaaacttctacactgcaagctagcatccattctatctttatttccattataccatcatcaaaataaattcttcatgcttatatgtgctttcttctcctaaaaagaaaatcctttctgaataaaaaagaaaagagaaaaaggagggaaaggcatggttatgaaaataataatcataataaacttatgctctctcaaaatattgagcaagatgttaaaaaaaatgtagccatgccctctctatatttatgaaaggaggatttggagaagaaagtaagcacaaaggagaagaattttctttcttttccacattccatttccaccatatgtcacacacactttgcacaatcttgatcttgagtatgattagtcatctattttagtccaagtttttgacttagtaataaatgtgaatacaagtatgccatgtttgatccctaccaagctccatatatcaaaccttagagtaggattcaaaaaggcaaatttggtgaggaattcatattcaaacactctgagtgatcgagagaatcatttgaggaacttagatttcttttgaaaaatcatttgaaaacttccaagataaaagttaaataaagattgggtgactagcgctctaattgttgttctgtctctcaaccgctcaagacaaggaaaggcagtgtctcgcgggaattaggtgtaagggtaagccataatgccaaacttatttggtttgagagagagtacacataccttgcatctgtatctttgagatatacagcatagtagcaactcctaatcgacaaccaagtttaaatttttgtgagccctttactcggaacgagcaaaggttcaagcttggggggtttgttgacggtcgttatcgaccagtttcgaccgtcaatattacccaattagtaaatactagctatgtttgcgatgtataattcccgaataaaatatctacttccactatgtactatgctactaacatctatgtagaagaagcacatataaatagagaagaatcgacaaaaaatagatgaacgatcaatcagacgctgtcgagaatcagacttatggatagatgggctgagaactcagatatgacacgatccaataggaccaaaattcactattctggataagagaggagttatgggggctacctgccaaaaatgggccagagtagcccagcccatggttcggccgaacccaccttgaagccgttcgatgcagggtttgcgatggacggtgtggatcactccccaatgatggttggagggcattttcgaccattccaaccgccaaaaccgtcattgggaggttatctcattccattctccacacacctcaagaagaagatcaagagctctcccaagtttagtttagtagttctagtactagtggagtaggaaatagaatagtcttcatagtcctcgactcttcaggagatttcgggtatggctctactagctttcctcttttcttttgtaagacttattgaattaatacaatattcttctttatacactttcgttatcttattccattcatataattgagtaccgactttactttatacttgtacgaatatagttgtgtgactagcttaccagagaggtgtattggtgtgggtttagtgtccgagtattcgtttgctctatgtcggttgcaaggatacagagtagtatttagtaatgtaagtgcgatgcttagattattatataccattaattggggtaatatgcaatggttcagaggctggccactgatggtgacagctcaatacgggtgttcctctgcatgtgtatattatcctaagtacaatttcctggggagggtactcctccgtatttagcctcggttggatggccatgacagattgtcgtaaggaactcagcaacaaggggtggtctctcaaaacaccaggaggacactgttagagggtattggttgcatgattgtataccaacaagtatagactaaagatgtatatatactagaagtacaggaatgatactttttgttattctttctccacttagcttagactatattttagtgagaatatcttagttctttcttctgtgtgccaccctaccctttgaactaaattaactcctgcatagactttgatgtatataagtaatatttgaattattagcatagtactatcttatcatatcttcccttgggataaaataaatacgataccttggaatactcccaggtgaaatgctacaatggtatatccgtgcgcttgcagatcacatctgtaaccataatataccaggattatttctagtgctattgctgggaattatattttcagtagtgtcgctaagaaataccaacacgtgccgcctgagaccccctgtcacatcgtgatgatgggaggccgcttagcctcttgtcgcacaagtgaggcttgcctaacccggttatggtagggtttccgtttcccagcacaagtgaggacccaaaagtcctcatttattaaatatcgaatgacatacgtgtcccctgtgtcagccagatggatttgacgggccccacgccgcaacatggcatgcaagagacttccaaggcaaggaacgagacatgcatttaatgtgattatcctccctgaataggctcagtgggcccatgtagtaaccccttgagatataaaaggaggtgcaggcctacttagggaggggatgagccctttttcactagagcagtcgcctcccctcatcatcaacaccttccactccaacaaggagatcttgtaatctcactctctcaatcagcatagcataagagtagggtgttacgcttctcaacggcccgaacctgtataaaccgctattgtctcatctccctaggggggcccgaccccctcttattcacactccaccacagaatcctcgaataccaatcactacccccggccgaaccaaaaaaggggggcctcatggttccctggtggaggagttcacccgccgacatctattctcttaaatctttctctcgtcaccacttcaaattattttttcatctgtggagaaatggggggccagattggtataaagaatattctcaatggatcattaagcaagatcgtgagtggacttaagtgaaaccgaagtctaaggatctgagatcttcagtcgtagtatagcctagtatttcttttgcaaatgttgttcaatctgagcgttcagttccctcatctatgatccctgtctaaaaggtttttgattctttgaaaaagagtatactggataagaattctagatctgtcaaagatcagcttgatttcaatgtgccaaatcattcttcggtttttgataggctagtttttccttctgattccccaaaggcctctaaatcttctaatcagttttgttcacgatgccttaggcaggatcatggggtttcaaattgttctaatcctatccggtgtaacttctgttttagttatggacataaggcccattagtgtttggcccaaaagagtaagactacttccaagtggatagttaaagagacttgacagtggaaaggcgttaacaaatctatttttccatcttcttcacctacttcttctcgacagattactgttgctctagaaaaccccaatccttctcaatccaatatgctgtcggaaaatcttgccatggctaagggcatgtttggcatagctccagctcctgctccatccctcctagatctggagctcaaccaaacagtttcagctccaccaaaactgggagtggagctaggtggagctctctcacaaaatgaactagagttgtggagctaggtttaggcagctccagaactctactctggatcgaactcctggagctaaatttaggagttggagctgtactaaacaggtcctaagattgtcttcaatccggggtgattcgtgggagctggtcatcatgttcaagatggtagtccaaatcgtttgcacaaagctgacattacggttcctgctcgttaaaagcagcatgaagcctacgtgcttgataagattgaaccccaagtgcaaaagatgaatgggatgttcacagattgcagatttgtaaccatctctagaatgaactgggtattatggtcactcattacgctccgcatccccttggtgttggcctttttgctgtcagatcaactcttattagagatacattagttgcagcctttggtttttattataatgggggtcatgtggttaggtttgtgaaccatgatagaggtactaactggagagctgctcatgctgacaaaggagtgtggattatgtttctagggtatcctctagacttccgctctacaagttacatctctagagctatgggtttgtttggaaagttagactacttgcaggaggttgatgctatccctggtcgtgttctgttgcaggcatattttgatggtgttgatttggtccaaggaagaattgttcttaaatagattcctaatcatggtggtcaaggggaatcgtggacctttggagtgcttaacttaaataataagtttgctaatccacaaccgcaagatgaagatttgccccctattggtgtcccgccaccgccaccaggccccactcaacatcaaggtccagcttgggatgatattaatgagcagcaagaggatgtagggggatgggataactaggatcaacaggctaagaatcaggggactggtcagtctggtataagctcacatggaggaagtgaaaatatgcagatcataatgttggctgacaatactaaatattttccacagttttctataacacctgagatgcaggagaagattgatgagttccttttgagggtgaaacttttgagctctttgcaaaatagagcccccatcccaatgcccattcaaatagctgctcttttcaatccgctcctttccctaaaaggaaagctatcactgactgttctccacctgttattaaaagggacaacgtgggtgaggcctcaagttgggccatggaaaaaaagtctattagtggttgatgatgtcatgcatgctttaggggatctaatgatttctctagttcccctggctattctaccccctacccctctggatatttttgctcctgatgaagtccctctactgcgtggccccctgttgatatttctgcctctcaggagatggatgtgcacccaagttcacttgttgcctctagctctgttactttagtgttgggttacgcgtaggctacaatagcagaaatcaaaattttctatcgcgtaaaccaggaaccatgcaagtattagatcatagatcgttaccactcgacgtgctgcgcagcggaagaaggcgctaagaagtcgaaggaattctcacgaagtagcgtgcgtcgatgtagaagaagtagtcgatcgcaccagctcgaccttctcctcctcgtgcgttctcctcgctgtattcctacgctgatcagcaccgcaaaccagcagcgccgctaccggtatccacacgtacagggacggaacgccacgcgcagatgtgctagcacccgcgcgcggctagggttttgctcggggaggggagtgacggctaggatttctcacgtgatgcaatacctccgccggtcacacccctcacgaatatataggatccatcactcaggcctccaaggcccgtaggactcctattcggatccctatccgaattaagctcatattggatctccatccaatctccttattccggcccattaagtgtgcgacccagtaggttcatgtacactcggctgtaacccgaaaactccttttcggtccacgcgtcaacagcggcccccagcagaacgtattgacccaccgggcatacataaaaaccatattggctgaacctctagtgtatacttgtatgaatccctttgcctcacgatagagatatctctccataggaggggtaaatcccatcttgattattcatatcccactacatgtttcatagcatgcccgaaaactacttttataactacccaattacggagtagcgtttagcagtccctaagtaagctactacacatgttgggaaccatgataatctcaggtctaaggattcaacaccaacactaactgagatcaatgatgacacaacacatatggctcttgcagtgtctcatgttgggtatatccaacaacatgttcaccaacatgtgtccacattattaatttggtatctctataccatgatccatgagacatgatcatcaattaatatatgtgctgatcatctaaacatatttgttccacatatgatatttgatcagggatcctttagaaatagcaacacacaacataaagagcctcatgaaagaatcacatattcattaaccaataatgagttatctatttcaaggaacaaagttggataaatatgtaaacatagtatgtgatacaatcatctctatgattgcctctagggcatatcactaacatttagtgcttccaaaggctcctgctaagaaaagagatggtaaaacagttctttatgatcaagtgagaatgcaaagctcgaggttgagggccttgctgattgatgttgcggacttaaatcccaggatgggcattggtaaacctaggggaaaatttgcaaagaagttgaaataattggcatgtatttctaatgttttatcttctggcagtatccttaaggaatctaactttgattctgatatttattttgaaactgattattccccatctgattgtctgtttccctttttacaaaagatgggagttcaaacgtgcagtctatctcttgagaaggtggctaaaagcaagctgggaggagctaaattggacttggtgcccaggccagctgaagaagatgattagtttaaattgtttatcaatggcagttcgtttcaaaaaacaatttgttttaaatatggtgtttttatgtggttattttgtaatgatagttattgtactcagccggtcactagttttttctgtatcatgccacttatgccagacttgctttgcttggtctgttttctctctttgttcatctttttacttatgaatcagcagcgtagctcaaatatcctatgttagaataagggggatgaattcagtggacaagtgggctgctcttataaatattgatgatagtagctaccagctagggtttgcttttaggaaactaaaagagagattgtagactgtgcttctcttaaaaaagttgtgcccaaaagatttgatagttttcactttgtgccttctcatggtgcttagggggggcattttggtctgttggtgtggttccatttttaggggttctttgataacctctaataattttgcactttgcctaaaatttacttctaggcataactctaaatcttggttcctagcttcaatttatggtccttgtagaggccatgaaagagtttattttgtcgattggttaaaatccttccaaattcagcatgatgaagcctggatttttcttagtgattttaatttttacagatatgtggagaatagaaataaaccaggggctgatatgaataacattttcattttcaacaatattatcagttctttacggctgattgagaaccttttaaagggagaagttttacttggagtaatatgcaaagtaatcacctcttagaacagcttgattgggtctttacctctaatgactggaccctaaagtaccctaacattgtggtttatactatgcctagagctatttctgatcatgttccttttgtgatcaaaattgaatcctctattccaaaatcgaatgtttttcgctttgagaattattgggtccagatagagggtttctttgatcatgtggcacaagtatagagtgttgaccctagtttttttattcggctaagcgtatcacttttaagcttaaacggttaacaaagggtctgctgatttggagtaatggtttttctaaattattgcaattaatcaagtcttgcaataaagtcctagattttcttgatctaattgaagaagttagagctttatctctgatggaatggaattttagagaaattgtgaaaaaacagctttgaaacttttttcagtttggaagagtattggaagaaaagatgcacaaatagatggatccaacttggtgaatagaaactaagttttttcatgccatggctacagagaggtttaaaaataacttgatagctcaaattaatgataatggatccgttgtctcagcacatcatgataaagcctctctcttttctgacacttttcaatctagaatgggtgtttctacttatcggctatgagttttgatcaatatgatcttattccaagaaatgataaccttgatagcatggtagatcattttttcactcttgaaatggatgaccttgttaaaagtcttccgattgacaaagctccaggcccagatggctttaatggttgttttattaaaaattgttggccaattatagcccaagattattacagactggatgctcactttcatgctgagttggttgacctgcaatgcattaattcttcttatattattcttgtgcctaagaaggttaatctagaatgtgttaatgattttaggcctatttctcgtatgagtatcactctaaaatttttgactaagctaatggctgataggcttcaaggagttataaagaagattgtacatgaaaatcaatatggttttattaaagagaggactatacaagactatttagccgggtcttttgagtatattcatcagtgtcagcaatccaagagggaaatcctgattcttaaattggacttttaaaaggccttcgatacaatcgaacattcgaccattttgaaaataatgaaacatatgggttccctacaaaatggttgaattgggttaagatggtttttgaatcagcaagttcttctatcttactaaatgggattcctgggaaattccttaggtgcaaaagaggggtcaggcagggtgatcctctctctcccttgctttttgtgattggtgctgaacttcttcaggatgttttaagtagagcc

SEQ ID NO: 26347 - DNA, 5706 bp, Oryza sativa
tgggatgggtgaccaccggaaaattcttccgggtgcacatgagtgaggataaagtgtgcagaaaagacttgtgttggtctgtgagggtagtctatgaactataaaagctattagatgtaagtgggcccagcctgggagaggcgggacgtgacaaaatggtatgaatgtaagtgggcctagcctgggagaggcaaaggcgggacgttacaacaagaccttccttgggttagacttatttgggcttcttgctacagaacaaaagtacctcatatggttttcaataaagggtctttttggtggaggtacataattcagttggccgatatttatagagctatttcccaatgtacaatacaatctggcacttcagtcttgttttgggatgatctctggaatggtgagattaagaaactaaagtatcgtgatcttttctcccaaactactttaagatgggaatctgtgaatcactttttgaatttacaacttgaagattactttaatcttcccctagatgatcaggcttatagacagtttcttcagttgcaatctgatttagtcattctgtctctcagtccaaataagggagatttatggactttcttctggaattcacacatctactctggccaaaagttttacaggactaattttgtgggactctatgttccaaggccttttatctagatttggaagaccaaatgtgtgaagaaaattaaggtttttatgtggttgcttttgtgggacatgctaaataccaacgacatgttggataggaggcattgtgctcctaaagatgcagttttaaactgtgtaatttgtggtggtcctagagagacgttgattcaccttttcttcacttgtccttttagtaagttgtgctgggagcgcctcagttggaatcgaaacttggaaatttcccaaatgtcgaattttattcagaagaaaaggttttctggatattatttgatttgcttgttggcacatttggaagcagcgaaatggccatgttttttataatgttcagccttatcttaataggtggtttgttgcttttacaaatgaaattcttctacatttctgcagaatgaaggattctcttagctcctccattcttagctagctacaaagtttgtaattttcaaaggggtattggttttgctttttgttttttcctctgtaaataactctttttattttaatatataattattaggcaaagctctggtagtattttacactaaaaaaagatatatggtattgctcttcagggatatgaatcagattagagctatagttgagggagtcaatgtggacttattcctgaggtgtcgcatgccagcctgggcatgattggggcacgtgggtcatgtgttggtatttcgtacgttcatagataaatctgcaagcgcacggataccgttgtagcatttctcccatgagtattcccaagggtatcgtatttatattccaccgggaaggcggcggtataaatatatggtttatatctcatgaatcaacctataattgataatgtagtgaacaaacaggagattcacctttataataatgtctagtggaaaataacattaggaaactatgatataactgtacttctatagtaatcatatttagtatcacttaacatatatatcctgacaacataggactttgttccaagcacctaggtactaccgagagatcactccttattggtctgccagcgtggttgtggcatttatgcactcttacgtcacccctccacctcctccaccaaatcccctacttttccccaatttttggcgccaaatcgagccccacttcgcccacggtgtcgcccacgtcgccggccgttgccgcttcaaatccgccacgtccggccacgatttctcctccccaagcctatcaaaagcaccctcgtgctctcctcttccgtttccctcccctccccgagctcctcgttacctctcccgtgctccccgcgcgagcccgtgctccgccgctttccggcgagctccggctgcacgccgccgtcgccgtagccaccgccacgctgcgctgcttacaccgccggcttcgccatgcctcgccgcacaccggccaccgctccatttgcacaaacctccgccgaaactccccttccaccatgcacccgagtcgccaccaccctaaaccgcctccagtcgcatgtcgtcgtcgcctgagccgctcccgcgtcctgccaccaccgcagccggcttcgctgccgcgcaggcaagcccggccaccgatcagtttttcccctccaccaccgaaaaccacccccaccgccaacctgaggccgacgctgcattttccgcctccagccgcctcctgctgccgtcccagaccaccttaatatgcgccgtcgcctccatcggcttctccgtctggtgccgccccttcgccctcgccattcaccgccggagtcctctccttcccgtcgaggtgagctacttcccatgttgccggcctctggccgctttttttccaccgcctcgcgcctcctccctttcccctaatcattccatcgccctcccaggtcatcccggcctccgtccgccgtttccaccccgtggagccgccgcgggagcaccatcccgcagtcgtcctgaggagctcgccgccgcgctcatcgcccctcgccgcccggcgcacggtgaggcctccttcctcccttttcccttctgcctcccttgtccggcgccgcgtcgtgctgccatcgccggcggccgtccgcgcgtgtgccgccgccttgtcgggctggccggcgagcccgccccttgccgctctgttcgccacccatggaccactcccgtggtctgggtccacggtgccgccaggccgcggtggaccgagtccaccgtgcgcccgccccttttgtgtcgctgacgtgcggggcccgcgtgtcagcgccggcgccccttgctgacatcagcgaatgccttttcctttgagaaaataattgataattgcgcaataaatcattaataattatagaaatccatttaaatggctcaaaacttctaaaattcatatctaattcattcgaactccgaattgggccattcaaattgcaaaattcatctaaaattgagttctacatgtttgtttactttttatgtactgtttccttggtttttattagagtttttttcctcgttttgcgagccagcgtgtagaatccgtcgtttcggaagatcgcggtcgcgaggaaaagagttcaaaaaatccaagtgaagaagcaaggcaagtcacacattccccttgagcatgttgttcccaatttataaatgttttaccgtttgtaaataaatatgcatgttttgctaattacaagggatcagggtttacctatctgctcgcttgtgccatgtttacttgatatctgtcatttgtcaaccatgggtaatagatcgcctagcttgtgttactttgatgacctagctagaactatatgcttagccatgcttaattaccactagctcagtcgaagggataattgcagtattagacattctattatcttgttgagctgcgtgctcgagacatctggccatgtttcatggtcgtaattatccaactaaaatgtgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggttttgtcacaatcactcgacatggtgacgtgtgcatcatgggcacatgatggcacggtgacatgccggtggattgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttgtttgggcctgttcaacgtggtgtagcgttgatcaatggagatttaatattaccttaattactcaactattttactgttttgctcaataaaatgatttacaaccgcatttatgcaaatagccacaaaccgtccttgtatccccttgcacgtctgcatcgttggtgtggcttgctgagtacggtggttgtactcagtcttgctattattcccccttttcagaagtgtagtgcttctgagctgaagacgaagttagaagaccaaggctcagaccccagttgagttttgcctgtggagtggagctgaagccccgctaggatcgccttttccgctgctgctgcttttgtttcggtgtgaggactaagtgcctcttctataagtattttatgctttatttacgtttggagctgtttattacttgtcattttgtgtaccctggctggtcctggacaaggatttaatacacaaaatagtctggaaatttgggctaaatttctgggcgtgacatgtgccgacaactccggtactcctccagaattcctcctagaaagctacactcgttgagatagaagtcggatggagcgccaaactttcgggcagtcctccaaagcttcccctcactctctacctattttttaatgttcaagagatacaatagagcctcttgtaattcagctcaaagttgtgtgtgttgaagtgtggatggagacctcattttataagctccatatgacagttatggctatgggaaatgtccaaactgccctccaaccgacattgggaaatgtccaaacgagctcagatactgatcccgtgcttgctgcatcattgcttcaaactcctgcttcatctcaagtgtgaatttctctggatcgattggcatgacattgtcatcaatgatgtcagtcaatcctggcttcaatgccttgcctttaatggaacctgggcttgatggtggtggtgcttgtttctcggccatgaggaagaactgacatctgacttctaatcaactcccactgggcgtgccaaaagtgtgttgacagaaaacacgtggcctgggagatctgcttaactccagtgcaggtccaaaactcgccttcggatgtattagcatgccagttgatttgatcctgtaatcaacaagaaataaaagcaaagaaaccatggttaaatctataaatgatagccgattggctagatgccgatgacatatcatttatctttgggccgatgtcatttgtgtatcgatcggcagtcatgaaaaagtaaataaacactaaatctactcgatcggctgtagatgttaacgatatatactccttatattggtatatacttaaatcgagtgattgggatagatcggacaccatgccgagacagtataaatcacttagatcgaaatatatatcaataacatgattatatatgtttatagcgtagccgatcagatagatctagcgtgtatcggctaatactccgatactaactcatatcaggatattaaagcaggtataatatatcaaacaaagccctaacatatttagatgcagggctgcaggaat

SEQ ID NO: 26348 - DNA, 20017 bp, Oryza sativa
  unsure (1)..(20017): unsure at all n locations
tgctattcttaatcggcaactagaaagcaggccaaagatcgatattctaaacacgacttattagatcaaactcaactgatgcagcattaagtatgaaaagaagaaccatatctagacaatcaagccgctagctgtttcatagaatggtagatatcttatataatctagatcaacatctagatctaacctaatcggctgccttctgcatacagatattgaccgatagtagtttagatggcaatatcgttagagattatataaggtatatgataacttgatgaattacataaacaggactagagtgtcatgaggatggaagcattaatcctaagaacgcaatccatcacggcgaatgttacctcttgttgaagatcgaaatccatgcagctcaacccgaaagcaagaactcgtcaaaataaaactaaagcaaaaggatggcgatgcgccgagattgtattgaacgtgtgtattaaaaattacatgtcacgcccgaaatttctatccaaaattccaaacgcttacatgtgtgtaaaccctcgtctaggaatcagccgaggcacacaataacaaattgataatagagtacaattattaataagcgactataatgtcattacagaggtagatagttcctctcaaacaataaagttctaagcagcggaaaataaaagaaacagcacagacgactctactccacaggcagcttgaccagggctaggcctaatcctccacaccatcagcatcacagtagaactcttcctctgatgaatgattgcaaggtgagtatatgacatactcagtaagccacgcagcaaatatgcaagtgcataggataacaaaggatggcatagtatagtctcatttgcataaatagcatttaataaatatttcagaatttaataaaacagtagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgcccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttaattttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggaatctgtgtgacttgccttgctcgccttggaattcctcaaagtcttctcctgcaaaatcggactctccgggaacatcggaatctaaagagaaaagagcaaaaacactaaaacagcacataaacaagcataaaaagtacatgtggatatttttaacatgtagatctcaattttagaaaaatttagagacttgaaccaactaaatccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacgatgacgtcggcgatgacgtcaccaccggcggcggctcgggcgcgcatgctcgccggcgaacaacggcgcggtggcgcaaacggagggcctctatgcgtagtggacgatgcagcgatccttaccgaggcacgaacggcggcggacggcgacgaggaagaagcggcggcgacggtcggcttgacgacgacggcggtcttccggcgatcctcggcgacgacggaggggtggacgaggacggcgacggcttggtgaacccggcgttgtccttcccaagcgacgatgacgaccggagcgacggcgtcgcacggctggacttgcggcagcgacagcggtgcaagagctcacggtgctagagctctaccggccatggaaggcgaggcgagggtggcggcgggtagaggagagctcgggggtcctttataggggctagggggtgacggtggaggcccacggcggccggcgacggcgatggaaacattagggttcaggggaagaaaacgaatccgaatcaaactcgaatccggcgatttcaaaagcgaattaggcgatgattccaaaagggaaaaagtagaggagatctcggggatcatttcccctcaaacaatttcatcggatcgagaaagggacgagcgaatttggaagggcggcggcggcgcggcttggctagggttcggccgggcgacggctggaggtggacgacgagtccgataggtgggccccacctgtcagcgagtgggacgcgcgcgcgagcggcgtctcggctgcaggccaacttgggccggggaggagagagagagggttttgggccgactttcggcccaaagccaaaaggaggatttttaaaacattttcaatttaaattattcatgaaatgcaattccatttattaaaaatacttccttggctcaaataaatcccagaaaaatccaggaactataaaatcaagtaaagtatttaataaaattttatctagccacttttacattggaatttattatttaaaattagatcttctcttctaggcttttaaaattatttctaataattccaattaaacaacaatttatatatttaggatttttagggtgtgacattacatagggctcggggtctatttatacccgaggattacaagatatgcccatagcggacatgaccattatctctaacaaactctaagataccataagtcattacggcagacttttgccccacacttatctataaggaatttacataaaatatcctaattaatagatacaattgccttcccaggactctatccatgcgtggcaatcatcttgaagtacattaaattgaacccgatgtcgcgtacaagtcgtattgtcggaatcggctacatcgacttacccaacacgactcatacccagccgatcttatcgtagccgatctggattttagccgattcctgctctgctttcaaacccgatttccgcttccgactttgcttcgatctactcttctctcccgacgctgatgttaccaaattcggttgttaacacatgccccccaagtccggaatatttggtaatgtttcggatttgctgtaaatcgactccgagcaagtttcgcactttaccgttttccgaccgttactgccgtgctttaaatactaaccgtcacccccgagaaacctcacaccgtgacacccgttttcaccgctcaagcagaacttattccccttccttctccggcgactcttccgacgcaaaggcgattcccaggcaacctctccttcgacgagatctccgcccgcggccatgtcatcctccgccagcccgtctggtgcgccaatagccgagtacgccgaggtaagttctcatcggctaaatcccctttccttagcaatagattgattttctctcatctcatacctcccctctcttttcgattgctttggattcgtaacatctttcccaccaagtcgcaattccaagcctttcacaccagaaccactacttccttggcccaatcggcaatctcgaccccaccgatttcatcactggtgagaccaaccggattccctttaggctatccaaccctaacctaggtcattggaagaacacctttaaatcctggccatctctcgaaaaacccacacccgacaggagttggtccacttggtatcaacgtgtatcggctagtaagaaagttcactgggatgagattggaatcggccaagcactagccctcaccatagccaattctgccaaagacgaacctctgatggctgccgccacctacttctggtcaaacaccatcaacgctttcctgttcaaccaagggccgatgactccaaccttaattgacatcactatgatcaccggactagatgtaacttcatcggccaaccccatgagcatgaataccaagaaccaattcgatttcaaaaccaagagcataggttgttggtccggctatgtggcagcatatatgggtcaaggatccgttacccctcgagagcacgtagcctttttgctcatgtggctggaaaagttccttttctgtggatccagttgtggccctacaaccaactggcagttcgtagccgaagccctggagtcaaagaaagaattccctttgggcaaaatccttctcggctatctgtaccagatgttgaacaacacatcggctagaatagccgtcggctcggcagttggagcaggtggaccctggtggctactgcaaacttggttaaacctgatggttatgaaggttgtcaatcggccttctgtaacagaagctgagttcccactgccagagccgattgtgggtgacgacggagaagaatgtactcatcgcaggtgcacatgatatggggaatatgcatccacaccaaccgatgctggagcaaagttatcggctgagctgcttaaggactggttctgcagcttctatgagggctttaagaaagatacccggatctggttcccttatgaagaatcagcagacctcgaacttccatcagattttagattcgaagatattaaccatgagaaattccagaaatccagagaagttcttatagccgcaatcagcccttgcatccttcctgtcggcattcaccaagggagaaacatccaagtctcctacgagttttatcacccaatgagctcggctaggcaacttggattaggccaactcccaatcggcttattttttgccgacaagattcagtgccgaggacaaatcacgtctgctctaatgatggatcggctactcaatctatcgggacctcctcttggcagcattgaaaatattgagttggctggattcagaagcaaaaacttcgacagatggtggggtgaatagaagctacatctgtttcatcaatcagccacgatgtatatgacagatctgtcccccgacgtcataccctaggtaaacattgttactatcaaattgcgtagtcaattaatcgatttattacttaaccaatcttttgctcctgctttgcagacaacagagtcctcccctcctcaccaaagcaatagtggcaagaacattgagtatgcttcgggcttaattccaaatggaggtgggctatctccccctgttattggctactatgcccccaagacctcaactctccttcacggcctaactagagaaccagccgatgcaggcccaaaaaggaaaaccagatcctcggctgtgagcacttcaatcttggctccaaagaaaaaggccaagttcaagaaaaccaaaccgactgacaagccggccgatgatctgcccaccttggatccatctattgaacaagccttagatgaagagataattgaagacgaagttgatcaggccgcagctgaagtaagcgatactgaaagaacaccatcggcttcgcctaagcaaacccttccaactccttctgccccagtccacttctcaagggtaagtgtttctcgttaatccttttagtgattattttgtcttatagccgatcattcccaagtcttataattgcagaaaaagaagactgcggtgaagaagaaatcggctgcaacaacatctaaaccagctccaccagtaagatagatttaactttcattagttaatttttagccgattctatctgacacttgtctccctttcagccttcacctcctccttctccttttattcaacaatcatcaagtgatcagaccccttcagctgcagggagtcatcacgtcgaggaagaagaacaaccaactgctcctgctatcttagtaagtttcttttatcacaacaggcattcaaatcggctataatcgtttaacctctaatctgcttctaaattgttattgcaggcattggccgatcttttctctttcaatatcagagactatcttgatgaaggagaagaagatactacaagcaaagcattggctcctttatctgatgacgtgaagaaaactcaaggaagtattttggatcggctagaggcatcatcactagacagcttagtagttgactgtggctcaatcaggctcggctgcatgagattcaagccttaatcccggatgagttagccgacatccttactccagctgtttaccttgagcaacaccaattcaagctggagaaagccaagttaagattagtcgaacggcgagaatgtaagaacattgaagccactatccaagccagccgacaacttgtgcatgaagagaaatccaagcttgaccaattatctgaaggcccaatcaagtctaacattgatcggcttgaggctcacaagattgacctcttagcacaacttgaagaatgtaacgccgagctggatatggagcgcaagaagctagccgatctccccaagtctattgaagaacagaaagcaagacttaaatcggctatcaagcatgttgctgaactgaccaagtccctaaaagttatccctcgaaccgatgctcaagatgcccaagccatagaagaagtagagcagattaggcagaaggctatttcggccatctagcgatacttatctcagtagtctttatgtaataatacttaagacttttgtaatcggctaaaacattctgatactttattgtcttaacaaccctttgcgccgattaatatgactttgaaatttgctcaaaaaattttgtactgcatactgcattttgatatatatatgcccccctagttttacaatgtcaagagcattgataaaattataaaacagctaagggcgatataacaatatcggccattttacatcggcaaaccacaaccgattacattataaaaaaaactaagggcgatataacaatatcggccattgtacatcggcaaaccacaaccgattacattataaaaacaactaagggcgatataacaatatcggccatctcaaggcgatgtaaacacatcggctgtcacgcatcggcagtagtagccgatcatgcgttaacccacacacttgggtaatatttcttcaagtatttgccattgagcgctcgcccgtaaacttcaccatcaagcccttgcaacatatatgcccccttagacacaaacttatgaatttggaacggtccctcccaattcggcaaccacttgctaaatttactatcatgagtaccaatcggcaaaatcagcttccatacaagttcaccttccgaaaaatctttaggtacaactttcttattataatgccgagcaacacgttccttatccttagtaaccttcgcaagggctcgcaatcgtgactgaaccaaatcctccctctcatcagccataagattgtaatactcatctgctgtgaaatcgttttgcaactccgttcgtcgagagccgattctaacttcccatggtaaaacagcctcatgtccataaacaggtttgtaaggaggaacttggatcgatccatgacaagccatcctataagaccataatgcttcggccaatcgagtatgccattgccgaggataatcagaaatcttccgcttgatcaacttaatcaaactcttattagatgcctcggcttgcccattagcttgtgcataataaggtgaagaattcaacaacttgatacccacgctatcggcaaactgaataaactcatcggacacgaagattgaaccttgatccatagtgatagtttgaggaagaccaaatcgatagattatatgctcttgaacaaattgaatagcatcccccgaatcaactttcttcaaaggaatcgcttctacccacttggtgaaataatcagttgccaccaatataaatttatgccctttactcgatggtgggtttatcataccgataatgtcaatcccctaacctctaaattgccatggtttaataataggattcatagccgacgccggtgctcgctgaattgctccaaacttctgacaatcctgacaccccttataatatctgaataaatcttccagcattgtcggccaaaagtaccctgcacgccgaagcaaccacttcatcttgtgagccgattgatgagtaccacagatcccttcatgaacttcaccgattgcaaccttggcctgatcggcactcaagcacttaagtaataccccatcaatcgtccgataataaagctcatcatccaacagtgtatagttcaatgccttatatcgtaatttcctagaagccgattgagatggattactcaaatactgatgcacatcatacctccaatcatcggctgacattgctgcaatctcaactttaacatctttgatcatcggcttataccccgatgcccctggggccaaatcattagcttcaagattttgttctcgagatacatgcttcaaagtaaccagccaaaactctttcattagttccaggcacttctcattataaaccatcaatgtatcattcttgcattcatatttctccagccaatgggctgattactagataagaatcccccatgatttcaatagtatcgtgatatgaccatggctactacggatacatccgtggctcacatcatggatgaccaccaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgtttttgtaccacagtcgtcgctgccaccgtgtctctgttgttgtcgggacctacgaaaacggaatcggctcgctgccacggttctatttttgtagttttcagaagtttctgtcggttagttttggagttattgagttgcatctagagtttgccgatccttgtgtgtgtttgttttggccgtgcctgtgtcgtgcacaagaggaggaaggtgaattaccatatctgattttggaagtagtcaagtttgttttggaaagatatagtagattggattggttaaaaatcagtttccgttttatcccatacaccaaattcggctgccatccactccacctccttgccgagtcccactcgcccctttggccgagtctgaccccctccctcaattccacggttccgagttgtgtcaaacaccttggcgaatttttgtttggtgtcggtttcgagatctgtttggaaaaacggaaccggcataaattcagcattccatttttttgtataattttaattttgggtttagacttttacatttgagtccctataaattttatatttatgtttgagtccctgtaatcttacattaaggtccttaagtcagtttttgttaaaaaaaataaaaaaaaaagtgagaaaaaaaagggcagaaaggtgcaaaaaaaaaagaaaaaaaagccgcaccaaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagctgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaactatatttcagatatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaactatttgcaggaagtgcgtaatcacgaaaaggaggagagagacatgaaagagccaccaattccattgttcacacccaagttcgagacacctccatcatctaaagaggacatccaaggtaaagtaaatgatactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattgctaatgaagttgaggaacgtaaattgctatcttctttaaatactttgggctatgttcagtttaatgatttttgtgagctcgataatttgaaggagaaattattttctaagtctgatttgccaagtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatataaagaacaccatatggaaaaaccgaggacggttttccgtgaagaaggggaggatgatatgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattacttttatcttgttcttgcttgtttcttcgatttgcttacaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatgactataattattcaactttgcattatctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgacatttgagctgccagtacctagtagttgataggagcgtgtatattcttgtgtatgtttcttgtttgctgctaaccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtaccggttctgcatctttttggtggcatactgtggggaataagcttgaaacttgggatgaatgcaaaatactgatgagaaaaagatttgtgttttcatactatagatgtgctctccttgagaaatgggaacatctaaaacaaggtgacaaaactgttagggagtactttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaaattttggagaatccaacggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgtttcttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttctggataaaatatgcaagctagagagacatgttactgctaatcatattgtctcgagtttgtcttgttttgattgcaagaaacaggttgtgttcagtggactgcgcgaagagcaccatatggaaaaaccgaggacggttttctgtgaagaaggggaggatgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggtttccggggttttgttagattaaagtttagccattgctacttgcttgcagcgcgcgtgtcggttagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggtccatcatagggcggcactcaccacatggggggtcgcggccaagtagagtagcaatggttcctccggtcccgggactaccaagatgggggggaagtgaggtaagctttcagctgattgagagcttgctcagcttcctccgtccatacaaacggcccggagtgcttgaggagcttgaataggggcagcgccctctcacccagcctcgatataaatcgactcagggcggccatgcatccagcgacgcattacacattcctaagcttgctggggggggggggcatcctctctatcgcgcgtattttctcaggatttgcttctatgcctcgggaacagactagaaaaccgagaagcttgcccgccggcacgccgaacacacatttatcggggttcagctttacgcgcgtggacataagactatcgaaagtttcggccaggtcctgtagcaacatgtcctggtggcgcgtctttaccaccgggtcatcgacatacgcctctacattgcgccctatctgattacttaaagtaatagagtcatgcgctaaaaagtagggcctgcattcttcaatccaaaaggcatagttgtataacaaaaagtgcccacaggagtaataaaggcagttttttcctcatcttccctagccatacgaatctgatggtacccagagtatgcatctagaaaacacaaaaggtcgcacaacgcagtggagtcgactatttgatctatgcgtggcagagggaagggatctttagggcatgccttgttgaggtcggtgtagtcgatgcacatccgtagcttgccattggcctttgggacgaccaccgggtttgccagccactccggatagatcacctcgtgaatgaaatcagcctctaggagccgcgccacttcctccctaatgaaggcttgccgctcctgggcttgacgccgcactttttgccggacaggtcgcgcatccggccgcacggcaaggcggtgctcgatcacctccctggggaccccgggcatatcagacggcttccatgcgaaaacgtcagaattcgcccgcaggaaggagacgagcgcgccttcctatttggcgtccaaggttctgccaatcttggcggtcttggacggatcgtcgccaagggggatttccttgacgggcacctcgtcagccgaggtgaggcgcttcttggaggcgtgggacgcagaggcctctgcggcctgcggccctgtggccaccgccaggttgtctgcgcgctgctccgcgcaggcgatggcgaccttgacatcaccaaagacggtgatgggaccagcaggacccgacatcttcatttggaggtaggcgtagtgggtggcggccatgaacttcaccaacgcaggcctgcccagaactgtgttgtagggcagattgagatccgccacatcgaagtcgatccgctcggtgcggaagtttgtggagtcgccgaaggctaccgggagctctacgtggccaagcggccacgtgtgccccggagtaacgccaataattgggagcgacgactggagcttcatccctggggccttgagtgcgtcaaaggctgccggggagatgatgctcagactggccccccaatccaccagcacacgcttcatcttgacgttgtggatggtcggggagaccaccagggccaacttcccaccccgagcgagcaccgtcgaatggttcgctctggtcgaacgtgagcttcacctccgaccagcgcgccttccggaccgcctcgtgcgtgggaacaacggccagaagctctcgcctcatggtcttgaagcctcgatgagaggtgtgagcgcaaccccccctccccgtcgagcgtggcgacggtcccctgaggtatttggaaatccagatcctcactgtctccgccatcatcgggggggggggggcttgttcttggcctcctctcgccggtcactggttgaggtcgcaggggctttgctctcctgtcgaccctgccgcttctcctcatcagcctttcggaaccgctcggccaaattcttgaccgagcggcagtcggcgagactgtggcggtaggtgttgtgtaccgagcaccacttgtccgctgaccggccctcgccggagggaacggtggggctcggcttatcgccggtggcctttcctttgcgcggggcccgtgtgggcccatctgctgcaaggacatggccctcgtcatcagagcgggctggtttccttttgcctctcctatctcgccgcttagagcggggggcaaactcgggggtagccgcggccgccgcaccggtgccgggagagttccaggcccacgcctcctccttccgggccaccttgtccgccagctcgaagagctcgacggtggtcttgggctccttggaggcgatcttctccagcatgtgattatgccgcacgccgttccggaatgcatatacaaccgcatgagctggaatgcacggaatagtgttgcggacctgatagaagcgctgtatgtacgaacagagggactcgtcatccttccgctgtacagcacgtaggtccgcctcttcccctgggcggggatatgtgccttggaagttcgtaatgaactgctggcacagatcctcctaggagtgaatggagtcggggggttgggtcatcaaccagctgcgcgcctgacccttgagggccatgggaaagtaattcgccatgacccggtcgtcaccccttgccgccacgataatcgtggtgtagatttggaggaactcggagggattgatgctaccatcatacttctccgtaaggttggggcgaaacttcgggggccaccggacattccggagactcgccacgaaggccctacaacccatccccccaggggtgagtgtgggggggagggccgccttgtgaagaggagcgcggcgctccagatgaggaggcgccttcccccatgcgggcagctcggcgctcgtcccggcgtcgctcgatgttgattcgagcgtcctgcgtcccgtagaggccgtcatgacgcctccggcttcccgaggcccccgacgatgttggaaccgtggatcgcctcaagatcgtggccgatcggcgggcccttctcctcgccgatgaggagagggtgaccgaggtacgcgacgtaccagtggcggtggatcgaccacccgtggccaactgccgctgggcagcagtgaccaggttggccacgtcgtccagccagcgctgaacaggagtctccggctgcgggtttaccgggggatgccgcagaagggcgcccgctgcttggagcgcgccttggggcgaaccgccgtctccatagtcgagacagcggcgtgccccgatgcgtcgcagcctccctccgccagggggcggagagagagccgaaccacccgaacgagtgggatcctccctccgcgaaggttcacggcggagaggagttggagaaccatggcgacagagacgaggaccacggctttcaccggaatccccactcccggactgggtgggggtaaacgccaccgcctcctcctctacttccaggacctcgaccatggtcagctaaggcctggagaaactagggacggaagaaagcgatttcctctcgaaacgcgcaaccgccccctacctggcgcgccagctgtcgagggaagatcctcaatagcggggagtcgtgagaccccctttctcatgagttcggccgggggcagaggctcgtctcttggaaatcactcgctcgtccctaagactactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26349 - DNA, 2168 bp, Oryza sativa
atgatttaaggtttttcttgtatagtaataaacacagtgaatcttctaaaattcataactaattcatccgagctccgtttaaacccattcaagtctcagtaaatcaagaaaaatgtgtagaatccattaaaaatggttttgttccctgtttcagtagtcttatagcctgtttgcaatgtttgctttgtatgtcactagattccgattcctccgacgctccggtgtacttcgaaatagtcgccgaggttcctccagcaacagagcaaggcaagtcatgcttgtcacttgaacatgttgatcctatattgcaaatgctctattgttttcgttcaaatactgcatcgttttataatgttactatgggttgtttacctattgtcatagccatgctattgttgtaccttgtttctttgtcaacttggggttataacatgattagagttaggactagggaatgcttagccatgcttagttcaactagtgcacaatggggaaaatcctattaatgtttagactgttggttctaatggtgttgttggattagtgacaccgctttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgagcgtgatggagtttggatgggccctgcgacggcctatgcggcttccggattcacctaggcacgtgaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccatgatttgtctcaccctagtgtaatcttttaaaattggatagtttaggtggatggttgggcctgtcgcaacgtgggttagcgttggacagtggatagctgatattgtttaattattacaactgtttaaatctttcaacttctgtttataaatgctcgctttatgcaaatgaaccactttagctcttctttgatgattccgtgcatcatacccctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgttcccgctgcagttttagtcaaggcttagctcctgtgtctttcttttcttccgctgcatttgtgtaagacttttatgatgtttgtaagacgtggatctgaatgtcaacattgtcgtttgtgtaccccggctggtcctggacggggattttaatgcacattccgcttgaaattctattcgggaatttctgggcgtgacagtggagaacggcgggcggcggcgcaggccgtaggcaatagcagcggctgcgccatgcgcgtgcgccacgcgcgcccatggcgcacccccagagaggagagaaggcggcggctgctgctcagcttggctagctgggccggcttgggccgtgcgctaggtttgggccggggtagggaaaggaataagtttatctgaggtcccttaacttgtcatcgaatctgattttcatctttcaatcggaaaaccagatatcacgggtccctcaactattaaaaccggtgcagatgacgtacctcggcggtttagatggcgattttggctgacatggcgcttacgtggctaatttgactcggtcttcatttgtcgtggcattgacgtgacgcttacgtggcaatttgatccggaaaaataataaaacccttgggacccacatgtcagtttcacacacaaaataataaaaaggtgggacccacgtggtctccacatgttatcctctttcaacaagaagctgggaacgaaccccacgactgcaactatggatgtggcggtggcgggagca

SEQ ID NO: 26350 - DNA, 7001 bp, Oryza sativa
cctgcagccctttatgtgtgaaactgacatgtaggtcccatgagtttttattatttttctggatcaaattgccatgtaagcggcacgtgaatgccatgtcagatgaagaccgagtcaaattagccacgtagcgccacgccagccaaaaccgccatctaaaccgctgagggacctcatctgcaccggttttgattgttgagggaacccgtggtatctggatttccgattgaaggatgaaaatcggattcgttgacaagttaagggaccttagatgaacttattccgtagggaaaagaggtggggaagggagaagggagaggacttcggcccaaataaatgttttctgaattttagaagggctttagaaaatttggtttggatagaatttgaatttggaggaaattcacaaaagaaagattttccaaaagacatattatctagtttatttgagtgcaatattttgagagaaagaatacattggactaaatattaaagcactcaaataggaggggaaataaataatatgattactcacaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttgttggtatttcttaatgatattactagaaatataattcccagcaatagcgtagaaacactcttcgtatattatggttacagactttatctgcaagcgcacggatataacattgtagcatttcacccgagagtatttgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccatgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcgtcctcctacctctcaccggccgaccccaaccgccattgccgtccacgtcgccgcaaaatccggcgccctcccgcacccgagctcgcatccaacgacgtgggcacgatcccctccacgtcctccaccatttcccccactctccccgcgaaaatcggcgccagttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgaactccggtcgccgtttcccgccgccacagccgtcaccgcgccgagccgccgccaccgccagcttcgccaccgcaaggggaagtccggccgcctcttatttccccctctccacccctcgagcaccactcccaccgcacacccgaggccgccgcccctttcaccgcctccagccgcgcgccaccgccgccctagccgtcgccccaatgcgccaccactgccagtaccttcgccgcctcaaagtcaagctcggccgccgctcggttgtcgcctctcgccgcccgagcaccaacttcaccaccaacccgagatcgccgccgtgtttgtcgtctccatctgtgtcgccccgcctccccggtcgacgccggactgcgccgtttcctccctcggatcggcaactccgagccgcaccccggccaccgcttcctcgcctccgggaaccactgaaatcgccctctccgcgccccggtcgtcccggtcaccgtccgccgcctcgcgcccgtggtacgccaccggaccaccgttgcctccccgaggagcccgccgccggcttcctcgttgtagtctcgccgtcgccgcccttggtgagcatccctcctctcctccccgcgctgtcgccggccgtcgccgcgggtggccgcgccgccgcgcgccgtcgtttggccagccggctttgtgccgtgctgtgccccagccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccgtccatgcttcatggtcgtaattatccaactaaaatgcaactgaatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacacatccaggcaagggtgggcgtgatggagcggggcgggccctgcgacggcctctgtcgcttccggattcacctaggcacgagaggggactgcccgttgcccgctggggacgggggtgaaatctgaggtgtggtgtgcttggttagagggggttatgcgaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcccttttccgctgctgctgctttcgtttcggtgcgaggactaagtgcctcttttgtaagtattttacgctttatttacgtttggaactgtatattacttgtcgttttgtgtaccctggctggtcctggacagggatttaatacacaaaatagtctagaaatttggactaaatttctgggcgtgacaaagtggtatcagaggcaacttgactgtaggttgagccaaatggtcaaaccctaaggacaagttttctgaaaaccctattcgcaaattgtctcctctcgcccttcggcatttctttgcgaaacagtttattaaaatttttcctccctgtccctccaactcttttagttgtcaaacatgtaggagaaaccgccagcttcatgcccgtccagaagtcaagtcgagtctcaagcttcgtgcaaggagcgggaagattagttcagagtcatcgttccgcgaagatcaagaagagttttcccgaagttcacctaaacctaatccttcccggaagagtagttcgttagattctagatcgtgtgttgtttgcttgtgtgtaggggtatggtttgcatcattggtggggatgcgactatactaggttgtttgcttaagcaacttgaacaataaaaatctattaacaacatatcagtaggcaagtggtttagtaccttatctttagcgacccctctcttccacctctcttccgtcctggcagcagatggtcagtgttagagataagatcaattaaagccacagatcaatggtttagttgaaagctgcaaggtgccccaatgccagatgaaacctgctcatgatcaacttttggtgtccaagatcagaagatgggtgtatcgatgtgggagatgcaggttcgacacctagtcaaatgtagcggaaataactccagcagtagtgtgttgcagtcagagtcagtggatcagttcaagacaacaagctaccagctaagtcagagcacctcgctctggttagccaagattggaagatggatgtgccagatattgatgtagcaaccgcagagtccaaagcagcagatgcaacgacaatgtctccaacaacaagtacaagctcagatgcaagccggaatcaggatcagagcgaaagtcagtttgttttccaagagcaagcacctgcaacctcagacagtacgccaccaagtctttagcagaccagcacagctaagtcacccccaatcccagaggcaacaagtgctacctatagtggttatggtttacaaggtcagttcttgcaaggttgttcaacggcaaggcgttagcgtcatcaagacaacagctctattcgcagcaccccagttcctcaagttgtgtcaattccaatgcgagtcggtcagtttagttttgagatatcaactacacaacccatttaggtggatgacaccgaagtcaggtcagaagaaggacagtcatgccagcagttattactgatgggatagtcagttaagagttagtaagatcaggagctaaatgagaatttctttatgtggaatttcctatcagcaactgagggttaagttccaaatcttaatgggatgaaagtgcatcgttgttactctattttgatcgatcggcgaagtttttagttttcaaagtcagggctcttcgcaaaacagagaagtgttggttatattcgaaggacaacagttcaaccgatctcagccacgcgaaagtaagactactccttgtaaggggggtaggtctcggagaagagttttgcctcacttcgtcgctgttttagttgaaggttcaaccagtgccgcaatcagggtagcacttgaagaagcatgttgcaaggtatcagaagaactaagccgatcccagggcatccgatgagcccagttcaacagcttagcttagaggagcaacagtgaggacagttgcagttcagacgaaagacaggtcaagcaggtttcctggaattacgtgtcactcgagtcagaacccgttcaagcggatgtaggatcaatgagttacaaatgccagatgcaagattcaggaacaactccatccttctctagccaacttggtgaactgtcaggttatcaaattgctagcatcaacggttcagtccaagataagtaagttccaggagcatccgcagttctggcctgggtcagttcaagcagaaccaatcagtccagttttggcaaagcaaaggaacagaaaggtcgaatccagccagttcaatcatgcaggtttgatcaaccagtcaatcaatcagttcgaagcagaatgtggcagttcaatgtgcagatcagtcagatcgcccaccagcactggctttctttctagccatcccagaatctcgggacgagattcctgcaagggggggagatttgtaacgccccgattttcgttcggcaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctct

SEQ ID NO: 26351 - DNA, 15267 bp, Oryza sativa
  unsure (1)..(15267): unsure at all n locations
cgttgatcagtggagatttaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagatgaagccccgctaggatcgcccttttccgctgctgctgctttcgtttcggtgcgaggactaagtgcctcttttgtaagtattttacgctttatttacgtttggaactgtatattacttgtcgttttgtgtaccctggctggtcctggacagtgatttaatacacaaaatagtctagaaatttggactaaatttctgggcgtgacagtattccaagggtatcgtatttatttaatcctgcgggaagattataacagagagaactatactaataatttatatattacttgtaataatcaaagtataagcaggggttaagattataaatagggtagaatgacacacagcaagagaattatatactctcataataaattatctaagctaagtgggaagagaatagaaagaatctattcttatacttctaatatagatacatattatacatatacatccaagttatatgattacttagctaataccctctttccaataccgtcctggtgcttcgagaagccacccctgattgccgagtttcttacaacaatccgtcatgaccatctaacctgggctaaatacggaggagtagcctccccaggaaagtaacttaggagtatatacacaagcggaggaatacccgtactgagctgtcaccatcagcggcccaccttgatgtattcgtagcatttaaccccaaataacgatatctagtaatctaaacaccacgcttaaattaccaaatactactctaatatcattgtcatgacacagagcaatcgtatgcacgatcattatacccacaccattgcatttcccagataagctagcatcataatcaatatagtttgaatgtatgatacaattggtactcatatattcggaaagtagtacaataccagagtagtataaagaagaatattttaataaaagtataagtcttacaaaagaaagtaaagctaccggatccatacccgattcctatgaagacttctcggactaagactcctattctattcctactccactagcttgagaagactactaaactagagagacagcttgattcttcttgcttgaggtgtgtgaagaaatggagggagtgaggggtttatataggctggtaatgacggttggaaaggtcggtaatgccctccaaccatcattggggatcaatcccagccgtccagccaaaccctacatccatcggtgctacggctggttcggccgaaccctgggctggctcagttcttggcaggtggcctccccgtttgctcctctccgcagacttgtgaattttgggcttgttggatcttgtgaatttggtgttctcagcccatttatccataagtttgtttcttgacagcgtctgaatgattgatcgtatgttttgctgtcacttctccttcatttatgatcattctctgcaaaaagttagaaacctagtgctagtggaatatattttagtttgacatgaaatatgcattgcaagcataactagttctcctttattttaataatattgacgggcgaaattgatcgctaacgaccgtcaacaaaaccccccaagcttgaacctttgctcgtcccgagtaaaggactcacaaaaaaaaacttggtagctgatcaggagttgctactatgctgtatatctcaaaagtataggtgcaagaagatatgtgtactctctctcaaatcaaataaatttggcacggtggcttacccttacccctgattcccacgagacactgtccttccttgtcttgagcggttgagagacagaacacaaacaacaacttgaatatcttgtggtacctcctcaacctgcctacgcaactctttcaaaataaccatagctctttcatatgcgaccttcgacttgcatgctgccctcatcactccaaatgcttcaatcatcatcatgtttgttatgtaattttcatgcaccccatccggtcctgcagtctcacgatcacacttgtcactgtttgctttcatggtatacctctttaggaatagacaacagggatcttctccagttggatgtgtacgaacgccctaatcaggtgtgtgcaaaacattcctacaacacaataagaaaaaaacaaaaacaatttttgttttgcaatcaacatgtgtgagctactccctctattccaaaatataatgcacaaccacgcttaacccaaagaccaagaaataattattatcatctcgtagtttggatcatcctaataaatataatacatgcatccaataggattagataacatgagagtggagaattttaaaaagcaataatttaatacgtatatcaatgaataaagggaaaagaagttccggtcggtcattttttcatgttaacaagtctagattaaaagagtgagaaataggcctaaaatcattaacacattctagattaaccttgggctataattggccaacaattttttaataaaacaaccattaaagccatctgggcctggagctttgtcaatcggaagtcttttaacaaggtcatccatttcaagagtgaaaaaatgatctaccatgctatcggtcactcttatatgttgtcacgcccagaaattcacgaaccagaatttctaagcttaatgtgtaataaacccctatccaggactagccagggtatacaaatgacaattgttgacatacagatccacgtcttacaaaaatataaaagattacaaatgcagcggaaaagataaaagcgagctaagcctgaagacttgactgctgcagcgggcgactccgttccacaggcatccttgacggcagcgacgaaaccaacttcttcgagacatctccaactgagaagaacttcaactctgggggtagggaaaagagagcaggactgagtactacccactgtactcagcaagtcataccggaagaggaggtatgatgcaggatatatccaagggaggctaaaggttctttcgcataaagctagcatttaaaagcaggagttgaaagcaataaaacagttgtagtaattaatcagtattaaccagtcactgtccaacactacaccatgttgcaacaggcccaaccaaccacctgaactacaccagttcattagctaactaggggtgagactaatcacggtgaatctggtcgaccgcccataaccgcgtgcacggctattcgaatagttttactctgatcagaggtgtacaactgtacccacaagacacagtcccacgacacgtttccgtgcgccgacatgccaccacgacataccggaaagaggccatgacaggatccttcgcataaccccctctaaccgatcgcatcacaccttagggttcgcccccgtccccagcaggcaacgggcagcccccctttcgtgccgcggtgaatccggaagccgatcaaccggacaccccgaccgacccaactccatcacgcccaccctcgcctgggtacgtcggctaaaggaaagcaacactacaagcctagccgttgcccatgctggcttgtggtaagcacgataagttcttccagggcatcccgcgaaccggtccttaatcgctatgggcacgactagcaaaaccatgcatccacagcccaccatgtagtgtattttaattaactaacaccattgcggtggctctattccaaagctataccaataatcagagtctatgcattactgtaattcccccctctatgtactagttgaactaagcatggctaagcgttccctaaaccaacatctaatcattttaatactgttaacaaccaaatttggtaacatctgtgtcaggaaagaagattggatcaaagcgaaatcggatgcggagatcgagttcggaaacagagcaggaatcggctggagtccagatcggctacgattaggattggctaggtctgagtcaggctaagtaagccgataacgccgattccgacaatacgatttgtacgcgacatcgggttcaagttaatgtacttcaagatgattgccacgcacggatagagtcctaggaaggcaattgtatctattaattaggatattttatgtagattccttatagataaatgtgggcaaaagtctgccgcaaagacttatggtatcttagagtttgttagagataatggtcgtgtccggtatgggcaatcttgtaattctcgggtataaatagaccctgagccctatgtaaatgataacacacacgttcaatacaattttggcgcatcgccaccctttttactttagttttgtttcgacgagttcttgctttcaggttgagctgcatagatttcgatcttcaacaagaggtaaaattcgttatgacggcttgtattcataggattagtgcttccatctttatgatactctaatcttgtttatgtaattcgtcgagttatcacatatcttatataatctctagcaataccgccatctaacctactatcggctaacatctgttagcagagggcagccgattaggttagattttgacgtcgatctagattatataagatatataccactctatgagacttctagcggcttgattgtctagatattgttcttcttttcatacttaatgctgcatcagctgagtttgatctattaagtcgtgcttagaatatcaatctctagcctgccttctagttatcgattagaatagcatcggagtttcagccgatcgtatctggtttaactatattttttctatatgcttcattgacatgttaaatctgccctttatatcaagatgttgctgtatctaagtatattaggcctttgtttgatatattatatttgctttaatatcctgatatagagtagtatcggagtattagtcgatacatgctacatctatctgatcggctatgctataaatatatatagtcctgttattgatatatatttcgatctaagtgatttatactgtctcggcatgatgaccgatctatcccaatcacttgatttaagtatacatcgatataaggagtatatatcgttaatatctatagccgatcgagtagatttagtgtttatttacttattcatgactgccgatcgaaacacagatgacatcggctcaaagataaatgatatgtcatcggcatctagccgatcggctatcatttatagatttaaccgcggtttctttgcttctatttcttgttgattacaggatcaaatcaactggcacgctaacacatccgaaggcgagctttggacctgcactggagttaagcagatctcccaggccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacaggaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagccggccggccggctacagcgagcggcggcggtgcacggtcgccggcgatggcaaccggcggcggcgaacggcgcggaaggcgtcggcgtcggccgaaggcaatggcgcgcacgcggtggatggcagtggacacgggagggagagaaagagggaggacagggagttctcaccatggggttggccggcgcgggaagaagggacgacgaacggcgatggcgaacgaccgggagatggcggcaagtgccgaacgaggtccggaaccacctagttgtcaaaataagagagattagagggagaagggaggtccgcggcgagcgaaaactagggccgaaggcggcggcaatggtggaagctcgccggagtgcgaggagatgcgggctccggtgacggaattggacgggggagcggcggacgaggtggacctcagccgtgcgaacccgacggcggtgctagcagtggcgagcggtggccggaggagtggaaaaggcggcggcggctggtgtaacggtgcgggaacgatggagagctcgggagcggctgatggaaaaaggaaaaaggaggaggagaatgcggggatggtttatatgggctcgggagggacggacgaggccgggaggaggccggatttctcgcngacgtgggggagtggggagagagagtttgggggggggggattgaaaccgaatcccgcccttgcggggctcgcgcgtgcgggagaggagggggaagcgggcggcgagccggcgacgtgggtgtggggtggggcgcagatgcggagtggaggaggtggggcgccggcggttggagctacggctccaacggctagaggaggaagacgaccgacaggtgggccccacctgtcggcgcccgaaggagagagggagggagggaggacttcggggaggggagaagcgggccggcgcgggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaatcctgttaatgtagtagagcatgtagaatctaagaaaaatttcacatgccgattccgattattaaatgcatttattaatttagggtttctctcttgcctttaaacaaataatttcttgcaacaatttattaattgaatttttgctaaggagaagaacttctgggcgtgacatacgtatacaatgaataaagggaaaattaacatttcttatacgtatatcaataataaataatgtagttgtactagactaagagaattaacatgaatgcggagattatacaccaaagtgaatgagaaatgaagctggcatgcaaagaaacacaccaccagcgaatcacgtgtgagcacacggattgatgggaccacaaattaggccaaatgttgatggtctttaaatcataatatttgaccgtcaatacctgcatataatgaaataaaataatgaaataaaatatggtattcaacttagtggtagggattattactacccaattccactagtgttggtgaaatatgtgtatgcgggtattttaatgagaaaacacaccagtcatgcaaggaaacacacctctggccaattagacgcaagtacacggattgaagggcccataagtcaggtgaaaccgccatggaatgcgtcataactgtcataaccgccatcagggcccaccagtcagtctcctggccaaagggaaggccaggaggtggggcccaaggtttggccgaaccaccaccggcgcctttgatcctggccttccacgtgtgcgttcctgttaacaaccgaatttggtaacatcagcgtcgggagagaagagtagattgaagcaaagtcggaagaggaaatcgggtttgaaagcagagcaggaatcggctgaaatccagatcggctacgataagatcggctgggtctgagtcgtgttgggtaagtcgatgtagccgattccgacaatacgacttgtacgcgacatcgggttcaagttaatgtacttcaagatgattgccacgcatggatagagtcctgggaaggcaattgtatctattaattaggatattttatgtaaattccttatagacaaaagtctgccgtaaagacttatggtatcttagagtttgttagagataatagtcgtgtccggtatgggcatatcttgtaatcctcgggtataaatagaccccgagccctatgtaatttttaatacacatgttcaatacaatctctgcacatcgccatccttttgctttagttttatttcgacgagttcttgctttcaggttgagctgcatcgatttcgatctacaacaagaggtaacattcgtcgtgatggattgcgttcttaggattagtgcttccatcctcatgacactctagtcctgtttatgtaattcatcaagttatcatataccttatataatctctaacgatatcgccatctaaactactatcggtcaatatctgtatgcagaaggcagccgattaggttagatcttgatgttgatctagattatataagatatctaccattctatgaaactgctagcggcttgattgtctagatatggttcttcttttcatacttaatgctgcatcagttgagtttgatctattaagtcgtgtttagaatatcgatctctggcctgccttctagttgccgataagaatagcatcggggtttcagccgatcgtatctgatttagccatatttattctacatgtctcatcgatatgctaaatctgcccttgctatcaagatattgctgcatctaaatatgttagggctttgtttgatatattatacctgctttaatatcctgatatgaggtagtatcggagtattagccgatacacgctagatctatctgatcggctacgctataaacatatataatcctgttattgatatatatttcgatctaagtgatttatactgtctcagcatggtgtccgatctatgccaatcactcgatttaagtatataccaatataaggagtatatatcgttaacatctacagccgatcgagtagatttagtgtttatttacttattcatgactgccgatcgatacacagatgacatcggcccaaagataaatgatatgtcatcggcatctagccgatcggctatcatttatagatttaaccacggtttcgttgcttttatttcttgttgattacagaatcaaatcaactggcacgctaatacatccgaaggcgagttttggacctgcactggagttaagcagatctcccaggccacgtgttttctgtcaacacgcttttggcacgcccagtgggacttgattagaagtcagacgtcagttcttcctcatggccgagaaacaagcaccaccaccatcaagcccaggttccattaaaggcaaggcattgaagccaggattgactgacatcattgatgacaatgtcatgccaatcaatccagagaaattcacgcctgagcagaagcaggagtttgaagcaatgatgcagcaagcacgggatcagtatctgagctcgttcatgcaaacccgcaagggaacgcttgttcagaagtataagataaatgtggttgctgatagtcctggaaccggttcttctaaagatggagaggtgaagcaagctccagaaggctcggctcagccgagcaacaaaggtgctactgatggttctctaggaaatcaaggcgacaaccctcaaggagtgcacggagctcaaggtgatgctgctcaagggtcgcaaggaggaaatcttaatcagaataatgagctagcacaagactttttcaacaactttcaagatcgggttgattacactgtgcatcatgctctgatcaatcagtccggggttttagtcaatacattgtcaaacatgatgaagacaatagccgatggttcgatagctaagcatcaggctacgggcccggtttacttgcaaggaggtgtcttcccgaattatcgatctctggtcatcgatgttcaaccagctgtgcaagcggttccctctattgcacccacaactcagccaacggcgccaacatcaactcccttgcccgctacatcagctatggcgctaggccagccgatgaaccctcggttgttaatgagggagcatccacagcctactgggcagatcgcgaatccgccgacccatgatcaggttgctgccatgtttttgccacctccacctattgttgatccagtgcagcagcagccgattcagcagacactaccaatccagccagttgtacagccgatccaacaataggtcgtacaaccagctcagcaaacaccatcaacacagcagcctatccaaccgattcagcaaacactgccaaggcagcggcttcagccgatccaacagactcaggtgcgacagcagatcgttcagctgattcagcacccggggtcggccaatgcatcagctgggttcgcagcacctggtgggcaacctgcgcagcaatttgtaaaccaagttgtctcagagcatttggttcaccatgcacagccggatggcactgtggtgcctcagatggtccctgagcacttggtacgcaacatccagccgaatcttcataattaccaagggggtaacttgagctatcagtatcagcctccttccccgcaagcccaatatcagccagggggattggctcagccccagttcgcacctcagtttggtcaattcgagcccatgcagcaacaaccgcaaggagcagctcagcaatgaccatgggccgatgtgattgccgatgtgatgagggagcagtttggacttaaaccaaaagaaactagaagtttgtatcggcagccttaccctgagtggtttgaaagagttcctcttcccaatcggtttaaagttccagatttctccaagtttttgggacaagagggcgtgtcaacttatgagcacatcagccgattccttgctcagtggggtgaagcatcggctgtagacgccttgagagtttggttgtttcggttatctctgtccggatcagcttttacttggttttcttctttgccgtatgggtcgatcaatagttgggccgatttggagaagcaattccacagctatttctacagcggggtccatgagatgaagttgtccgacttgacagcgatcaagcagcggcatgatgaacccatgcacgagtatattcaaaggttcagaaagatgaggaacaagtgctttagcttgagtttgaccgatgctcagttagccgatttggctttccagggtatgtccctccaatcagggagaaattctcatccgaagacttcgatagcttatcgcacctgatacagaaggtgaccttgcatgagcataggtcagcggaagtcaggaaaagctctaagaaagttaatcacgtttgtccatatatgtatgggtcggatgacgaagaagatgattctgagatagctgcagccgaatgggtgaggagcaaaaaggttataccatgccaatgggtaaaaagtcctgggaaagaggagaagtatgattttgatatcaccaaagctgacaagattttcgatttgctactccgagaaaagcagattcagcttcctgctggtcatacgatcccatcggctgaggaattaggcaagaagagatattgcaaatggcataattccaggtctcattctaccaatgattgtaaggtctttagacagcaaatccaggttgccattgaggggggaaagattaagtttgatgattccaagaagccgatgaaggtcgatgggaatccttttcccgttaatatggtgcatacagctggtcaagcaaccgatagggaccatgcaaagggttttcaagtaaattcggctaagattatcaacaagtatcagaggaagtatgataagcagcaggagaggcgttatgaggagtacgatgatggttttgatcctcattggggttgcgagttcttcagattctgctggaatgaagggatgaggttgccatctattgaaaactgtcctgggtgcagtgatatcatcgagagctcaagccgaccacgtaatagggatgatcggctgagacagacaagactccctgttcatcaaaggttgggtccgatgaatcaagatcgtggccaagaggatgaggtgatcaggaagaatcaatggtgtccttctggtattttcacgaagaatcagaaaaggagggtccagagattgaggagcagggaacgttttcaggaggttgaagaggaaatcaaccattggctgaggaaaccaaagccaagacaggagtggcgtgtcaagaatcaggttcccgtagccgatgatgctgcagccaatgaagtgaagaagttggcaaaaggaaagagtgttatagcggcaccgattaatatggtctttacattgccacctgaattctggatcgatcaggccgatgttgatgaggtggaagaggaatcggctaagttggtcttgtcaccagaacaggcagtattcgagaaacccgaggggacagagaatcggcatcttaaaccattgtatgtaaatggctacatcaacgggaagccgatgtctaagatgatggtcgatggtggggccgcggtgaatttgataccttatgctacgttcaggaagctgggtaggaacgccgaggatcttatgaagataaatatggtgctcaaagactttggtggtaatccatcagagaccaaaggtgttccaaatgtggaactaacagtcggcagcaagactattcctaccacgttttttgtcatcgatgggaagggttagtacaactttgtatgctcgaaaggggaattggattcaatgcctaactgttgcaatctcttcgactatgcatcaatgcttgattcaatggcaaggcaacaagaatgaaaatgtgccacccaccggtcaattaaaggtgcccgggcccaattaaccctttgggaaaatggatggctttgttggttaatttggaaaattctgggatggagattttctaaaagtgtccgattctgatatacagccaatcgaagatggagaacccaagctattactttgagggcgttgtggagggttcgaatgtctacgctaaggatacagtagatgatctcaatgacaagcaaggtcaaggttttatgtcggccaatgatttggaagaaatagacataggtccaggcgatcggccaaggccgatatttattagcaaaaatttgtctccagagtttagaaccaagctgatagagttcctaaaagagtttagagattgctttgcttgggagtactatgagatgcccggacttagccgatcgatcgttgaacatcggccaggggttagaccacgtcagcaacctccgaggagatgtaaagccgatatgctcgaacctgttaaagctgagattaaacgattgtatgatgctggttttattcgtccctgccgatatgctgaatgggtttctagcatagttccagttattaaaaagaatggcaaggtcagggtgtgcattgattttcgagacttgaataaagctacaccaaaggacgaatatccaatgccggtagccgatcagctggttgatgccgcgtcagggaacaaatttttgagttttatggatgggaatgcaggatataatcagatctttatggccgagggagatatccataagacggcttttagatgtcctggtgcaatcggcttatttgaatgggttgtcatgactttcggcttaaagagtgctggagcaacttatcaaagggccatgaactatatatatcatgatttaatcggctggttggttgaagtctatattgacgatgtggttgttaagtctaaagaagtggaggaccacatagccgatttaaggaaagttttcgagagaaccaggaagtatggcttgaagatgaatccaacaaaatgtgcttttggtgtgtcggctggccagtttttgggatttcttgttcatgaaagggggattgaggtgaaccaaaggagcgttaatgcgatcaagaaaattaagcccccagaaaataagacggagctacaagagatgatcggcaagataaattttgttagaaggttcatttctaatttgtctggaaggttggaaccttttacacccttattgaggttaaaggccgatcaacaattcacttggggagcagagcagcaaaaagctttggataatatcaaggagtatctcagctctcctcctgttttgatccctccacagaaaggaatactgtttaggttatatttatcggctggcgagaggtcaatcggctcggttctgattcaagaattggaagggaaggagcgagttgtgttctatctcagtcgacggctcttggatgctgagactcggtattctcctgtggaaaagttgtgcttgtgcctgtatttttcgtgtacaaggttgaggcattatttattatctaacgagtgcactgttatatgcaaagccgatgtagtcagttacatgctgtcggctccaatattaaagggacgagttgggaaatggatattttctttgactgagtttgatcttcggtatgaatcaccgaaggcgattaagggacaagctatagctgattttattgtggaacatcatgacgattcaatcggctcggtggagatagtaccatggactttatattctttgatggatcggtgtgcactcatggttgtggcatcggcttagttataatttcccctaggggggcatctttcgagttcgcttatactatcaaaccgtatgcgactaataatcaagctgaatatgaagcagtgcttaaggggttgcaattactcaaggaggttgaagccgatatgatgaaccctgagttcctctcgacactcaaggctgttgttggcccgatctttcggtgagttgtgataactacgatttgggagaaacgttgacgatccgactacaaccgtacgagacgttgtgttgcaccttagcgatcgatacacctctccgtgggttgctgatcttgccggtgcagatcaaccctattcctgcaagcaaatcgaagaaacaagcaagaacaagataaaagcaatctgataatgcaaataggaatttaatacaaat

SEQ ID NO: 26352 - DNA, 877 bp, Oryza sativa
tatcggttagaggaataggaggttgggcaagtttagcgaggcaaaagtattacttcacaatcgtgggtgggcgacggaccgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtatagatggccatgtgggcagcttgtcgggccggcacggtccgaccgacgcaccgggctgtgccgtgccaacccacgtgccgcactcacggcccaggcatggcccaacacgactcgggccgtgccgggccggcccaaaggtagagatggcccatcgtgcttttcctcagaataagactaattttcctccctcctattgggctgtgacatatatattgctaggaataagttcacttggtgaccctcaaaagtgattgaaattt

SEQ ID NO: 26353 - DNA, 409 bp, Oryza sativa
cgccggcgccggcgaacttcatcgctccgggaaaacggcctctctcctccatgacgccgacgatcatactaaaggcaagcatatagtagtaactactaaccatttcgctgacgctgacgagctcgccgatgctgaccactgcagtgctatctgtgcagaacggacagctcgccggagtagtcggcggcagtggcgggacgaacatcatcgcgacggcggcccaggtgttcgtgaaccatttcatcgtcggcatgcacccgctcgccgccgtccagcatcccagagtctaccacaaggcaagcacgcatgcatcaattaattaccttaatctcgtcgattaataaacagcaattaattaattactgggaaactcaattaggatatctctcacttttacatgtcgctttaa

SEQ ID NO: 26354 - DNA, 321 bp, Oryza sativa
aaatttctagtgcaacagacccaggctgcggatgagcaggtgggagacactcaccgcgtcagtggcgttgtcggcgtccatgtcggcgcgcaggcgggcgtagagctgcgggctgcggtacagcgaaccaggcgccgggcgcgagatgatgcggggcacgctgtcgagagagatggagcccatgtagagcagcatcgccgcgacgtacagcagcggagcgaagaggaagaccgcctgccgccgcagcagcgcggcgagcaccaccctcgccgccctccgcacggcgcctccgccccgcacagctccggccgcgcctgcccc

SEQ ID NO: 26355 - DNA, 630 bp, Oryza sativa
acgagtttaacttcactggtgagtggtcccctgaggacgcctaagcggcgaacccagaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcacaaagaggatgccagcaagccactgactttacaggattttttctcacgcatcacaaaccaacgaacgatgcgatcgacgaagaaccatccacccaaacgatcactactggctcaggagcagcatcgcctccggccgctgctgcccgaagccgtagaacgggtggtggtagtggtgcggctcctccgccgccgcctcggccttcgcctcggccatcgacaccaccagcaggttctccttgtcgccgtcgtccacgcaggcctcccttcttcacctgccctcgtaccgcgagttg

SEQ ID NO: 26356 - DNA, 641 bp, Oryza sativa
  unsure (1)..(641): unsure at all n locations
cagtccgatgaagaatgtgatggtaaaggaaaaccggtacgttttccacggccgtcttgctttcagcttatcgagtacaagcattcaccggcgtcagtgcaggtcgtcaatgggggctcgaggcgggtcacatgccccatttgtagcttatgtacgccgctcgcatcatccccgttaaacgacaataacttgtgaaaggaagctggtgagtcgagcatctcgtgaaatctctctgacggatttagattcgcctttttgcccgttcattgtttcagttacccatttttggccaggtgccttttggtactgaatgaatcaaggcttctcaaacaggcgtcacaacataccgtgctatcgtagtggtccggaagacgatacctcacctgaggaaagttcggccatatcttgctgttctggtcaggttgagtgtaatacacacactannnnnnnnnnnnnnnnnnnnnnnnnnnnnnnnnttcactacgcccttcacgtgccccattttcacacaacagagtaaacaccgcccaggaccaaaacaatgtcgaatcttaagaccattagtttcgaaatatttttgatcctgaattgagggtacagtaatggactagttttttttttttgaaatttacagtaatgga

SEQ ID NO: 26357 - DNA, 11522 bp, Oryza sativa
  unsure (1)..(11522): unsure at all n locations
nnnnnnnnnnnnnnnnnnnnnnnnnnnnnnnnnnnnnnnnnntagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcacttggggtagttcttccttcactccgaaggtggtgaactccaaaccactcacaaacggtgccgggcctcctccacaatctcctcggagaggtcaccgggcaacacctccacaagctgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttatgaggccggtcagaccggactactttgtaacggctagaaaactagccgttacagggcaatcattgagcccactcaacctggccggtctgaccgcagtgtaggggccggtcagaccgccgtcggctcggtctgaccagttgcggctctggcggctctgtatcgccaccaaaaaccagaccagtgcaatagactagtggggccggtcagactggccttaccacgccggtcagaccggctaacagacccggtcagaccggcctaaggcccacggtcagaccgtaggtcacttttcagctcaaccgactgttagtaaaacggtgatatctcttgactcgggtatcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcataagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcctttgtcaagactttattctcattacaagcttgacttcattcttgccaacatgacgatgtccttggcttggtgaccactaacccatggtgtcattcattagcctcatcataatgggacctattccttttcacacctcaaaggagaacattagtctcaacaaatcggttgtcatccttcacttgatgaccaaccggttgcatatgaaagatatagatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagactaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagaaagaaatcttataataaacaaaatatagaataagctccccctcaagatgtgcatacatatggatatgaaggaacgcatatgcacataatcaataaagatcaaataggaagctcacactatattttggatccacaagagagaccaagttagaatgtgtgaagtttaatacatacctctcatcatttttactttcatatccaaatgagactagtcaaagaaaggctcataaaaatgttagtctcatataattaaatttgtcattaatcaccgaaacagaattaaggcacttgaacttatagtaatgggtatacccacgggcacaaataatctcacgggcatgggtatgggtaggaactacccgtgcccgtcgcgcccgattgccatccctagtgaaaattctttattttgaaacacttgaaccggtgtaccgtccatcctctcccaccttcgtgtgacctctcgccatgtccacaatggcttcaccgacgaccctatttggcgattaaccctcaaggcctcgaatacgaaggagccatcgtggaggtgctgtatgggacaaatagggtctgtttgggagagcttattctgaaaagtagcaagtgagaatctagagaaattgagaaactcatttctggattctacaactgtagattctcataatctaaatgaaaaactgaactgtatggaggagctcgcagctagagattatagaagaaactgcagttgtcagaaactcccctaacagacccataagctatattgggaacaatgtgggcaaggaggatgtgggggttgagcttaacacgggcatgtagtgacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaccgcgatttctttgcttctacttcttgttggttacaggatcaaatcaactggcatgctagcacacccgaaggcgagctttggacctgcactggagttaagcagatctcccaggcctcgtgttttctgtcaacacgcttttggcacgcctggtgggacaactaagaagtcagccaacaatcctccctcatggccgaaaaaccaccaccaccaccatctagcccaggctctgttaaggaaaagatgctgaagttgggattgactgacgtcaatgaaggaaacgtcgtgccgatcgatccagaaaaattcacacctgagcagaagaaagagtttgaagcaatgttgcggcaagcacgggatcagttcttgaactcattcatgcagacccgcaaggggacacttgttcagaagtacaaaataaaagttgttgctgatgatcctggaaccagttcttctaaggatggagatgggaaacaagctctagacggctccgctcagccgagtatcaaaggtgctgccgatggctctctaggaaatcaaggcaacaattctcaaggggtccatggaggacaaggtgacggggtgcatggagttcaaggtgacggtgctcaggggctgcagggaggaaatcttaatagtgacgtggcacaggactttttcaataacttccaagatcaggttgattacgctgtacatcatgctttgatcaatcagtctggggtgatagtcaataccctgtcaaacatgatgaagtcaatagccgatggttcaatagctgaacatcaggctgcaggcccgatctatttgcaaggaggtgtttttccaaattatcggtctttgattaccgacgttcagtcatctactcaggcagttccctccgttacacccacaactcagccgacggcaccggcaacaactcccctacctgctacatcagctatggcgccaggccagccaatgaatcctcagctgttaatgagagagcatccatagcatagtgggcaggttgcgaatcggccaacccaagatcaggttgctgctatgtttttgccgcctcaacatgcggttgatctaatacagtagcagccgattcagcaacagccgattcagcagacaccccaaattcagcaggttgtgcaaccaatccagcaacaggtcatgcaaccagcacaaccaatccagcaacaggtcatacaaccagttcagcaaacaccaccaaggcagcagtctctgcagccgatttagcaaacgccgttgagacagcagatcgtctagccgatccagcaccaaggtttagtgagcgcatcggccgggtttgcaacgcctggtggtcagcctgtacaacaacttttaaaccaagttgtcccagaacatttggttcaccacgtacagccggatggcatagtaatgcctcaggttgttcctgagcacttgctgtgcaatatccagccggaccctcacaattaccaagggggtaacctaaattatcaatatcaacctccttccccacaagcccaatatcggccagggggattggctcaacctcagtttgcatcgcaatatggtcagttcgagcccatgcagcaacagtcacaaggcgcaactcagcaacgaccgtgggccgatgtaattgctgacgtaatgagggaacagtttgggcttaaaccaaaagagatcggaagcttgtatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagatgaagttatctgacttgacgacgattaagcagcggcatgatgaacctgtgcacgagtatattcagagattcaggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggggacagagaatcggcatcttaaaccgttgtatataaatggctacgtcaatgggaggccaatgtctaaaatgatggttgatggtggggctacggtaaatttgatgccttatgctacgttcaggaagttgggtagaaatgccgaggatctcatcaagacaaacatggtgctcaaagacttcagtggtaatccatcggaaaccaaaggtgttctgaatgtggagctgacagtcggcagtaaaactattcctactacgttttttgtcatcgatgggaagggttcttacagcttgttgcttggaagggattggattcatcataattgttgcattccttcaactatgcatcaatgtttgattcaatggcaaggcgacaagatagagatcgtgccagtcgacaggtcagttaatgttgccagtgctgatttagctctttgggagatggatagccttgattgtttatctggaaaagtctgggatagagattttctaaaagtatccgattctgatatacaaccaattgaagatggagaacccaagctattattttgagggcgtcgtggggggttcagtcgtctaccctaaggatacagtagatgatctcgatgacaagcaaggtcaaggtttcatgtcggccgatgatttggaagaaatagacataggtccaggcgatcggccaaggccgacatttattagtaagaacttatctccggagtttagaaccaagctgatagaactcttaaaagagtttagagattgcttcgcttgggagtattatgagatgcctggactcagccgatcgattgttgaacatcggttacctatcaaaccaggggttaggccacaccagcaacctccgaggagatgtaaagccgatatgcttgaacctgtcaaagctgagattaaacgattgtatgatgctgattttattcgtccttgccgatacgctgaatgggtttctagcatagttccagttatcaagaagaatggcaaggtcagggtgtgcattgatttccgagatctgaataaagctacaccgaaggatgaatatccaatgccagtagccgatcagctggttgatgctgcatcagggaacaaaattttgagttttatggatgggaacgcgggatacaatcaaatctttatggctgaagaagacattcataagacagcttttgagtgtcctggtgcaatcggcttatttgaatgggttgtcatgactttcggcttgaagagtgctggagctacatatcaaagagccatgaattacatatatcatgatctaatcggctagttggttgaagtctacatcgatgatgtggttgttaagtctaaagaaataggggaccatatagccgatttgaggaaggttttcgagagaactagaaaatatgacctaaagatgaatccgacaaaatgtgcttttggtgtatcggctggccagtttttgggatttcttgtgcatgaaagggggattgaggtaactcaaaggagtgttaatgcgattaagaagattcagcctccggagaataagacagaattacaggagatgatcggcaagataaattttgttaggaggtttatttctaatttgtctggaagattagaaccttttataccattgttgagattgaaagctgatcagtaatttacttgggaggcagagcagcaaaaggctttggatgatattaaggagtatcttagctctcctcctgttttgattcctccacagaaaggaataccgtttaggttatatttatcggccggtgagaagtcaatcggctcagttttgattcaggagttggaaggaaaggaacgagtcgtattttatcttagtcgtcggctcttggatgctgaaactcggtactcccctatggagaagttatgcttgtgtctgtatttttcgtgtacaaggttgaggcattatctactatctaacgagtgtactgttatatgtaaagccgacgtagtcaaatacatgctatcggctccaatattgaaaggaatggttgaaaagtggatattttccttaaccgagtttgatcttcggtatgagtcaccgaaggcgattaagggacaatctatagccgattttattgtggaacatcgtgatgattcaatcggctcggttgaaatagtaccgtggactttattctttgatggatcggtgtgtactcatggctgtggtatcggcttagtcataatctcccctaggggggcatgtttcgagtttgcttatactattaaaccatatgcgactaataatcaagctgagtatgaggcagtgctcaaagggttgcaactactcaaggaagttgaagccgataccattgaaatcatgggggattctctgttagtaatcagtcaattggcaggagaatatgaatgcaagaatgatacattgatggtttataatgagaagtgccaagaactaatgaaagagtttcggctggttactttaaagcatgtttctcgagagcaaaatattgaagctaatgatttagctcaaggggcatcgggatataagccgatgatcaaagatgttaaagttgaaattgcagcaatgatagctgatgattggaggtatgatgtacatcgatatttgagtaatccgtctcaatcagcttctaggaaattaagatataaggcattaaagtatactctgttggatgatgaactttattaccgaacgattgatggagtattacttaagtgcttgagtgctgattaggctaaggttgcaatcggcgaagttcatgaaggaatttgtggtactcatcaatcggctcataagatgaagtggttgcttcggcgcgcagggtacttttggccgacaatgctggaagattgtttcagatattataaggggtgtcaagattgtcagaagtttggagcaattcagcaagcaccggcgtcggctatgaatcctattattaagccatggccgtttagaggatggggcattgatatgatcggtatgataaacccaccatcgagtaaaggacataagtttatattggtggtaactgattatttcaccaagtgggtggaggcgattcctttgaagaaagttgattctggggatgccattccattcgttca

SEQ ID NO: 26358 - DNA, 85712 bp, Oryza sativa
  unsure (1)..(85712): unsure at all n locations
tcctcaaactattactactgatcagggttcaatcttcgtgtctgatgagtttgttcagtttgccgatagcatggtatcaagttgttgaattcttcaccttattatgcacaagctaacgggcaagccgaggcatctaataaaagttggatcaaattgattaagcggaaaatttctgattatccgcggcaatggcacactcggttggccgaagcgttgtggtcttatagtatggcttgtcatggatcgatccaagtccctccttacaaaattgtttatggacatgaggctgttttgccatgggaggttagaatcagctctcgaagaacagaattacaaaacgatttaacggccgatgagtattacaaccttatggccgatgagagggaggatctggttcagtcacgattgcgtgcccttgcaaaggttaccaaggataaggaacgtgttgctcggcactgtaataagaaagtggtacctaaagatttttcggaaggagaacttgtatggaagttgattttgccgattggtactcgtgatggtaaatttgacaagtggtcgccgaattgggaaggaccgtttcaaattataaggttgtatctaaaggagcgtatatgttgcaagggcttgatggtgaagtctatgagcgagcgctcaatggcaagtatttgaagaaatattacccaagtgtttgggttaacgcataatcggctagtattgccgatgcatgacagccgatgtgtttccatcgccttgagatggccgatatggttatatcacccttagttgtttttttttcctggtgtaatcggttgtggtttgccgatgtacaatggccgatatggttatatcgcccttagttgttttttcatggtataatcgattgtggtttctataattttatcaatgcttttgacattgtaaaattagggggcacatatgtatcaaaatgaaatttttttgagcaaatttcgaagtcatattaatcggcacaaaggattgtcaagacagtaaagtactagagcatcttagccgattacaaagatttctaagtcctattacataaaagttattgagacaagtattgctggatagccgaaatagctttttgcctaatttgttcaacttcctcaatagcttgggcaccttgagcatcagttccaggaatgatcttcaaagacttagtcagatcagcaacattcttgatagccgatttaagtcttgctttttgttcttcgacagaccgcgggagatcggctagtttcttgtgctccagatctaattcggcattgcattcctgaagttgtgccaggagctcaatcttgcgagcctcgagccgatcaatgttggatttgatcggaccttctgaaagctgatcaagtttggattttttcctcatgcacaagttgccgattagcttggattgtagcttcaatgtctttacgttctcgccgttcggtcagtcttaacttggctttctccaatttgaattgatgttgctcaagataaacggctggagtaaggatatcgactaactcatctgggatcagagcttgaatttcatgtagctgagtcctaattgaggcgcaatcaactaccaagctatctagtgatgatgcctctagccgatgagaaatattttccagagttttcttcacgtcatcggataaaggggctaaggctttgcttatggtgtcttcttctccttcatcaagataatctttgatgtcaaaagaaaaaagatcggctaagacctgcagcgacgatttaaagagagttaggggtcaaataggcatagccgatctgaatgttttttgtcaaaagaaaacctactgggatagtaggaacagttggttgaatttcttcttctatatggtgacttcctacagctgatggagtctggtcacttgttgattgctgtacagaaggagaaggaggaggaggaggcttaaaaagaaacaagtgttaggcaaaatcggctgagagttaattaatggaaaattgaggttatcttactggtggagctggtttagatgttgtcgcagccaatttctttttcacagcagtcttctttttctgcaattattaaatctttaagtaatcggtcataagatacaatgattataaaagggattaaagggagctatttactcttgaaaagtggactggagcagaaggagttggaggggtttgtttgggtgaagccgatggtgttcgttctgtatcgcttacttcggctgcggcctcgtcaatgtcatcttcaataatttcttcatccagagcttgttcaatggatggatctagagcagatagatcatcagctggtgtggtcttctttgtcttagtcttcttctttggagctggggctgaaatatttatagccgatgatctggtctttcttttcttgcgggcatcagctggttctctgataagcccttggagaagagctgaagacttgggggcattatagccgatgacggggggagatggcccacctccgttggggatcagtcctggggcatactcgatatccctgccgctgttgctttggtgatggggagaagattctgttgtctgtaaatcaggaggaaagttagctaagggctaatcaaccaagtagttattcaaataaaatcaagtgagttaggacttacttgagggacaatatctggaaagagatctatcatatacttggaagccgattgatggaataagtgtagcttccattcaccccaccatctgtcaaataatttgctcctaaaggttgccagctttatggtgtcaatgctgcctagaggaggtccttggagattgagcagccgatccatcattaaagatgatgagatttctcctcggcattggatcttatcggcaaagaataagccaattgggagttggcccattccaaattgtctggcagaactcattggatgataaaactcgtaggaaacttggatggttctcccttgatgaatgccgactggaaggatgcatggggtgattgcagataagaagatttctctgggcttctgatatctgtcattgttgatgtcttcgaatttgaagtcccatggattttctagaagtgttgagtctccatagagaaaccaaactcgagcatccttttggaacccctcataaaagctacaaaaccaatctttgagcagctcggccgatagctttgctcctgcatcagttggggtagaggcgtactctccatatgatgtgcatctccgatgagtgagttcctctccgtcatcgttaacagtcggctctaatcttgggaattcagtttctgttacagatggccgatcgacgaacctcatgactaccaagtttagccaggattgcagcagccaccatggtccacccgctccgactactgagccgacaattagcttagccgatgcattatttagcatttggtacaagtagccgaggaggattttgcctaaaggaaattgtctttttgtctccaaggcttcggctacgaactgccaattggttgtaggaccgcagctagacccacaaaagagaaacttttctaaccacattaataggaaagccacatgttctcgaggggtaactggaccctggcctatatatgctgctacatagcctgaccagccgcctatgctcttggtcttgaagtcatattggttctttgtattcaaactcatagggttggccgatgaggtgacatccagacccgtgatcatgctgatatctatgagagttgggatcatcggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagatctcccaggcctcgtgttttctgtcaacagacaccctccgaatgcctgcatgtcgtcgtgcgcgccgcattctgtgctgtccacccacgcccaccgcccgtcctcgccatgcacgcagcatgtgcgagagagaggaagaggggaagtggagtatgatgactggattgccacgcgtgcgccacgttggacaaaaccaatcttaatttggtctagggggttaatttgtccggtatggaaagttcaggatagggtttagggggctatcaaattttagttatttctaaattatatttctatacaaactctatactccacttccaatgttctttattttttaattatgaattttcattatttataagttttactcctatatttcttattttaaattcaaaacttcagttatttctaaattatactcctatatgaactctagacacttcttttaatattgcttattttttttaatttgtgaattttcattatttctaattgtatttctatatgcactctaaactcatcattcgatattatttatttttaatttatgaattacagttacttctaaattgtatttttatggactctagactattgttccaataattttcataatttctaattttagttatttgtaaattgtatttctatatttactctaaactcaacttttaattttattgtttttattttgaattttaattaattctagattcctatatggactatatactcttattctaatattcattattttaattcctaatttctattaagtctaaataggctataaacttacctttcaatatttctttttttatactccttccatccacaaaagttacacctattacttttgtcgccaagaccaaggaaaaattgaatcatcttgaatgttacaaaatcaatgagtgaatgcaagcatgcaactaatgagtatttagatgactccttggattgtactccctctggttctatattaattgacgttttggacaaggttgaggttaaacttttataactttgaccatctataactttaaaaatattaagtttaaagaaactagaaaaacatatatagatttgtctttcaaaacactataataaaagtaaacatgcatttatttattttatatattataatagagaaataaggtcaaagatatatcttgtagagcgtatcattatccaaagcgtcaatcaaaataaaaccagagggagtaatcaaacatttaatttatctcctcaatcatcttgaatgttacaaaattaaggagtgaatgcaagcatgcaaccaatgagtatgtagatgactccttggattgtaatcaaacatttaatttatctcctcatttaagtctttttttttataattacacagtacaacgcatacactcacaacgcacgcgcacacagccttatgaaggcacgcacgcaaaccctacccctatgagcatcttcgaagactaagccggcaaatccttgagattgatgaagtcaaacgcacgctcattcacacctatgaacgcacgcacgcaaaccctacccctatgagcatcctcgaagactaggccggcaaatccttaagattgacgaaatcatcacaggcgcctcgctaccacttaaagcacaacactgttaaatcgtagaaaattcgcttccatggagagtcgaacccaggacctcagatgctactgagactcttgtaactactataggctacaggcattttcgctcctcattaagtattgaatgcaaaaagactacaaaacttatttggaaaaactcaaatgtaaaatatgtctaacttttatggatggggggagtaattccgaatttcaattatttttaaattgtatttctatatggactctatattcttcttccaatatttattattttttaatttcaaattttcattatttctaaattgtatttttatatggactctaacctctacttttaatttttcttatttttttaattccaaatttccattagttatattgtatacccgtataaacttcagtcttccttttctatattcattatttttaatttcaaatttcatatatttttgaattgcatttatatatagacttttttttattaatatgagaattttcagaccatagagcgaacgtggaggcttttttctattccttaaataagttaataaattctatagttttatagtcctccaattaccaaagtgggtggtaggatttgtgggaccaatgaatatacaaagcttattgtgcatcaaccactcgatgagatgagagagagaataatatgtttgtaaacatcagcgcccgatattttggcaagagcattattttggatattcctaaaatatctgtaggatttatggaagccagttcatgtgttctgaatggccatatagaaatttgttcttagtattttctacaaaaagtatcgtcgtccgattatattcccttcaagacccttaaagaaaaaaaaaagcatgagaccacacctcgcgaacgtctgttttaaaatcttccagggttccaacgtaaaccaatgcacatgacacattgacaccatattcttgcattttcccaatcccattttggataatccaaatctaatgcacatgacaccatatttcttacattttcctaatctcattttggataatcctgtgtttcagaggattagcatccacaaatttttggttaatcgttgggccatttcgccattggaaaccaaatagctcccaatcttacagcccaatagaccgttacgatcacgtcaggacacaataggcaagaacagtttcaaggacaaaactccacagaatcaagggcaatagaaccctgagaaattgtgacaaaaccgatgtatcgaaacatgtgccaaaatttcaatgctcctcaatagcattgcaatgttctcaacggcaatacagcacctcgatctagagcttactataggtccatataaatgaattacaataaggattgcaaaaagatcttcaacttgaaacttctatttcttcttgtcagtagtaccagcagacctgcacaacaagagaagggatttagtttgcaaattctctttgtcaaaggtaagaattggccagaaaatgaaaaatgaaacaaaacttacatacaactgaggtaccaaaacaacggagaaaatcatttgtactgctttgaattataaagctataataaataacagaacagaagtatagggacacaagttgggcggacaagcgggattattttatttttcccggttatcccacttatagttcactttttcttccaaaatttgtgctaccatgtgggaaatgaactagcaagaaggtatttatgcaaatagtggtattgtccacttgcacccctacatagctacagaaaaaggaccaagttaatttagagacaagtccaatatttgcagaatgcctcttatatacttgggagtacttacacaaataaatctcacaacaatgttaccgataaagtgctactccctccggttccataattcttgacgttttggacagagtgtagtcaaacttttataactttaactatcaactttaaaagtatttagtttaaaagaattagaatagcatatatggattcatctttcaaagttctataataaaagtaaacatgcatttatttattttgtatattataatagaaaaacaaggtcaaagatatattttgaataccgtgtcattgttcaaaaagtcaaaaattatgaaaccagagggagtagaacccattctacaatacgcacggaaaaaaaatagcaactaaaaaacagagaacatcaacaatgaaattgcagaatgcagtagtaaagacacacacctcatcttcctgatgacacccgccatctcctctctcttcttctttgctctcttgtgggtaccgagctttctcttagcgaccttcagtgcacgcttgtcctttccaaccttcagaagctcagtgattcgtttctcatatggagcaaatcccacaacctccctaatcaagcccctgacaaaattcactctcttggtacttttctgcaataagacaagaaaacatattaatgaaagaatataaataggaagcagctatggtgtatggccgtattcatcaggaagacagcaaaagaaatctctggtcatagactcgagaagcagctatggtggagattgtagttctcctcagtaaagtgaatttttttttcacgtcataggctcaagagatcacaagatcaactaatggtaattcagaattttctatttgacatgaggtgacaaagcatcacttcatcgttcatttgtcatttcaaaatattgaagctgtggaagttaaaaaatagattttaacagaacatcatttttatttgcttttatagctttgctcagaaaggtaaaccaaagatccacacaactgcacaagcaaaaaacattcaatttttgtttacattgcacagaaaccgaatctacattactggataataaaaaacaaaaaacattaaaatatttagaacaagacaaaacagaggtaaatttagtgagatattttagaaacaaaatcatgaggtgattaagcttccacgttagactcaccaaataaatatatgcctccaggactagcaattttggagttgtgttttctccaaattgccaaaggtgagacgaggcacaaagacatcagtgtgcatacacatctaagccattcaaatgcaattttgatgtacagaaaacgataacccattgctgatacttgccattaacacgccaccatttcaggcaaataaattaataaattaaacacaccattcttagtccattataatcaaattgccaggaaggtgattaagcaagcacaagccaccacgcacttactcatgtccaatggtaatttagacaaccatataattttatgccgacataatatataatttaacaaaaaaacagcagtcgctgctccgatgtctagtacgacgaaacgaaattagctagcaaatacagtaactgtaccatatagatctaatcaaacagatgacatgcccatgttgctacgatacgagatgagcaaggatagagaagggaggaaacaaattacccccttgcggtcggacgggcgaggtggcagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaatcttcggaactaccaaatgttggtaggatggtgttgttaaggtagtgtttagtttttttcccaattaaaatttggtaacactaaaatttggttatgttgaaagtagcggtaaagtggcacatgccctgtatgtcaaagaagagcgtttttttctttttagagatgcaagcccttatacataggtacattcaccctttagcctttgtaaaggcgaatccgaacaccttatcctctatggatacgtttaaaaattggtgtatattttgaggcgaacgaaagtcaccataaacgtcgtcatctatctatctatctatctatctattatctatctatctattatatactaaaagtccataaaacttcctacagacgttctcaagccaccacgtggcgctctaataaaatagagaaaatcctagaaattctaagaaaaaagcaaaacatctatcccttgattttaaattaaattggcggggtccaatattacacaccgttagataaaattgatcttaaaacaaactaaatactatgggtcccacctatcctcctcccgcacattggcaggtggattatatacgtgcgtactgtacatacgattcctccccttttttttcctttttttcttcttttttcaatttatatatataatggatatattttttaaataataataattttacaaacaaagaatctaccatcatataatttaaaccggtgtactctttactttgtactattattttcaaataatgcactattttaaaataaattttacacaattatatcgtgtacctatcaaataaacaatatctatattaacaaatttatacgtgcacttaaactgatggccctattatataaattatcggatctactttttacattggtctattattctcaggtaatgcactgtttcaaaataaggtctactattattaactaattaactaatttaaattctatattaactaatttacacttacactagaactggtggacatattattataatcattggatctattgtttgctaataaataaagcgtccgaaattctctttttgcatgctgcacagcgcacgtctgcaccttggcctttcgcacgtgtgacaaagcgtagtgtctgagacatctaaggtgatcacaaccgctctagcactaccgctttgccacatatcaaatcataaatcatatatgaagatgattaattttgttaataacatgaaaagaaaattaaaggtgatgcaacgagagaataattaagcaccatgggttgtgtttttctcaacactaattagctctgtttaagttgaaaccgagagttgattacataataattataatgtatttgtgttatgtcgtatttggattttgtactatttatctgtacaggtgaaatgaatcattatgttataaatgcgagtacaatattgacgaatatcaatagaactcttagtacgacaagggtgataataggagcttaaggccctctctttttttcccgattccatattttggatttttttttgcacgctttccaagtttctaaatggtgtcttctttaaacaacattctaactttttagaagtcaattcattcgtttataccctcaaatagctatcacataaattatataattcatcaatttcagctatcctaaaccttaagtactacatatttttttcatgcgagtcatggtgatcagtaaattggtgatcaacgaatcatcgaagttgtaagatgaatatgtaagagttactctgaacaattgtaaataggtgttaaaattaattgctattaatcagacatttaatggcttgctagccacaaaattaatttctctctacatatatataaacatagacgaagttggaataaatattaccatacgtcccatacatatatattgcgcagttaatattctaattagtcatttaaaattccttaaaatgctctcaagctgccacgttgtgctctaataaattagggcaaatattagaaattctaagaaaaaaataaagtatccgttacttgattttcacttaaatcggtaggtccaatattataaaccgttagattaaattgatcttagaacaaactaaatactacgaggtcccacctcagcataggtatgcacctacgtgcatgggtacgtacgcctcccctcccttttttatttttctctttcttctttttttcccatgcatatgcttccctccttttattaccatatcatgcgtctttatgagacgatttaatcaaaagaattttgagtatcatgcactcatatttttcatttgtggccatactacacgtatgtatatatagatggactgtatgataattaactagcaatatttttttatttactcgagaaaaaaaacatgattcaaaagttataagtacttaatccatctcctattcaaaagtttatgaatggttttctaaaataccttaagaaaaatagaacccttaatttattataaaataacatcatccaaactttagtttgccctaaatttatgaggcaaaatttctgaacaaacaataatcttacctttcaaaaatatgcccgcgcatacgcgcgggccaccatcctagttcactaaaaaagtaattagctgtaaacataaacacccgtcccaaattagagactaaccagccgagtaaatcgctttccatcaaccggtttcggattgacagcgtcgtataggttacacaatgctgaaaggattcctttcaatggcgcacacgattcaatgccacttaaatcaccgcgtgtggtaagaagaggggaaaaaacgcaaattgatcggttaaccttcgcaagctgttttcgtctcctcgttgggatgacgcgttgctcttccatccatgtacgctcgaatcaacaaaaactgataaagaacttgtctatttttttatcggcaaatgttttactcggcaaagacaaacgtagcagagatcaatgtgaagaatcatgaaagattcgacaatgacccgggttctctggaaaatgagaagaatcgaaatgcaacgcgaaaccgatcaaactcgagcatctctagccatggttccccatgagaatatgagatcataagctacaacgagctgctgcttgctctcctctccatctcgaggaattgcccgagcgacggcgcggcgcggccgttctccaggtggctccggaggcagagcgacagcagcagcgccctgaccttgccgctcttgctcgtcgccctcgcgctccggcgccgccggctacggctctccatggcgtccaccaggccgatcaggctcgccagcgtcatcccgccgccggcgccgccgcctccacggcgggacaatgaccatgccgactgcgacaaaaaacatacttatatataaacgtacgttacgatcagatccagatgtaatctgcctgcactactgttccattgccgcattgcgaatttgcgatacagattatgttcgaactgacctctgtgtcgaaatcacaagaagtgaaggaagacgaagcgcagtgagacgaagtgaaggccgtgctgaaggaggccgagccagaaagatccacgcttctcgtcactccagctcttgcattcatggcgcccagtccaagaggccacccatcctgcaccatctccccaaacaaaccacaagcttgccatgatcaattggtgcgctaaaacagactgagaaaaagcatgtgagattagagctacaattaggcgaaattaagattggcgcacctcatgggccatgatctctcagagccgagcttgccgatcccacgggggacaagagcactaccagagtctagaaagcaggggtaactgactgatgaggagtggacaggcgtgaaggcttatatggtggagtcgaaagcgggcaacacgtgaaaaagccaagcatttgtcagtaaaattatctgacaaacctgcttgttttgcctcgagggttggaaagttgcaggcggataaacaaagtgcctaattgccaacactactacatggattagattcagccttggttagcatcaccatcacgagctcatgagatgtcgtcagtgctgctgctgctgcgtgagctcttgtgcgcgcattttacaagcccattgtggccaaagcacagatcgggaggaggctgcttacagtaagataatggaggaaaagccttgaaagacggtgcgaatcgttggcggtgtatgcggacaaatgtgcgcccgagaccgcggaaagctcgctagctccgccgctgcacgcctgcagcgcatcccgcgcatcctccgttctccctcggtccctcgagtttttcagttaccgggggacttcagtagagttaattgggatcactttccgggctgactgcattgttggttgggcttccggcgaaattctctactccgtcacgggcctaatgtctggcccagatcgttttcgacggggaaaaagtacaccgaaggtccctcaacttgtcatcgggatacaaaatcgtcccccaactgtaaaaccagatatccgacatcccttaactatacaaaaccagtcacaatatgtctctcggcggtttttatcccggttttatcctacgtgactgctgtctcagcgtgggacccacgtgggccccacatgtcagcctcttaatatttctctctcttgccctttccactctcctttccacgggcgaccggcgtgcgcgcttgcgcgggacggagaggctgggcacggcgcggccggcggcggcggcaggggaggagctgggcgcgagggcggtcgctggggagccgcgctatcctcgcctcctgcgcgcacacgccgcacacacgcgctccgcggcgtgcgcctcgccgcgcccccgccgcctaccgcgcgtttggcgcgctcgcggctgccactggcgagcaaggcgaagtggccaggctcggctactgactacagatttccaaggagagagtacactctcatgctagctttgcttaaattaggccttgccatggtggtgatgtggttaattagctggctgagcaagctaacctcttcgagcatggggtaaatgtaaatcttgcccttgagccgctgcagctcgcccccgtccatggactggatctgcgtcggcgcggtccacgacgacgagcctccgccaccgacggcgtcttcttgcgcctgcttgggtgccttgcttgccgacgatgggctggtggtgctcttcatggggaggctgcagaactcctgcaagagctgctgcgtcgggaggaggaacctttagccgcggagatgccacgcgccttgctgcagctgccatgtcgacgccgcgcccgccgccggcgacggctggtggtggtggttgtgctgctacatcagcagcgacatcgccgcctccggcctgtgaagcgagagggacagcggcgcttggctctgcggtgttggtggtggtaagctcgccgagcccgccgaagtggaccgtcggcagtcgcgcctccatcatcgacgccgccgccgccgagcgcgcccacacccttactttgctcgtgcgcgtgcgccaccgtcgctggcatgagccccctcacccatctttggccgccgcagagcttcaccgggctaccgccgtgcttccccactgcggccgctgccgtcggccgccatcgcggcgccgccctcctcctctcccgcctcgccccggcggcctcctccccaatccccagccgccggccggcttgcgatttgcgaagagaaaggaagagaagagaagagaagaggaggaggaagggagagagatgacgtggcatcctggtggggcccacgtgggtcccacgctgagtcagcagccacataggacaaaatcgggatcaaaatcaccgaggcactattgtgaccggttttgtatagttaagagatcatcggtatctggttttgcggttggggacgattttatatcccgatgacaagttaagggaccttcggtgtactttttccttttcgacggtgagcatatggcccgtgaaaattctggcaggctaccatgagggagttgccgcgtgccgatggacatatcggtacggtcgtaattcgtaaagacgttaagtaaacgacattgataaggtcgttaccgttttcaccccggtgtcagtgtcatgctcacgctgtcgatggtgaggctctctcgacctgactgtcgtgcatcctgttggggcggctgctccatcacttgtcgacgctgagcacgcagtttgcaagtagcgatacgtgactcgtcacgacgaaagtgaaggctgcgattaagaggatgaggaaaaaaaatagagaagatactgtcgacgagtgatactcatgtatcggaagaatagagtattgggttacgtcggaatagggatctacgtagtacgacattaaaacagacaaaagacaaggattgtactgtttcaggccctttatcaggtaatagccctagtccagtttatatgggattgctgatgatgagaacagattacaaagcgcaaaatctaaatcgagagcgctcttgatttagtcataacgagcgacgctagccattgtccagatacgattagccattgtccagatatgtgtcttgaagaatcttactttactatagtactaattgatcaagcaagtagaaaaaatattcctaccatttatgcttcaaatataattttctcttaaactattcatccgatctacgatccgattacactgttgtgttcataacaattaaatctttacaacaagatctcacatgattatattttgataaaaaatcataaattacttttataatatatctaaattacttttagatttcactaagttaaatatataaaagtaaattcaataaagttttaaagtaattaacatatattatagaagttactttctttttttataagttacttctatagtatatgtaaattacttttaggctttattgaattacttttatatgtctaagaagtaacttagtgaaatctaaaagtaatttagatatattataaaagtaatttatattttttttcatcaaaatataatcgtgtgagttcttgttataaagatttaattgttacgaacacaacggtgtaatcggattgtagatcggatgagcagttttagagaaaattgtatttgaaatataggtggatagtgtctatcatatatgagacaaaccagctaccattagctgtgtagttacgtccattacagagagagtaaccgaacaggtgataccgacaagatcgtagtcgagggatttgacgagatctcccggcgagttggctccgtgtactccggcttcgtaaactttggtgggtgtgttggcgatgagatgcgatgcccttagcctctccctaggggtcccttttatatcgtgggataccttgactctcaagtaagacttggagattatgtaaaccgacatgatatactagagattttacccttttcgagtagtacttcggtaatcccttaactcgtagagatatctcccataatttgaggtgaatttctaacggcgtatacggaaaccaaccgtatacgtatacgtgagagtataccttattgatatattccataagtcataggacagaggttatccttatccgtaaccctgacagatacacgcgatgaactgaaccattaacccgtaatcaattgggtaatattttttaaaacttgtaacgaatttaaagtaacttttctataaaattattttcaaaaatacattgtttaacaactcagaaaaagcatatatgacgagaatttattctctctctggtccgaacgaacgtagcttacgactggacaaggtggcacgtagaaaagcccgtggaccgtgacacattttaacacagacatcgtctcaatgaaaaagttaaaaaatgtagatgaaatcctttcttttctggttctcctacttcttccacgctttcaccggtgacgcccgtcgactcaccttgggacgctaggaacaatcttgcactgtactccctccgttccaaaaaaaaaagataaatcctgggttagtgtccaatatttaactgtccgtcttatttaaaaaaaatatgaaaaaaattaaaaagacaagtcatgtataaagtattaatcatgttttaatcatctagcaacaataaaaatactaattataaaaaaatttcgtaaaagacggatagttaaacgttgcacacaaatttagggttagtctttttttttttaagtaagtctaacaaaagcgggtcaaatcccttccaacctccacctgccaaacgtcgtaggagtatggctccagaacacttccgtagaaaaaccgagaaaagaaatcaaagtcatcgttctcgaaagcgactactactgccactaccactaccactaccactaccaccaccacaccgcttgtccctgacgtcgctgggcgatcgatcgtgcgatatggagtgtactcctatacgcttcggggcacaggcgcacagcgcgaatgtgcgtcgcacagagaattccagcacggccaccacctgccccccatctgggccgtcctcgccacggcgcgcacgccacgcgtacgtaggccggaccacgtgacctcagccgcgacgcaccacggcggccacccctctagctagtactagcgcctgcgctgccctggctgcgccacgggatgcgggtttcaaaattcaaaactcgcccacccgtctaatagtaccaaacaccagttgacaatcttgtcgcctcgctgcactaggccactagcacagcgtagcgtcgtcccgtccacttttgaacgcttcaaaggggtgatgacaaagagatcgaccggggcgcgcacttctttcccctccaaataagctcgtccagtccaagcacacaagccattccaccgctcgccgtcgctgtctcccatcccatcccatgcatcactagcggatttgtggagtggttgcgccccctgcgagcgagctctgttcgtaccgcgcgctccggtgcggagtggttgctggccggcgaggcgggcggacggacgcgtcgatgcgcgtggcagtagctgcgtgcgggtgacgaagcaggggcacttgctatatccgtcgcctcttggcggatgtgcgggattctgcgcgcagtacgcggcggccatggacgcgtcctcgcccttcagcttccacgagctcaggcggcaggcctcgtcctacctcaccgacaagatccgctccgcgcggctcgcgctcaccgatgttaccccgacgcagctgtgagtggctccttcctcgatcgatccttcccccgtcttgttgttcggatagatgtcaccgatccgttgttccatcgtgttcttgatgctgaggtttttgttggtatggtccaggatgacggaggaggcgacgagcggggacgcatcgccgccgaacgtgaagacgatgagcctcatcgcgcggcaggcgttcgagatcgacgagtacgtcaggatctccgacatcctccacaagaggtgagcgatggacgtgcctagcttgcctctcttaacgaagccacccacacgcacgctgcgtttgtgatctgctcgtttgttggctgatcgattgattcgggggcgggaaatcttacaggttcgcgaggttcgacaggcggcagtggcgtgaggcgtacaaggccctcctcctcctcgagcacctcctgacgcacggcccccgtagcgtcgcgttggagttccagagggatcgggaggtcatcgagcagatggtctccttccagcacatcgacgagaaagggtccgtttcaattcttcgtcccgactcgatcatatcttctcctgatgttctctcgcccttctttctcatcaccgatggtttcttcttgaatccgagttgcagtttcaactgggggatgacggtgaagagcaagtcggagcgcgtgctgaggctgctggagcggggccccttcctggaggatgagcgtgagcgtgcgcgcaagatagcgcacgagatcaagggattcggcagcttcaacctcagcagcgcgcatgcgtcggggtcggcggcggcagccctccgcgcgggggcgatggagcaccagtgctacggccggagcaactcgcggtacgagggcaggtggaggagggaggcctgcgtggacgacggcgacaaggagaacctgctggtggtgtcgatggccgaggcgaaggccgaggcggcggcggaggagccgcaccactaccaccacccgttctacggcttcgggcagcagcggccggaggcgatgctgctcctgagccagtagtgatcgtttgggtggatggttcttcgtcgatcgcatcgttcgttggtttgtgatgcgtgagaaaaaatcctgtaaagtcagtggcttgctggcatcctctttgtgatgacccttttgtaatcgtcgtccttaatttcagttctgatttctgaaactctaaaaatgcctgattccctgagctcataaacacacgaagaaaggaaattttgagaagttggaagcttcaagctggcaattgcaggcaaatacacctgacatgaatccggacaggtacaaggatcgtgaaaagacatgcgaatggatgaaccgatgcagtgaaattctctctgctatactccagagtccagaatgtgatatgctgaactgatcagaatcagacctaggcctggtttaggtcgtgtttgggaaaagtttgggaagaagttgatagtttggaaaaaaaaagttaggagttatatgtgcgtaggaaagttttggatgtgatgtgatgtaatggaaagttgggatttggagggaagtttggtgtccttaggctgtgtttagatcctaactttggattcaaacttccaactttttatatcacatcaacctgtcatacacacacaaattttcagtcacatcgtaccaatttcaacccaaacttctaactttggaaggaactaaacacagcctaagttcccaactttttcttcaaacttctaactttttcatcacatcaaaacttttctactcacacaaacttccaacttttccgtcacatcgtttcatttttaaccaaactttcaatttgtaaaatcaatgtgtgttttgattcttattctgtgataaacaattggcatatgtgattattggttttgatatttggagattatcgtcgaagtggttttggagataatcaattttcaggtgatgatcggattcactgttatttcatgtgaccggtccgaccgggcggtgtatgccggtcagaccggtggtgatcgagcggttagaccggccggcccgcggtctgaccggccgacgctgtgtcggtttcggtttcgagttgtttctttggatatccgtgattgtttcatagttatggcttctagatggatattatacgtatgtaatactgttgtttgctactaatgagtcaagttggggatagcttggtctcgaaatatggtttctttgtttgtttcatgtgtaggtgactcgatgcctcgagagagtatttgcggtgatggaccgggagtcggcttggtggtaagacgatgtccgtggtggtcagatatcatgcgggatactaaggctagagttgatgcacatgattggtgaagattccatatggcatacaatggaggtattatgtgcgtatgggatgcggagtcgaatttggaaggagtccaaatttggtacgattggttatgtaaagtttctttcttatactagagggtttcctaaggtgtttaggactcttagtatgagtttggttcgtggctttaggctgcctacctcatgtataaatagagggggagcgtgaggcttcccggtatcgcttttgagagcaattgagttgctagtttagttagggtttcgagtttagtcgaaatttttttaaggagtgctgttggtatactttgtaaacacagagagaagcaataaagttgtgcttcgatttgtgtttcaccgggttttggcagtctaaccggcgactcaccggcggcaaggcggcggtcagaccggctagggcgaggcggtcagaccggcggcgacttcacacgcggcaggcaatcttcaggcggttgaaccgagtgatcaacatcggtcagaccgacagcgcgagcgcggtcagaccggcggatcaacttcggttagaccgatctacatcgaatttaagggtaacttttatttccgctaaaagtttgggtttttgggtataccaaccattcaccccctctggttggcttagttactttgtttcgatcctacacaattttagcgtgagttaaactcacccctaagcttgctgattaatctgtgacatacgagtatcagaaaactctggttcgtgccggacagttcggcgttcgtgttccattgcattttctttggcccaagtcccactcttaattttattctaacctagtaacatcatgcaaatacttaaactcttcactaaacacatatctacagcttaccttttctctgtcacttttacatgtaaactgttcgtcattaccacttgactagttgactttaccataccatcaaatattccaacaattatcagtgtattcaacgctacatactagcactctatctggaaaaaaaaacactacagagcactctagttattacttcctatgtcccataaaaaaacgaatctagtattacatgtgacatattctagtacgatgaatctggacagatgtatatccagattcatagtactaaaatatatcacatctgatactaggttggttttttatgagacggagggagtactccagctacttgcaaatagaaaggagggcacaaaagctcgcggcagaaggcagctgcggtctataggtaacgcgtagcaagatgacatgaatagattcctccagtgcgtgcatcattcccaactactgtacatccctttttgactctgctatcatgcactgtttaatctgttatcatatcttatcctaccccacaggggcccttcgaccggcaggataggaaaaatataataatagtaaaaacgtaggaattgaagtaatatgattcttcaatcccgttggaataaaaaacacaggaaaagatgaaatgtgccctttgatagtgctataggaaaaaacacatgatttctcttccaaagaggtcagacctttttcttttttttcctgtgaaaatgaactaaaggtatgtaatccttgaatgtttcctttcatttcctatgaatcagaggcatccataggaaataatccataggattgtgaatcctacaaaaatcaaaatcctatactgatcctttgattaccgatcctttgaatcaaagagccctaattactggaaaatggcgtagagagtgtatgcctgaattatgcgatgttctgtacaagatcctaccatgggagtactagatttccctcacaagtacagaattcaaacctaaggttcaataacagacttttcatgtcatggtcaccaaaactctacagcgccacaatagcacgcgatggaacgtactggagcttagcattttacctccgacatcacaatagtgctgtgaaaaccggctatgtaaaacaccgaccctattggttaatatcgtcaatcctcacaagtgttcaatatccacacaattgtttaaaagaaatgaaatgaacgtgccacaaggattcattggtaactcacctattgaaggaaccaggcaaacttctacttccttccgaaacagctactccagtaaatggattttcctcggctggtcccatttatatcattaacaagggctaagaaagaaataggaaaaaataaatcaagcagaaatatcagttctttgaaccctcccacaaaaaataacccctaatataaagatcaccggaagcaggtcacctcatgtacagatcttgctgcagcatggcaaggccattctacttgtacattttcactttgtaaccatcatacaaaaatagacagtacaataatatgcctgcaaccatgtgaccacgaactaaattccactgttgtatcaatgaagagcctctgacatcaaacatgtcctaccaatttggatcatctgaagttgctccatgcttttgctttacctaagaattttaacatgtggcatgtctaagacatctactttcacatcttttcaagtcaatcaaattcacagtacaacaaatctcacaaaaactgtaactgctaatccaacaagaaaacagaagcaactttcagttttctctatgaacatagagttctagactactgaatcagcacattcttgacctaagaagattggaattaatggctagatagcatgttacactacagtcacctgatcttcatttcgacatttagggcatgtaaaaagagagggggaggaggctactatatccactaagaacacttatgtcagctacccttgtattattgatcaaaatttgcagattgaaagaacctcataataactatgcatatcttcttcctttttttttctttttgttgataaaagtacaggtaatcaggaattttagatgcacaatcctttgatggagtatgtataagaagttcagaactccattaagctcatttgcaggaataggttacaagaacttacagaaaagaacattgcatattcctactctaggatttaagttacagagataggttaaatgatcttacagaaaagatgaagcttcagacaaggagcatgagaacaaaaatcaaaaggtaaaaaatattaaaatagatgggcaccttccatttattcattattgctgaaattcagtctcaagactgtacccatccccccccccccaaaaaaaaaaaaactgtagcacaataggtgacaagtgcatgctgcagcgcacaacaaagaacaagatattggtgttacactgttttctacagcatatgccggtatttttctgacaagacttcagaatgtgaaattgaaaacatagatacaaatgcctcttgatttcactgtaggctatagatggacaagtccgcaacaataaactaaaccagtaatttgccactaatccaacatacctatatgcattattgctaaatcttatcttgcccaagaacctaggtgttccaaacgactcattactttgatctttcataaatatcacctcatttgttttcatgacatgaagacactcgagacatatgataaatattgaactttttttagtataaatattctccgcaatctgaacagtatatttcagataggcagggttttctattctgcattcatttcttcactcttcagtggtacagaggatacacttttactgaagtagttacaagtttaatgaatagttacaagtctatgacaaacacatcgcatccagtattaatgctgaatttccaagacgctagtttacaaagaaagcagaaaatgtgcacgtcattatttagaaagtttgacatttcaaccatggctcatctcatggatattattcagaaaagaacttgatgggtcccatggctcatgtaaagtacgcatgagctggcacatgaccaaacgggtccagaaactaatcgaataaagatgggcaacctcaataggtccactttcatggactctagtgaaactacatacaaaagtttcatgcacagtggtccctccccaaaaacccaccagccattatgaacatgaaacaccacagaatgttaggaatagccgcacatataaacggtagctaccagaggcatatacaagttacaacaactcatgtttttggtcgacatgtttggataactgacagactatttggatatgtttagacgttagactagcaatgcatgacaatagcacctagaatttcaaactctttattgggatggtttaaattccctcaaatctctaccaaacacaacaatatacaactacctaacttgcatgaaatgagcaatacctgataggtagtcacaagaatcagaacacctacctatcagtaaattcgcaacctggtatacaatgctgctaaacttcttctcttcagatcttagggctgctaaagttcatataggaagcttttggagctggggcataagctatttaatttaactgcaaaccaacttatcagatttcagttcacacgctacgaaactagccaaatgatcagcaaggagtacgtggtaggccaccctatatggttagataaaaaaagggataattgagcatatgccaccctaaatggttggtttatgtcctcaacagaaatttaacggtggaaaatcctgaccaatcagctaaagggtggacatgtgttcaatttgtcttcagggaatagtaacagcaagcgcaactagagtccgcgtcattagcaggaaagaggagtgagaatcaaaaacaggggtagacaaccaggccacctccaagctggccagctcattcctcacgcttaccacctatctatcaatctccagaaccctgactccaagacttcaggtccttgataaacaaaataccaggcaaatgcatgtcttcaaattcttctgcaccttaccttaatacaaaagacacacaaatcgattccccagtaatcctcagttcctcacaccaattccccagtaatgctagccccaattggacttcagttcaaacacaaactgacctgattagaacaactatgaacatgctgctgttcgttttggaacaagtaggtttcataggtctctctacacatgatattatttcgttaaaactaataaagaaactagacaaattgctactgcttttgcccctataaaattctctacccatcacattcccgtagtacacattctaaaatggggaaaatagtaacagaagaacaaaaattgagcaaaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctcggcagcatctggcgccatcgcgtccggcggcggcgccatgacgtcgctatcagcaccgccccgaccgaacatttccttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcggggaggtcggcgaaggcgtcgtcggtgggcacgaagacggtgatgccggcgccgcgctcgtctgccgtgaactcgtccgcgacgcccgatgcctccagcatggaggcagcaacgttgaacccccgcgcgtccgcgaggacgtgggtgatgttgacgccaccggccgggcggctgtcggaggccgcgacgtcgagcccggaggggacgatgaggccacccaccgcgagcacgctgaggttgtaaggcacagcggtgacggcgccgaggacagtggcgctcgaccccgggaaaggcgccggcgaccggaccacgacggtggagtttcccccgacggtgaggttgacggcgccgagatcggagggcgcgcgcccggtggtctggaacagcgtcgtcacgagcttcccggaggcggggaggcgcgcgaggtcagaaggggagaggtactcaagcaggacgtggtaccgcagcacatcggcgatgtcggcgccggaggccgccgcgaacgccgagggcgagcgcggcaggttgttgttcggcacggccagcagcgtcagcgacgaccgcgccgccagctccccggccaccgggctcgactccagaagccgcgcgaagtcggcgaagctggggaaagccgcgagcgcggccgtcacgttcaccccggccgcccgggacggcagcacggcgagaactagaagcagcaccaccccgagcgcgaggccgcctggcaccggaagggctcccgctccgccccgcatctcgccagcggggggagcaactggggtggtgggtgggggactgaggagtaagcgaggagaagaggtgcccgaggaggaaggagacggggaagaaaaatattttgcgcgtgattttggttttagattacggggatttttttgctgtcgaaatgcgatagtttacgcctttctttaaacggtggacttgttttgggtgtggaattaaatggtggcgtcgcagcgttgatgggacgatgtggactcctgctagtctactacgccagccagctctttcccactctccgctaccaggcgcttttgccaactttgtaccatgatgcacgtcgcatcacgtgtgccttggtcctattcgacagaatggtgcggattgaggcgtcattctaccaaccaaacaattaaatacggactttgctcttaaaatacttcgaatcaaaggattaactatatgaactagtccattactgtaaatttcaaaaaaaaaaaactagtccattactgtaccctcaattcaggatcaaaaatatttcgaaactaatggtcttaagattcgacattgttttggtcctgggcggtgtttactctgttgtgtgaaaatggggcacgtgaagggcgtagtgaaatggcagcggttaccttccctgggtggaaatgtagtgtgtgtattacactcaacctgaccagaacagcaagatatggccgaactttcctcaggtgaggtatcgtcttccggaccactacgatagcacggtatgttgtgacgcctgtttgagaagccttgattcattcagtaccaaaaggcacctggccaaaaatgggtaactgaaacaatgaacgggcaaaaaggcgaatctaaatccgtcagagagatttcacgagatgctcgactcaccagcttcctttcacaagttattgtcgtttaacggggatgatgcgagcggcgtacataagctacaaatggggcatgtgacccgcctcgagcccccattgacgacctgcaactgacgccggtgaatgcttgtactcgataagctgaaagcaagacggccgtggaaaacgtaccggttttcctttaccatcacattcttcatcggactgataatctctcatactggacactttggttttgaaagattgccaactgcaatttcagaaatatcctgcttctcagatggcaacatgaagaaccagaactgggaatagaatttccaacttttagctgtttgcctgtttctgactcaaactgaaattggcaaattgtacaaatgaaagaagaaggaaaacctccctcccttgatacaataatcaaaagaatagttagacaaagagctagctttcagatgaaaggatcaataaattatatcagaataagcattgttcctcttctcaaaatttgtatgacaaatttcttcctagctgagaaatgtacaagggaactactattacatcaagcggactggcactacattgtcagggtattagacctagaaacggttagacacatctattgagactcagatcggtgtattgttagccccaggattagcttagctaatatgaatctaatatatccgcaaaatccacctggggagtgtaatagatgagcaatgctgcagtagggtgcttggagaccggacagacatcacaccaccagacggcaagcaaagaatgagcacatgctatggtaccaaaaagaatcaaggtcagtcaatcaagtcaagactagtagatgctatctagcctggatggatttagagtgttctgatttgtttgagcggcacatgcagtcggggcatggaaaggtgtatatagattcatttgctcttttcatttcaatacccttggcatcgctgtgtgttctcatattcaccaactgacgtttcagtgacttccatctgcacaaatgcaactaaaattttaacaaaacgaaaatttgctagttttaacaacgaataatgcaagaacgtccaagatttccagagccagaaggtaatttaatactgagttcatgagccacagtaatagcatacccgatacgtggactatcgaagagtatggctaatcttcttttatcaggcttaattgtcttcgaatgaccaccataaatgtatctcctatgaccaagaaggaaatgaggaaaatttccaccttgggtagtcacgaaaacttcactatgaacacatactgtgtaatcgatagctgccatccttgaagagaaattctggcagatattgcattatgtcagatcatacttgaaaagcaaagaaacttttgcagacaccatttgtatataccttgaatggagcaagttcttcatctgatgccaatgtttcttttgtctgcaagagaggaaacatttcaaggagaggtgccatgttcttctctgatttatatatcctcccagaagccaaatagatcgcggtgttattgctgaaacccatcccgcgaagcattaacccaacctaagcacagaacataaatatgtaaacctatggtgcaacaatcttaagcaatggctattaattaaatcagtgtaaacttgatggaaatatttagacactagaatacacctccaaaggtgtaagtggacatttcccattcatccttattgctccaggccttattacacgtcctggcctagtaaactttcctctccaacccctctccctggctgcatccagttccttcttctccttttcacccccgtcgaagacacaacaagagaatgcaaccatatcctgcaaaagaaaaatcaattggttgacaattctcttgtctgagaaacaggggattcggaccccattattattttggacagaatcagcacccaaaggtatcatgaatagtccagaacgatttgttaacagaagaaagactaacctcttcaaaacggagatgcaccgctacatatttcccattgttttcggcacttttttctctcattcgagatactaaaatgtcagataaagttgtgatcggcttagaaaactttaaggcttcaaaattagccagacatctcaaccgttgaacagctgatggagcatcaaaggacagtcggtttgcaaaaggtgatatccttataagcctataatgtacagataaaagcaataaaatatcatatatcacagtcggtttgtgaaatttactctatcatatatcacaagtcaacattcttacattcttcagaactacaataacaaaattggctttaacctacctttcttcgatcaacttaggaagaacagcttctttgtagtatcggatagaagaccaagcctttatcttgaaattaaacacattactcaaattgtgaccaaacctctccataataaactcaggcaccttgtcaactactcggacatcatttttcaatcgttggacgaagtgttcctcatcataaatatcactaaatttgctgtatcaagaaaaagaaatgttaataacttgatttttttatgttgtaataaatcctcaaagaagcctctctcatccaaacacaaacatagaaccttgtcagtatggcagttaacatagtacagtgttgcagcatgcaaaaaaaggaacattttcatacttcactactaccatttggtatcttttttatgtgacacctttgaacaaaatcatttctcattaactcatacacatatttcataaaaaatggcataagtagagttaatgcaaacaaacttctggttgtttcaaaagaaattcaacttcgtcagagagagagggggagagagagagagagagacctaggatccctccaaatgctgtgatagtggaagtttgggatcacaagagttgcatttagaaaaccagcaaccgcaacagcattgcatatctgcaaaaaaaaaagggggggggggcgggaacaaaaaaaattgtagaaactcatgatgtgtttgtggacagaaatgataaaaatacaaaaacaaaaagggttcattgaaggtaggtaacaaccgatgccctttgctgattcaaaccaccattcgcctccacgtatatgtagccatttaattcaggcaaatctaacataaatatttaactttattagataattccatcaagacataggcgcatcatgcaaaatggtattgctgttttactaagtaactgaaaaaggagtatgcatatagcataaacaagtatggcaaatgcacataagtaaacgacttccagtaaaaaaaacaaagtgccctaggcctaggatgtacagtcaaactattattttactttgaccaataatagcttcatggtagttatattggcacaaaggtgccttatgccatgtcccacaaatatatcggtagatttatcttaaaacatacttccaataatattacaaatttcccggcctttacaaatacatcacaacaaaagtgcaatgtagaaagtgcaccacatatcactcatatgcaaatgacaagtggaatcatttgcatgtaaatgtgatttatctttcctttagatttttgtgcaaaaaggatgtaccaggaagcagcaagccaatggaaggaattaaatgtctgtttgttcagagatacacaattaaccatcagagatgtcatatttggaaactgtgaagaaataataagcattgttcataaaaatcctttatgggcatgtccacatgtgcctgattctaccaataaatgtaaccctgaccaacatgcatatgtagtggtatagtttcacctaaatcacttgtaaagttttgatattttctttcacaaaatggaacttcaaatattacacgtggacaaaggaagaaactaggctgcattggaattcatccaagtcatatcatattaataggaacagttctggcctttgaaatgaatatataaacaaatataagaactgtttgaaactcattagtaaaaaaggaaaggtaggaatggcataccatatgtaatattgtttatgcaaggtcgccaaatgccacccttgtaagcatgtctccatacagttgctagctacaaaaatgtagtaatatgagattataaacatacatcgaaaacatgcataagtgaacttagaaggacaagataaagggtgatagcatgagggaaataataaaccctcaaaccacagaacaatatggatctgtaacatataacatgaaatggtactaggcaacactaaaaattatgtcatataactacattaaagctaatggacacaatagaaggaaaatggtattgataaatcaatcctccattatgttatgagcacacaaagatctatatatgaaaatagcacatattccatctttgataaattcagtgcaaaagaatgccccacagtgctatagcaagcaggtggcaacagttgtacagtacatcttattgtttgctaccaagcaaggtcattttcactgatcaaaaggacaatgcgagctatcacaccaggaaacaggcccataaaacttgaaaggccatcggatacacagaagtttcattaatttgaattaaaaaaaattacctgtaatcatctaaaatgaaattcttttttgcagtcatcatccatatcgagtgcaataattcattaaggaagaaccaactaaggcatttacttaatgtgccacaattcataatcattgtggacaaaaagatacaaatgaggtgtatttcttaaactcccagcaggcagtcacaataaacacaaacatgatagctttttgacccaatgtacaaacccaacaggcttattggcttattgcttgcagcagttgaactgataaattctcacattccaacactctagttctgaccaagcaaccccattgtctgctaatgcccaactggctaatattataggacacccacaaatccacaaatatgaagtaggtttcaaccggtgaaacaccactagtctgccctctaatccaccccgcacatgcagcaagtacaccaaaaacattaactgatacatcacacgcatttctataattttattgcaattccccaacaactgtaagaatacctaacccaaatccaacccagtcagaataaactaaataatctaatcgtttattggccgctagccacagacacagttcactgttgctacagatgcgctaaacttagtacacaatcacccagtaatccaagtaccaccgccagacctaagacatctcaagcaccaagtaaactcgctcagcggtcatcacaaaaaacgaccaaatattttcatcgcaaatataaatttctagtgcaacagacccaggctgcggatgagcaggtgggagacactcaccgcgtcagtggcgttgtcggcgtccatgtcggcgcgcaggcgggcgtagagctgcgggctgcggtacagcgaaccaggcgccgggcgcgagatgatgcggggcacgctgtcgagagagatggagcccatgtagagcagcatcgccgcgacgtacagcagcggagcgaagaggaagaccgcctgccgccgcagcagcgcggcgagcaccaccctcgccgccctccgcacggcgcctccgccccgcacagctccggccgcgcctgcccccgcccccgccctcgccgacccgcccttccccgacgacctcctccccgccccccgccgcggcgaagacggcggcgacggcacggcgccgctcccgccgccgccgccgccgcccaagctccccagccggttgtacgcgtggttctgcatcgagcccctcccaatattaaagccgttagttaatacccccccccccctccactgtagagctagggtttctcccgcgcgatcgatcgcgcgccgcgccgccacgcggcgggagagcgagacaacaccgaggcggcggcggcggcggcggcggagaggaggaggtggcgagccggagcggagggggaaggggcgccgcacggcatgtgtccggcgcgtgaccccgcgcgcgcgcgtgcgtggccgcgtgggtgccggtccgagcgcggcgctagtggccgcgcgctggtggtggactggtgacctcccctaatcggtcgcgctcggattcccagaagttttttcgtgcgcgtttcaggcgcggcgcggcgcggattatggtttggctttggctttggccgtcgctgaccggggattcggatttttctggtctctctgatgtggtgcggccggtgggcgcgcggcacgccaatccagcacgggagtcgggatagattgattgatgtgggaatgaacggaatggaaggtctaatgttcaagattgggagtatggaactagtcggattatctttctatcctcgcgtgggtggtggtggacatttgggtttggggagagattcgtaatgcgatccgatctttgcctcatgatcgtgatggggaagtgaggttgacagcatcaggaggccaggaatgggctcggtaatgaccctttttattcgttagggcatgccaaatgtatctggctcaagtgggcattagcataggcccatgtaacaggaggtagcagtgacatagagagttcactatgtatattttgtctgccagaggtagtaaggtggggccactgaaaaaactatacattttctatataacataattgcttaccccatgaaaatgttgcacatctattatttttttattttcttgctaccggtagtagtactaaaaccggatagcagttgttaccccttgccacaatgtttattacccgataatagagatgtatttatgtcttattacctacttttcaaccatattgtggttgtagtgagtagtgacggctattgatcagagtcatcaggctgtgcttcctgtagtaccgcatggtgactgtgacttttaacacgaggataggatgcaagttgggagtgtacagacagacagaaatgctaccagtattattactaccggtttattaccacgtcatcggtttaggccatgtgagtatgtgacacgcggagcatgtagagagacaaaccgaagacacgcttccttctattccggatctttcaaagaaaactgcaagctgtactcagcattgatctctttcctcgtttcctaagcttccacagctagtactagtagtactacgcaagttttgtgcatgacaaccgaatttcttccagaagatactgcatatgccagtgtgaagccaagtagtagcacaaaattgtttttctgctcttctccgatctgtcaaactctggtagccgtgcatagttggcgatggatattattttcgtctcaagctccccctttttcacacggacagaacttatattgggccataacaccatctttcaagtggttttggtttggtgtggtatttatgccacttaaatactatgccaaataatgcggtacatttcccacgggttattataaatggaattgctatatgttattcgaatgaaatttagagatgaaatcttatagattttagactattggatctatgccaagattcgtacatcggcttctctcctctaactccggcgggctccccttcttctccggcgctggcgacaccccccaacttcggtagggagcatacgggttaggatttggagttggggtcagagtaggaggggggttagggagggggaagagagggttttcctcggggcttagagagatggccgtaggaggcagagaaatggcagtgggtggtgggcggtggacttcagcgggcggcaaggcagcggcggcgccgccgaagccacagtgatggaggagggtggtgggccggcatcggcggcgggggcaaagcaagcgtgtggttaggagacagcggtgatggttgcagattcggcgatggggagccatcggagacggggaagacggcagggcgggggcagggggctcgctgagggagcctcactagcaccgttgactatttccaactagccaacgaggcgggcggcggcacagtgggacggtgatggcaggggatcgcacgagggacggaaggaggagtggtggcagcgcgatctgaacggggggaggaggagaggagttgttgagaatataggcatataatgatttaatatattccataaataaatcatgacattacagatgtatacgggcgagctgtcgcggacgaacaaggagcagtcgcgcgaaacgcttcccaaaaaccttattgccgccttctccggtgcaggacgtcgaaggcgataagtcgcgcgtaacttatccggactccactacgcgaagcgcttcccaaaaaccttattgtcgccttctcccggtgcaggacgtcgaaggcataagtcgcgcgtaacttatccgactccattgcatctgcgaagggtgaggagccaattttgtgaatcattcgacgcgtacgtctgccagaccaggccagcgagcgcgcgcgtgtgttccccctcttctctccaccacacatgcttcaagtggctaggagggcatcctcccctttaaggatgtccccctctcctagaataagcaaggtggtactaaactccacatgcatgccatcccatgaggtgggcttttgtgattttccaaagaattaatcttcgaataggccttagcccatctattaattccaacagaagttagggttaagagctccgcacaaatcttgaagcatatccaatggtccaaaattcgaataatatgatgtgggattttctgtcacaaaggacctgttcagattgtagccaaaataaaccttacaataccaaaaatttggcaatttaataatattaccaagttttggcaggattttttatttatttactagagtttgataagtaactaaatggatgcacgtatttcacaactttgcaaaaaaaaaggtttgaaatggcatcaatctaaacaagcccaaaatatgtagacatccccatttataaacatttttcagatgtcctgtatttattttctggaagctccatcacctgattttaaacataatgtatttgttatagcatgactgtatatgctacagtttgcaccaaagtaattgcatctttgatcaatcctatcaaaaggctataaagaattaagattgtgtgatctatgacatgttgattacggattgatcatccaaagcttaattaaagtaggttgatatggtttcagaaaagaagaaaaagaataactagtagtaagaattatttaaggccagatacagttaagatggtgcagctatatcattacctaccattaatggtggggagcattacgatccgactgataaatttagttttttttttgccttaaatagttccgatcatacaaaaacaaagaccaaagtgcattgatttttttctagaaaaaaagagtgttgttattttggcatgcggtcatgacaaaagaaataacagttccaagggatgaagaaaatcacaaaagcaacagaggactaggaggaagaaagaggaggaagccaagcgctacatcagccagccacattgccatctacaaccagcgatctatataacaatggagagaccagagtggaggaagcaacgaccataagagactcgaagttgagaaggagaccctcgacgtggtcaccattcgtcgaagtggacgaggatacgcagccatcagagacaattaggaggaatgtggctttatctcagcagtatgggcgttgggtggacagtatacgcgcgagatgtggcgtgtgagtggctaggtgtgggactatggtctatgggaatggcgagtgggtgactgcttggataagaggcacctagcttactcaagaaccataacaattactatattgacagaaaaaaaaactagaagatatgcataatttgaccacgttgaatataggctttaacgatgtaggtgtactgatatagttgtgtttatgaaaatggaagaaagggttgaatctcaaatacaatttgttttaaaagaatctaactttgcatcaagttatgctggaaaatacattagcttgtgtcgaagaaagtaaaagaaactaaatcattcccatctttttttctgaatggataggtttattatgttaaatttggaagttttgagaactgtaccaacaaagcccgtctagctcagtcggtagagcgcaaggctcttaaccttgtggtcgtgggttcgagccccacggtgggcgcatttcatttttttcctgttaaagtcctttcctgtgatccagcacatgacacccagctaatgctttctggcactctagatacaggatttttttttttgccgaagatggagaagctgatgaatgcggtagcaaatcgccgatcatctcatcaatattcatcaggtgacaactgacaactcaagaatcccacttagacaagccattctagttccctgtgtggttggttccttatatcattggatatttaattcatggatgagactcccgactttctgtggtttgtagttttgccattgacatgtgggccatatcaaaaataggacccacatgtcagtggcacaaccttaattcagttacctcttttagcacagcctgcacctgcaatgtcgtcgaaaacacagcgcactagcgagcagttcatgctgatacttaacgaccgattgagtgaggatacaacctccgttattaagaaaagaaaccttctagatatggcttctttgccaattttttttattatacgaatgcgtatttgaagtattgaacgtaaactaataacaaaataaattacagattccgtctataaactgcgagacgaatttattaagcctaattaatccgtcattagcaaatgtttgttgtagcatcacattgtcaaatcatggcacaattaggctcaaaaagtttcatctcgcaatttacatgcaaactgtgaaattgtttttttcgtccacatttaatgctacatgcgtgtgtccaaatatttaatgtgacatttttggccaaaaatttttgggatctaaacgcaccctatgtcgaaatatataactagaatttaggactgttttggtttgctgcaaaaatttcctctaacaaatagttggcacttaaaatagtaccttgtagatgtttggattgatgccaaaatttaccaaaggcaatataactcctataattcaactctactaaaaatattggcaatgccaaatcttgcccataatttgacactaccaatgatttggtagggcaccaaaccaaatgagccctcattatctttttaaaaaagagggagtaggcaaaactattggtagttcatatgtaacggggtaagtgtagcgtcttgcttgaaaaaaaaaaacaggtggaagtgacctaaatatatgcagacccgaaatgactagtactaccacaataaacaagatgcgacatatttcgtattttattttttatgggacgaatatagagaactccctctgtccttaaaaaaaaaggcaaacttaaatttccatgccaacgtttgactgtccgtcttatataaatttttttttataattagtattttcattgttgttggatgataaaatatgattaatactttaagtgacttatctttttaatttttttcataagttttttaaataagatggacggtcaaatgttggacacggaaaacagagtttgtctttttttttttgggacggaaggagtacatgctaaggcgcgctatatagtctctagtgttaacaatgattgatttaaggtatggtggtaggtgacaacattcaaccacatatcctgattcctgacattaaacaggagctatttttccaactagactgaatgagctgccggttgaacacgtctagtttcttcatagctccatttcaccaagtacatgaaacggtagagatggtcggttggtcacgttgatctgaaaaaattagcacgagtgggattattcaaggtcctagagatggtcagttgagcgccggctgcgcgcggccaccgcccggaggtcattccatgccggcacttggacgtatatattacacgagtaccccgtatttacaccatcatcgtgtatacacgagggggagggggaactccgatgtggggaacaacagccgcagcagcgcgccgtctctgcgcggccggcgacgtccgctcggtgctcgcgatgctcgcctgcagggcgaaggcgggggacacggcgctggacatgaccgcgtgcgccgcgcttgtccggaccacgggttctgcaagggcggcgatgtggcggaagcccggagggtgttcgatctaatgccgctcttgggggtggcgcctaatgaggtcacctacaccgctttgatgcacggctacttcatccatggccagagggagaatggtttgtccttgttcgaggagatgagaattgaggagggctggagtcgagccaagcctctacacctaaaactgcttgatcgcagagtggtgcacaagggaattcgagcgcgctcgtaactagttcgacgaaatgcctgcaagggtcatagtacgcaatattattagctctcattgccgcctacgcaggcatggcaagctgtggggtaccgccaagctattggaaatgatgcggagggacagtactcgtctgagataaacatcattacctatagcctccttgttgatggctacggcaaagctgggaagatgtccaatgctttgcatttcttcagcctgatgaaggcggccagtttccaaccagtgcaatgacatacaatatgcttattgccggtttctgtcgtgctaggggcaaatagggctttatctgacatgaaggaacgaggcttggaaccgaccaaagtgacatacacaatactaattgattatttgattcatttgccagagaaaatgacatgaataaggctttttagatgcttgcatgggagaaggcaggtctagaggtggatgtgcgcacttatggtgttctggttcatgcactcttcatggaagggcatatgaaggatgccaggaagctgtttcagtcaatggaccagaaaggtgttgaaccgggcaatgtgatctatgacatgatgatttatggctatggaagagaagggagttgatacaaggctctgaagttgatcatggaaatgaggcagaagggtttggttccaaattccgtaaggtatgccttgatgatgacgatttgttttctttgcaatgatgataaatgtcaggaagctgaggctctgctcgatgacatggtccgtgctggtctgcaaacaagtgaaccaatctgccagtttactgaatgccaaggcaagattgagaggttctactgatggctcttttgtgtaagtaggaattcatttcttttcatgttatagtgaattatcctgattcatgagaaattagaaagatattgcacaaggaaatctacgtattgaattacaatataagaaactgtaagttcatttgctgggcatcacagagaactccattgcaagcgacaaagataggcagcaaaatgccgaagataaatgcacccagcacttgctgcaaaataaaggtcagtgcttattgggatcctgtgctttcatgctcgtcctgcacgccggaggctttgccaggtgaaacttggtttgagcaaaacccttttcagatgttatttcatgattcctagtacaagataacctaccttcatactcaggtattagataagaaaactagagatatatagcttcaactattttgtgtccgtaccatatactccgcccatagcgcctgttcatatcagtcaagtagaattaggttttattgtttcttgtttgtcagggggtcaaccatgagtccttgacaatgctgtatgagttcctgctatatgatagatcagcagtcgtcattttcctcaggcaatataaaacctagctttatattcttgctcttatttgcttcataaacgcttgactttaagttataacccatgtttatcatgcacacgcaagttcccagcactctcctacattattaaattggggtgtgtttagttccatgccagaattggaagtttgaagaaattagaacgatgtgacagaaaaattggaagtttgaatgtgtaggaaagttcgatgtgacggaaaagttaaaaatttaaagaaaaaagttgactcttcagggatggagaccccttccatacaaagaaataagaatgtcggcgttctctataggctactgacaaagctatgctacatgagttcccttgcacccccttttcataatataagagattttaggtagatgtgacacatcctaatacaacgaatctggacagaccgtttgtctagattcattatactagaatgtgttatatctacccaaaatctcttatattatgggacgtagggagtaattaatagctctatatggtttaaggaaatgagtaccctatccaaatttctacacctgggcctcctcgtccttttctgattgctatgtgataccggttcccacttgctaagttgccttaacaccgcactttgcaatttttctgataggagaatcaagagtgaccgatccttttcagattcttttgcaggtacttttcagttcatcttgtgtttatgacgaaatgctctttaattcttttgagctcatgaataagtgtcttaaaagaagagctcatgaacaagaataatttaattgttactaatactagtaacaaattactgcatatttactctctcttttgtttttacttgttagtttggacatcaacatagtctacttaattatatttatatatacaaaagaatgctgaaaacatacttcctccgtcccacaataattcaactcctggattcccaatgcaaacttagtacaaccatgaaaataccgaaatgccctcaacaacaacattacacaggattgtactgggttctctgcactgtcctcactgaaaaaaaaggtttaactgggttctttgcacccatcgattacactggtatccagcaaaaaaatgaagttttaaaccgaatatgctaacaaaaattaagaacctctagtctgaaaaaagaaatcataaaaaaaatactactccacaatctgcaagatggtttgcatccataatctgtcaaaaaaatacttctccacaatctgcaaggagtatgaattaatctgcaagaactagaaagaacaaagaaaggtgtttgcatccaccaaggtggcctgtagtcatgtgtgtatttatctagattgaccatgcaaaaagtcatcatcaaaatccaagaacttagtatagttaacaaggtgaaatggcagaaataaacaccagagaagaaagagtgatgaaaaataagtagtagaaaagagtacctgggttcattctaatggcaaagcttctcgaaccacctcagcgctaggagacacaaaatcgttggctccttcatcagatccgccattgcaaaagcttgtgcatcaggctccctgcaacagatccactggcgctggagaccataggcttgcgccttcgccgccgtagtcgagcagcacctacacgttgcgttcgccttctcctgcatcacaatcgcaagcccctacctctgccgccgtgctgctagtgcctcatccgagccatctcaatccgccggggccggcgctgcccccgccgacctgtcgcatccatgacatcacgggaggtcgcagggagggagagatggatggagcgtggagggaggggaagcgactcatcgccgtcgagggatgggcgaaggtcgtgaggagagggaggagatgagaccggcggtggtggttttttttagcgcggctgtgtggtgggcgagaggagagagacgggcagggataaggatcattgaatatttctcgggtgttgcgcaggagttgattttttctgggacaaatcctcacccccagaaatcgcttctttctgagacggagggagtaaataattgaagtacttctgacgacaagtctcttgatgctattttcatgtactccttccgtcccataatataaggtattttgagtttttacttatactctttgaccactcgtcttattcaaaaaatttatgcaaatataaaaaacaaaaagttgtgcttaaagtactttaaataataagggcaaaaaaagtaaataataattccaatttttttttaataaaacgagtggtcaaacagtactaataaaaactcaaaatcccttatattataggacggagggagtaacaaacatttatcttttacgaatgggtaaattggaatcatgccattataattttgtaaagtttgagatctatcggtatctcaatgacacgtaggacccacatgagtcaatgacatgtgggtcaggatgacatatctcaaattttgtaaaattataatgacatggttccaattttccgttacgaattgatgtcaatgttcttggaatgttcactacagcaagtactagcgctgaagcagtacagcataacgacgactataggactatttacctgttcattactcgtcgtaatgtcgtggactcgtggtacgccgcgtacgcttctgcacgctgaccgctcgccatgggccatggcaaatgtgaagccgtgaagcatcggcccagcagaatcacccgtacacaggatcgattaccaacggcgcagatgacctggaggagaccggacgcggccggatgcggaagtgtattccccttcgcaccgcacggtcgcacgcacgcaccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcgatggtggagcaggaggggtgcgtcgagaaccggcagcccctggcggcgtcgagctcgtcagtttccgacggaagcagctatggcggcggcggcggcgggctcgcgcagatgtcgccgccggtgtctagctcggcgaattccatctccggtcttaggtaaggaagttctttgcccgattcccctcagttgggatcctattatgggagggatctaggaaggtccgttggttagtacctaagttcgtgtggtagttgagaaaaatggggccttcgtggatggctccccgatggttgtgtggttttatcgctggcaatttgccctgtctgtgattccacgagcggttgtttgtgcgtttgagaaaaaatcttgccacgaggagtgctaccttggcggatatgtggcaccgagagtgttgtggtggctgtttgagtgataaatttggtgtttttttggtatccatttgatgagatacttttttatattcagacatgactttgagtgtgttatgatggatatactgatatgaaggcgttttccttttgggatggctgttgatgttttcatttctgtaattaatttgcttgccttactttaaagtgtgtatattgatgtaatttggataaaaatatgttcacttggaacactaaattggtccggttacatgcagcagtagttgtttaaactggaaatgtgttttttatgccatgacccaaggttttattagatttaatatgcttgggctacagcattggagataccatttacttgtaaccttgatgtgtatattttttgttctgactgctgcgctaaaatatggtactggtgcactatagaaatagttgttttaatgaataaacagtatttttttgttaggccctgtttggaacgtttaccctttgtgtaagattcctgagttcaaaacagggcctgaatagttgcagttacaactaaccgccatttttgtttcccacttttaatttcttgatgatgaattgaatggtgttagtagggttaagcagtatttttttcatggaaatctttcttgttcatgaaaggctccacacatgggaaatttacattgtcgaactatagccttaatgttcttccctatgtaggtctctcaaccaacaattgctgtttttttgggtcatcttatgctagtgtatttagatataccttgtgccttctcggacctaatatgctattgtgccctgaacagaaaatctttcactttatttttgctgataatctttatcttatgttaggcggacaagcgggccaataaggagagcaaagggtggctggacaccagaggaggtcaacacctcactctctattgtacttcataaatactccataagtcctattaaatgcaatacatacctacatttgttacacatatatgctagtttggtttgtatatgtattttggcatattcagtggtaatatcatgcactggaaaagttcttagttaatctttttccattcctgtttttctaaggttcttattttatccgattttatttcatatatggttttattggtattcatgggctgaccattgattttttgtttgaatcaaatcttctattttcctgcttgaacgacatttccatgttgattcagttacacaatcactgttactaattggtcttaacttatcgcaacaggacgagacattgaggaaggcagttgaggcttataagggtagaaactggaagaaaataggtccggctctcaattccactgcaccagtgtataacttgggcagtcagttatccttgagatgatgctatcattttgttgaaaacaacctgtcaggaggattgcaaatgcctaatggtttgattccattaatatcggcccatttgcatataaatatgcgtatacaaatatgatctcagcaaactaatacatttttgcgtagattatatttgtataaatatatataagtatgcaacctatagtaatattggtgatcttgtagttgaaatagctgtttttttacctttttaatgttgtagtacttcattatatcagttgctccacgtgtactggcatacagcatgccatattatttttccatatctgtatgccaagtacattgagctcatagaatgtatctgtatgcagccgaatgttttccatacagaacagaggtacaatgcttgcatcgatggcaaaaggttcttaatcctgaacttatcaaaggtccttggactcaagaggtttgtcatgtagctgactttgctttgatggtaagcgttgacattatatcttctaattgttatattaatgccatgttttctgcaggaagatgatcaaattattgatcttgtaaagaagtatggaccaacaaaatggtctgtcatagctaaggcattacctggccgtatagggaagcaatgtcgagagaggtaatatttttatatcatggctgtattgttaccaggattcagctcactgttattaataaaacttttaaatttccagttatttttttcacatatgcatttatttccctttacatgagacattaggaaacttttgtaattgcaagaaagaactttaaattttaggatgctcatagttgctacaaaagctcaggatcccgtctattatgaaatatgaattaattaaggccttgttcggttaatccctgtgatggagggattggaggggatttattccacacctattgtggtgtggaattattccccctcaatccccttcaatcctcttcaactctaaaccgaacaaggcctaagaaatgcactacttactgaaagaactgtgaaaataattggctaataattatgctacagtatctcatagctgaattcaaactgttgtccgcatataatttactttctttatggcttcaatagtatttgttatgaaaaaagtgcttaagtttggcatgatacaatacattatacggagctaagtatgaagtcatacaatcttaggtggcacaatcatctaaatccagaaataaggaaagatgcttggactactgaggaggaacaggcactcataaatgctcatcggatttatgggaataaatgggcagagatagcaaaagttcttcctggaaggtacgtttataaagcttacttccctcggaattttttgctttcattagttcatcgagctaggtcaaaatcacgctgccctcgatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatgttgctttttccaggactgataattctataaagaatcattggaatagttctctcagaaagaagcaagatatgtacaataccagcaataatatggtagttccgaaactgcttgttcatgataagttcaaggataaaccaaagctgatggctatggagggtcatcttgatttgaacaaggcacccattatcaattcaaaagaccaacctggaacagctcatcggtctaattgctcagggtttctatctcgttcctcattaccaactgctcagccacttacttcccgtgaggcatctgtagttgatggttccgctgtcactttagtggcgcaagctctggaaagtgattctgtccgtggtaagggcttggaaattgattctgttcatgagaaaggtcttgaggttaactcggcacctgatcataccgggaactcttggaccattcaactagaagctgcaccatccaaaggtgaagcagaattatctttgaagaatgaggcacgctctcttggtccactttgttaccagatccctaacatggaagatgtagtccctgtgagttcctcactcttttctgaccatcttactgggaaccatacatctgaacattgtggggatgatatattgtcacctgctggctgcactactccccctccaacaaagggaaaattaacaagccagcttagtgttgattcaattttgaagagtgctgctaacagttttccaggtactccttcaatattaaaaagaagaaaacgggataaatcaacacctgtttcagctagtgagatgaagatcagtggatcaaatactgatagattttacactcccatggggatggaacctgctacagctacaccagagtcattcaaaactacatcttttttgtcattgggttctcttgatggttctgtaaagagctttgatgtttcaccacaataccgggcaaggtcaaaaagaatggctctcacgaaaacagttgagaaacagctggatttttcatcagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggatgtaacctaatcnnnnnnnnnnnnnnnnnnnnnttacaaaaatcttgaaaacccctgctttacaattgagatgcattatacttttcatagccagtctacaaattctacctggtttatctgatccatgttggtagttgggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatgatatgattcagctgtattactggccctgtttgggtgagcttaatttagagaaactggaatatgtttctagattctaattctatatctatagtaactatacatatcagaatatgtatgaaaaattagactatgtaagaagggtgtgttcacactaaaattggaagtttggttaaaattggaacgatgtgatggaaaaattggaagtttgtgtgtgtaagagttttgatgtgatgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactccacgaaaaccctctgcctccttcgctcgctgcaccctcgtctcggcgatccatccatggctgccaggaagttcttcgtcggcggcaactggaaatgcgtaagtattccccccagcactagtcgtctcacaatccagattccggatgagccggagacgctgctgatgagtgatgaggcttgggttttatcgatgcgctgcgctgttgctgcgtgcagaatgggacaggggaggacgtgaagaagatcgtcaccgtcctcaacgaggccgaggtgccctccgaggacgtcgtcggtgagccgtcgtcccctcccgagggcgttgtttggagttggatcgattcatgaatcgatctggtgctgatctgtgggtttgtttatttattttaattttttttgggtgcagaggtggtggtgagcccgccgttcgtgttcctgccgcaggtgaagggtttgctccggccggacttctccgtcgccgcgcagaattgctgggtgcgcaagggcggcgccttcactggcgagatcaggtgagcgtcctcccccactcccctgctctgtttcccttccccttttgttttgagagagatgattagtgatttatttggcattgggtgaacaactcggccttacagcgcaatctgagtgtttatcacgagagcgtcgattttagtacggattgttcgaaccgcgagtattgttagtcgattataagcagctctagttccacgaaatctgacttgattataggcatgaatggatttgtgggacagctgaataatgaggcatgagtatgctgctgctgctctattgtggttatcggtgatgttctgcagactgcagtgctattatattaaggggtgaatgacagcagaatgtggaatgctttaagagcaatcctttgccaattcactgacgtatgcttcatatttgcagtgccgagatgttggtgaacctgcaggtgccttgggtgattctgggacactctgagcggagagcgctgatgggcgaatcaagtgatgtgagttctttctacattgtctagaaacataggattttttttcatgtcagctttatagcaactagaatgcgggcagctactggtttagcaaggccaggaacttgccaagaatatctagacaatggtcctattttaaggtcaatctgcaccgtccctaagctagcataaaagactgttgagttactctgttgagttttagccaagttagacctataaattgggttatttcatcaagctgctggaaattctgtttgaagctcatgggattttgatttactatgttgttactaacagttcttttcaccattcatgacagtttgttgctgacaaaattgcgtacgcactttcccaaggtatcaaggtaattgcttgcattggtgagacccttgaacagagagaagcaggaacaacgatggaagttgttgcagcgcaaactaaagctattgcaggtaatttcacttgctattcttcaagttaatttcttataaagttggaacttcacccctaatgttggaacaactgaataagtgcttccttccttccttatgaagtaccttgtgctgttgataaatccagttcttccaccttgaaagctgttaaacaggaatgctagtttatatttgcagaatagaatactgtgattgcttttaccctgctaaatatccaaaaggtatctgtagcttgtgtacaggtttatgatgataacggtgtggtcaaattattaaatgatctatcatttgaactaggaattatgtcatacaagaaacacatactttactactatgagccttttagttattgaagaaaacacatcctgttttgattagtcacatccattttcgtttcatttgttctttatggcttttgtggtccattgtactgtgctgacatagaagtcttctcatttctccacccctaactttttgtcttttttactcgtcatatttttcagagaagatatccgattggaccaatgttgttttggcatatgaaccagtttgggccattggaaccggcaaggttgcaacccctgctcaggctcaggaggtattccttctaacatagagcaattacatcacgattagcatgttcccttcacatttatctgcctcataaaccaatatgggttttttcctatatctaatgtctttcttgaccgatgcctggtacctgattctgcaattctgttcattcgaattatttgaaatatgcatgacattaggttcatgatggtctgagaaagtggcttgtgactaatgttagtcctgcagttgctgaatcaaccaggattatttacagaggtatacctttataactataggactatgaattgaaatgtaaccaagattttgtttagtagtgatgccaattgctaatgtacaaaactctccccacttccctacgattaacctgatcccttgtcttcgcatatttgtcttctacaggctccgtaaatggagcaaactgcaaagaacttgctgctaaacctgatgttgatggattccttgttggaggagcttcattgaaggtcatattcctattcctttattatcctctccatgatattgatagtagcatgtagaacataagcctagttaaacaaaacaccatttgaccagtacaatccttgtgcggttgtgcctagtagcatgccaaatatttgaatttaactctatacattctcacataacatttcaggctttaccgttgtgtatattactgatgattactttttttttctgcagcctgaatttgtggacatcatcaagtctgctaccgtcaagtcttctgcttagtgttctgggttgcaaccagatgatcgtaggagttaatgctgccaattttaagttatgacatgtttgaccagcttgctttgttatatctcgaagtcagtgaactccatatcgttccatagagcatgcagccacctgtggttgctttttttctttttgactttttctcccgagaggatcagatgaactgaaagtgccgttaatgtctgtattatcagaagtttgttgatggcttgatgctataatagttgaacctgatacttcctgagtgaagtactgtcctttgcatgtttgattgatgattacttgttttcgtagtcaaacgggctatcatgaaggatatactacatgtttgttaagtttgttacttcgtgatttaagcaattgttgattaatgcagaataataaccgggtcattcgcttgttactctattacattgtcatgtaaactagttagtgactgaatccatctgtgacgtactgtcctccctcttcctttcttgaatgtacactcccttaaaagcgttttctgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcagatcagaggatgtgtattctgaatagatcctttactgccagtgcccccttgcattgttccaattctttaagagaaaatcgagcatgatccggcataagttgaacacctttgtgctacggcgtttgtcaatcacagaagccgtacaagctgcggcaatggcccccggccggccactcgacgacgagtttaacttcactggtgagtggtcccctgaggacgcctaagcggcgaacccagaaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcgagttgccggcggcagccggcaggccggcagcggcgtagggtgtaacgccggctcgttcctacttcctccgtttcacaatgtaagtcattctagcatttctcacatatatattgatgttaatatatatatagattcattaacatcataatgttagaatgacttatattgtgaaacggagggagtagaaggcaacatgtcaagaaggcaggaaggcaatcgagggcggcgcggaggacatcgctgaggcagaggcgcagaagagcacgccgtccggggatgctcgtcggtgaggtcaggggctcagggcggccatcattggcagcgatccaagcagggtcctttttacaaaatgtcagggcctattcgaaaatgtgttgggcacggatgcgtcaaacgtgggtggtccctggccgttggatccctgtcaacgccggctcacccttcgtcctcgccgttgcaggggacgaccgacgacggtgatcgcatggatgtcggtgccgggagctcatcagcaacgaggtcgtgcgcgagataatcctcgctaggatttcccgtcgctgagcgtgagaagcatcgtggactaatccgcaggtgcagggcgagcaaaaccaataagaattttctttctagttgtcctcgattaagccaaattaggaaccaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaattctctgtctgctttcatttttctctgtctgaggatttcaacttttggattactgcgacactgatccatgctttgttctttaattagttatgtgttgcgcgagctatcgacttcaaaataatatgctttttttttgtgatcgactgatcgccatatacctgtacgtaatgtgagacgaaaccactattcaattttgcagctgacgttgtgatgttgatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaaagatggcggggagcggtgtcctggaggtgcatctcgtcgacgccaagggcctcaccggcaacgacttcctaggtgagataggtgcgtcctacctcgatccgcggccgagcgccgttagaagaagacgaggccgatcgagctcgatctcatccgcgttcttgtcctgtgcaggcaagatagacccgtacgtggtggtgcagtaccggagccaggagcgcaagagcagcgtcgccagaggtcagctaatactgctccgtgcagattactgcaaacttcttggtttttcgtttcagaattcggattattgttagacgaggcattgacgaacgttctgggctctgacctgaaaatgcagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgtgagtgccattatatgctctcaccaaaacaaaaagccaacaaccatggcagctagcttagtcatagcaaacgctaaacactaaagtaattttccagttcttaaaggagatattaaggaggtaccaaatttacactaaaatttttggaatttctcgaggactataaaatttctctgaacactactataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagaacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaaattaaaggtagagttttgagtctgtataaaaatacaatttacaaataactaaaattcgaaattaagaaaaacacgtgaagaagagtttaaagtcaacatagaaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacatatataaaatacaatatgaatatttcacatttgtagtttcgtaaagttattgcaaaatttaaaattatgatgttattttaatatatttgaataatataatgagaaaacatatatgctattatatgagagaaaatataatgatgctagccgtataatctgcgcgggccaccatgctagttaacataacagtagaaaatgcatccaactatacagttatccccaaaagtccgcgtttgaacctgaacatagcaaaggtcctacttaactcaaatgaccagatctgttccttcacctgattgtctcggactcaaaatggatgtacaagttagactactggtacctgttaaaagattcaaaatgtgaccatacccctgaactgtactcgtttggtccaagcaatatggacttcgtagttgtaaactgaagaagatggtctcgaagtggagatcgttgcctcaggtgcataggtaacaagtcacctcttgcatttacatcagaatcaatttcttcataccttcactatagaggaaacgacaggtgcaattctgctccttggcaagaccaaatagcaagctatgtttcctaggtgcacaaagttgctgcagtagtactgtagtattgtccaaggttctaagttcagatcgtgaggcagtttgcataaacaagggattgcatttttactcatcttaaacttctgtaatctctgtgactgataagatgtcatcacgtggatgggctgcttccacaacgacactaacttcatctcccactttcccagttgaaaccacggctgtagcttggatcccaacctgcgaagtatcaccagaattggaatgtaataccccaatgacgatattgagaaagtgatcctacttcaaggaacccaaatatgccattggagaataattgtgacgaactagtgtagtggcaaagtagtctagtacagcagacatattaattagctgtgactgccagtaatcctatatatctgcaccactagcagcgattagtgctattttctcctgtgtaatgaaaccacatcatctatgttttacacagccggaggtctccatctagtaatacaataagattagctctagtcgtttctagcatgatcactgatcacattgttccatgtccagataaaatttttaccagtctggacaaatttagctgctataaaagttgggagttggtgctggtgggccatctaaccctctttcacctcactaaaaaaaaagccgcagaaagaaaacgttgctcttgttccaacaactccctctcttaaaaatttgaccagagtaccagacatggcatcatagctcacactcacggtgtaggatgagcattgcagggtcggtgcaatgctgacatagggtaaagctcagttgatgcagtggattactatgagattcaaactgtagcaaagcatgtgtattcaaactgttcctttgaatgctaagatatttgaatacttaaaatacaaaataaaacaactattgtcctggctaactgctttgcctggttcaatttgtttatacatgaaccatcaagcaattgacttgcatatgttttaccaagccttatccctattccatgtcatgtagattttgtttaacctgagtcaaggtaaaacctggtttaagataatacaaaagcattgaaatcagctacaaaaatagttttttaaataaaaaaccgtgaataggattgaattatcctaagtcatctgggattggtcatactcgggaataaacaattaaaatgaagtgaatacacaataagatggtttttatactgactaggatttgataaactttcccaagccaggttacactggttttccaagccctgggcaagaccactaatatctacagaggtgctcttgctccaaatacaatcccataaaagcaacaagaatactctcatcttatatatatcaaataaaaatgtactggatgaagcatgtttgtgtacctctataacaagcaaagttgccaaacgatccttaataaacttaagaatcagggctttatacttctttccctttggttgtcttctcaagtattccaacaaccagtaacgtaagttgttgctatggagtctcctggcaactttaacatgcatgcttgcaataaaggtcattccttctaggtcaccagctgaatagggtggagattcacctctaagaaaagcctttatctgcaatttaatacatcttccatcagcactcaaatttaagtagaccataagtacgacgctcggatcaagatacaatgaaactagactgcactcataacataaaacacaaggtgggaaattgataataggaaagctctttgtaaattgtaaccatcatgttcctggaaactgttaaagttctccctattagcaggaataacagaggcatatttacctgataatgagctagcagatcaacatatcttcgaataggggaggtgaactgtacataaccaggaataccgaggacaccatgtggtacaggtttttggaaatccatttctgcagcacggagcacactgatgttggcaaaactcctggcaggcccttcagggagatgagtaaatgctgacacagctgtgttagactggggatgccctctgtatggcaaagcaatattgttgtcagaaccaaaagcagccacggcctccccacagagtatcatcatctcagatacaagctgcattgctgggttggattggtcttcaacatatagattaatgtttggttcaggatcatcaggatttgccaccttgatacgtggttctatcatagcagtatcaatcgaaccctgtgaacttcagagtgtcaattttgtcaaataacaaatgcatctagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacaatgtattgataacttttgaatgtttatcactcccagctaggcaagggaatactaggctctttgaatggttcacatggctcctataaataaagtccaatgatatttgaactacacttgagaacatgctggatggtgacattgacaaggaggcaacttccgcttatgacttgctaagtcctgctgatggaggagcacaagtcatttggctctcctggtgcataatagattttctagtcaacacaggctagagtgtttaacattctcttctctacaaatgacccattctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctataacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtcagtaggcacagctgctaaattataaccagtctcttgggatagatgcaatggcagaaggaacagaaacatgcctcatcagcttcatccacatcaatagcatacactttcaaagttgagagatccttcctgatatcctggaaagatgaattgaatgagattttgaattagtatacatcttttaagggaagacagtgagggagaggcttgctgtcagtacaaatcaacttaggctgtgcactatacttgtaaaaaaacaaaaaacaatacaaagggcatcagtatttggtagtagactaatagctgacatattaatttatagttgtacagctaaacttacataaagggaaaaacacaatatgaagaacatcaatatttggtagtaattaaaactaccttgtctgagtcaggacagtctaccagaagttcctctgcagctgacaaaacttcctcagtgtacctgatgcgaacatcatacctgtaaagatcaagattgacatgcacagggaagtatccaatatttataaggatctttagagcagctgatgaagtctttgaaaagcccatagccttgagaatctgcaattacattaataatcacacaggtaaacatcagctacaagggaaaacttaattatttccttcaatgaagaattatgttacactacaaaaacatttggttcaaactttttaaaggacatgatactttatgatggtaaacaaggattatggttattcagtaaaccaacactagtgtaaacaaatatttacttatttattatgcatgacaaaataatagtagtggtatagaatatgttacgtttcctgccgttctcctttgttcatcatcacatgcatcaactgcatatgcctgaagtgactcaatttttcgcttaactttctcctccatcaaccatgaatcttttgaaggtttagcatctagaggcaatgctttggcagacttgattaactggacaaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtaaagcttaatataggaaaaaatacttcccactcagacactagatactaatagaaaaatgacgagaatatgtgaagtcaagcattctttagttgaccatcaagatatttaataaaatatctagattgatcacatcaatttgatattattgtatatgctactcacaatacaatagacttagcagtaactgtggcaccttggagactacatcgattagcaaaacgacctatattttgtgaaagaaagagtgaaaggcaggtaatttagagtgtgtatcgtgagatgaaaatcatgggtatatttaggaaatatacctgagcaggtgggcgaggttggtacacagaagaatcccggctttcgaccttgacaaaatagactatgtcccttgataacaagaagtgtgcacagtagctttccagagactccttgctaccataaactatctgagaaaacaaaagattagagttacatctgaatatggaaatacaagatagaaaatcagatggaataagggagcttctgacctctgcgaactcctctactgttactgatttatcattctcagaaagctccatccaagcacactccaaaacagtagggtcctaaaaaaaaaacaaattatgcacatgtatctatggtgcagatacatatcatgattcgtgcaacacatcttaccaaaagatcttgtgctttcttgataaattcatctattcttgaatgattgtaattgatgataccaggtataacatatgtaacctgctggggttttatagaagacaatataccattctgtacaaatagaatagctatgtcaatgaaagaaatcatagacaaatagacaatgacaaacatatgctaagaaacatactcattatcaatgtttactctattgaatatagacaaaactacagtaattgtttcttttgatacctggtcagtcaccttccagtttttctttccatcgggcctttctacaacagcaagcaaaaatctctcagaatctttctgaaattcaagaagcaggcctttctgcaatgttctcttatctatcttattgtcagacagttcctttgtcccctgcaatcctatcctgaaaaagggattccaacagcaatctttagtatattgtcaaatggttaaatcaaacaattaattattaaaactaaacatctgtatgcaaaattttcagaactagccattaacaccttgtgataagctaaaagaaaggaagaaagaaaaaaaggaaacactcatttatcagaaaaggccagtgcagcagtgtcacactaatatagacatcacaatcacaatatactaaatggttgtaaatttggacaataaatggctgaatatctacaagtatatatgttaacggattttccgcattacagtataaatttcactcaacacatttaccaataaaaaatcgtgcaaacattatttcaccttcccagaagcacattatatagaaacagctccttgagtaaattatttgattacttttgttggtacataaatagttcacagcaacagctcataagaaaactatgctcacctacttgcatcaataaagaatatactatggccactggtcaccgctcaacggtagaaatgtcaattcctaagaagtttatcataaccctatagtctgtttggtttgatactgatgattgccattgtttgtcttaccaacttttggtaccattgactggatttggccagcatttggtttgctaaaagtgttcggaggattccttccattagctccctagttcattccttaccaaactttggcaaggagtgctatggaaaatttggcacaaactaccaaaccaaacacctctggggcttactcactaggcaccaaccgatgaagttttactaaggaatcaaaactcccttgtgcacaatttaatgaggaaatacatgcggattagtaactcagtgtaatgtataacttggtagctactgccaatcagctccaagtgcacacgcatacaccaaccattacaactcaagcatgcaaattatgggttcaaaatgcataggcaattcagtctagagaatgacaagggcgcgttactttgccgaaacccgaccacgcctctgtgatcggagctcctccaggacggagtcgacgaggccatggacctggcgtccccggcatccgccgtacagggagaagtgccagccggcgcgagcggagtccgggcggacggcgcggccgaggggacggaggcggaagaaggcgagcgtcgccgccgccgccgtggagcagccacccgccgcccgcaccgccatgggcgacggcctcatcgaacccgccgccacgaagctgccgccggggaggagagggtttttggcgataagagcctcccgcgagtggaaggcgaggattcaacggtgcatcgagaggttagcaagagggacaaaaatcccacgaccgcaatatgagccgccggtttcgtgtgctggtcccattatggaataagttcaccagagggtacctcaacttaacagcaaaattattttgagatcccttaaccacaacaccagaaatatgtacccctaaattcactcaaactgtttaaaggaggtcccatggaagtatatatgggtggtttcactgacgtggcatcctaggctgtgttcgttacttctggatgggagcaaatccctcccacatagaaaacggggcggtacattaacacgtgattaattaagtattagcaaattatttttttcaaaaatggatcaatgtgattttttaagcaactttcgtatagaaactttttgcaaaaaacacaccgtttagtagtttgaaaagcgtgcgtacaaaatatgagggagagaggttgggaacctaggttgccgaacacactcctagtcatccaaaaatattaaaaaaaatacgggggcccacatgtcagccaccctctcctctcttcttctcctctactcttttctcacttctctctgcttttcttcggtgagggaggccggcggcgggcagtgcgcgcggttgccggggcggagcaggcgtggcggcacggggcggccgggggcagagggtggcgcggagaggaggagaggaggccggcccgccggcgaatggcgcggattgggggagagaggcggccgggatggcgggagtggcgggccgggcggagggtagtgcaaagagggggagaggaggcgggcgcatctatgggcggcgcggattgggggagagaggcggcggatactactggagccgcgggcggggcggagggcggcgcggagaggggaagagaggcggtcgggacggcggaagtagcggacgagagcggcaagcggagcggtgagcgagagctgatagcagagtgactggcgagcgaagctagccgtggacggcgggcgatatcggtggcgctcatcatgctccagctcttcattgcctgcgtcgtcatcgtgttggttgacctccatgagcgcagcaggcgaaggagcggtgggtggagggcggcgggcaagtgcggcggagcggggggcctggtcagcaagggtgagcagcccggcgccatgctcacccgcctccactgtcgtcggccatcgacttatttctccccctttcctcgtcgtcgtccccgcatgccgtccgccggcgcgcttgcctcctctccccctctccgcgccaccctctgccctgcccgctgctcccgccgtttcggccgcctctctccccctctccgcgccgcccgccgctgcgtctgcctcctttccccctctcccgcttcttccccgcgtgtcgccgcgcccgttccgccccggccgccacgcgcgctacccattgccggcctccctcaccaaagaagagcagagaagtgagaaaagataagaggagaaaagaggagaggacggctgacatgtgggtcccacatattttttattttttttactgactaggatgccacgtcagcgaaaccacctatatatactgtcatgggacctcttttgaactatttgagtgagtttaggtgtacacatttctggttttgtggttaatggacctcaaaaaatctcgttgtcaagttgagagacctgcggtgaacttattccgttagcttctggaagattcgtgattgggcctcaacgggaaggacgggctgattgggccatatgtgggccgtcactggtaacatttgaatttgctgcgggaattcgagcttgtgtatcgagggtgtgactcgtttgttatacgatctactgcccagattttcgtagaaattgaagtgctctacaaaatggctgtaaagttcaaacgaaaattcactaatcttgatgtaatgtgattgagaaggtccgaattgagttttataccacagtacagagacaaatgcaaaccattggatcctcagggctccatcggtcctgaacctgaactgtggtcaatgctgtaaatttgttcattaattaagtttatgttttccaatgtcaggattaactttcatgtttcagctctcgagctccttgggttccttctaatggcacatgtccccaatagcctcatcggttattcggttaatataatcaagagctgattatatggcacacagctttattagtgattgaaaaataatttaaaaattttatatatatgtgtttttaacgacttaaaaataaatgttaaaagagatattatattaaaaataccataaaatcaattttaaattttaagttttaactgtagctgaatttatttatttggtaaacgatgaggcttcttttgggtggcagccagagcaccgaatcaatctgggatccatggccgttattagcaattaatttgcatccacgggatctggacaacacgtagaccttctagaagataaacatgtgctacgacagctacgtactgtcattgcaaggacgaagacgctttgtgtgtcccctaccgccctgtcagagaattgctatacagaacttgcaatgcgcgaaggctgtaatgcacaatctaaagtagtgaaagaactctaaagataatttcaaacgaagctgcttgattcataaatttgactataaagataattaccaagtgactcaatgaagtgtgcaattaacagtactgttgacgctctttcagcatagcagtataatagtattatctccgtcccaaaataattgtaactctaaattatttagcgtatattaaggtttgagaaagaaaaaagtattgtactctaaatgatgtataggatatagcgaaagaataattatgtagaatactaggaagaaaattaaatgagaagtgattgataggacaattagtactttattgtgacatttattttaggataaatttaaataatagtagaaatacagttaccatgaataagagtgtacaattgagactaattcagttaatcatttttttataaagaaagctttattaatcttagacaattatatcaaagtgatacaattactctaaaatcaattatgacttctgcatagctagaatgcacgctgcctacaataaaaaaataaataaattgcttcaaaattaaaaaggatgacatgacagcaaatattatatcgcagcaaactgcacccaaaagtactttaagctcacgtcgagataatttaggtgcctagtttattctcagtaaaaagttgtcttttttcttttcaaatttggtcctatttggctggggaatagtgtattaccacctccgtaaaaaaaatacaattctaacaatacacctagtattaagggaaaattaatgatgtcataattaaagaacagtgcgaatgcaactgatgtccttgtattatgtcatcaaggcaacatgtcatggtcaaacccaactcttctcccaaactgatcaagaaaattttcgttatctgctcgagctacgtgccccggacaactccgagaccgaagctgcaggaaagccaagtcaaaggcgacatctccaagccccatctaacctcgctcgtggtcaatatgctactttctgctatccccaggaaaaaaaaattgcaaagcaaagcacccttaaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaataattatataaattaaagaggaattttcaaaggcgtgcagtttttctcgtgttaaaattgctgacagtgaagtgttgacggtttgtatcggaccacgtattttacaacaaacttctacggtaacagctagagctagctgtccatgtagatatccaactagccaataagcgccgtgtgtcaattatctgaattataccctatttgtcgtggcatacatggagtgatctgaccaaaaaaaatgccgaaagctagggtgtgtttagttcacaccaaaattagaagtttgattgaaattagaacgatgtgatgaaaaagttgaaagtttgtgtgtgtagaaaagttttgatgtgatggaaaattagaagttcgaagaaaaagtttgaaactaaactcagccctagtagtattaattagctagctttgtctactactccttctgtctcaaaacaaaaaaatgtagagttatatgatacatattttaaaattacatacacatttatagttctagcatatgtcatattcagttaaaggtttttatattttaaagagtaaattacactttggttcatgttttattacctaagttgcacattaggctaggcattagcaaaacttttcactttagacaagattttatcaccaaattttgcaagttggaccagtggcccacgcgtcaaccactgatgtcttcttcctcaatcctcaatcccctacgtgcttccctgctccctcccgattcaatcgaatccactgtgagctcctatggttaatcccttcgagcacgcggacctccactggtgagctctttctagccttacaaactcaccactcatcactgcgccaaagcagacctgcttgagcatataccctgtgccctacatgcagtgaggagtgagaagcccccacatatcccatgattatagctcaagctagccattgccggtaggtaggctccctgacctgagttagcgctagagctcaagatcaaactctaacagagctgaccccgtacgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattgttcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacagatgaagcaatcgtaactgctactgtactagtactatacgtacgattaatgcatactgtacgtgatgatgaatgacacgattgtttatgtccgattgtccatgatcacacataaaaagatcaacttgctatatataaacaccaaaagaagattgccccatgaattaaaaaaaccttaaaaacaaaagaaaagcctgaagcccctccaaaatatagtactaacatcctcatgttgatccgaaaagattcccacctgtcagtgttgttggtcttgtggctcaggtccaatgtaccaagaccttctagaaggaatctatgggggctcgctccacttgcatctgcatgcatgtgacgcagctcgcatggagtatataggagtaaactaacgagtctcaagaaaactaatcatcgccatataccgagattttgagaaaactaatgaacaaccaggtttatttggttatgggatataatcgcttcttaatttgctcaaagcctgcaatctaaccaaactgcgagaaggtctttgccacacctgggacccgtttggttgacaatcataagttgctatcaaactgtcaaactcaaattaagattatgtgctcaaaatctaattagcacaccttagcaagattaagataatcttgtcatcttttcggagtcattagtaatagtatgtactgtctaattcgctagaaggaataaaaatcatgatatttaaacttgattaatcttaggtgtgacaaaatcatgagaaattgcgtccggcaatcaaacagacccttgaccacatcagcctcttgaataaaagtatttcttcttatttattggatttattagactttatcttcttatttgttgaaattgtttagttgcttgtaataaatgatgggagaatggcaaatataccactacttaattttacctcctaacttggaatagccattaaaaaaactgcaaatttaccactagaatagcttccatttaccattgttgtttgatgtgtgcaattaagaggctaaaaataattcataaaacaaatgtgaaaaatcaagggaataataagaccgattccctatctgcctctcttcaaaccctggcagcactcatttgttccctttgcccatcccctcctctcttccttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagccgcaggcgcagcagctaactatggtgatagcagatgagcagcatggactacatcaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcagatagtctaggttcatactgtattttaatggcaatgcaatcacatttttcttaatggcagattcacaataacaattcaaaccaataacaaatatgcaattggcccataaaaaacgaacctagtaccgaatgtaacacatcatagtacttgtccatagtactaggatgtgtcacatccagtactattggttttttatgggatagaggaagtaagggggtgtttgggaaggagagactaaacttcagtgattgagcaaataccacccaagtaattgagcaaataacagaactcgtttcattgtaaaaaaaaaatgcggcggtatgtggtggtaaccactggcactgttccccgggcctcgctcgtggtagacgacggatgccgctcagctgggtgcacgacgtactccacggtgtaattcatgtgccgtttcagatgcgtgagtgcgtgacgccgtgaccccgctcatcctggacgcgtcctgtctgtccttcgtgcgtaataaagtgcgtgtgtccacatgccgacgtggaggaagggccccgcagccccgctgcgacgcaccacgccgtctgctgatgtgtcgctcgcgctgcctcgggccagcgtgcggccggcgtgcgggagcggcgtgtctggctcgggaccaccacgtggggccgtgggggaacttggtggccaaggcaattctgtgtccgtggccttcggtgaacccggcccatgcgccgtatagtataatccacacatgacacagcgcaccgcgccaatcacagtccaggaaccgcgagaatttttttatttttaacttggcgagatttctcgctgacacggtcaatcggccactgcacacgggagtgtacaggaccaagcgggtcaattacggctaatcctaaatacagcgacgacgggcggttcgtgggtactacgtactagtagcatatatccatcttagagtaccatctaaatctatgcttctaatttatagtactctggatattttctcacggtaatcatagaaataaaacgcataaggtaaccaaatataacttaaaacagatgaagtttaaaagtcgcaccaaaaagtccaaactttaggagacatcaccttctgcatccctcgacccttctcttcctcactcaagtctacttttccttttgtgttctgtctgtacatatctaatgctcttgagctgtgttatttcttatggcttcccaacctatctctatcattttttcatatgcacgcttttcaaactgctaaacggcacatgttttgaaaaagtttatataagaaagttgctttaaaaatcatatcaatccatttttcaaatttttatagctaatacttaattaagcacgtgttaatttatcgctctgttttccgtgtggtggggaggggttccaaaagaatacagccaagtgtgtaaagcgatatactcaagtactcaaccctagtacaaaggtatgcgctttacaaattatagaaaagaattaaaacagttgaaatttagaaactccccaaatttaaaatgttcacgttaataaaaaaaacaaattatcaaccctagtataaagatatatacacgctatttgcgtattccagaaataaaattaaaacaactgaaatttagaaactccccaaataaaaaaatgttcatattaataaagaaaatcaaattaccaccatgagttaagaatactactatacttgatgtagatgtagctcgtgcatgcaggcactatatgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagggaacagcgaattgatcatcgaccaaatacttggttatttgctagctactcaaatacactcaatacttgatcacaacgtacgtctacacttgtactcttcgtctacgctcgtctcccgagtttatagtgcagacaactaagtttcaaaaaaaaaaaaaaaccaagttcgtctagaattggcctttcgatgtgtaaaataaatatgcgcatgacctatatacttcaacctgaacgtgtcagaaagaacatagattgaacacgcaagctagtgggtgttaatggcgtgcatatttcatcaaattcagtgaggctatccattttacatttccccgctaaaaaagataagggtatgaatagagttacaaagtctagcattttagcgacccacttactctctcctagaataattagatattttattactaaaaccaaggagaaataaaacttcgaccgtaagctacttggttgcatacatgtacgtgggttgctctcgctattattaacgacacgacgaaattaaatgctgcatgcatgtcctccattcaattaaacaccgcatgtatattttcccattcgtaagatgctcttttttttctccttatacactcatcatccttgtatagacttaaaaaggttaacaattcttaccctaccaatcatctgttagactatttggctctgtaggttgggatcttctactcactcgtttttcacagacacatttctcgaacggttaaatgatatgtgttttgcaaatattttctataggaaagttgttctaaaaattatattagtccattttcaaggttttttttcttcaaatacttgattaattatgggctaccttatttttcgtgcagaagaaataggttgaacacactttcgaacacaaccttaattttgaatagtacctgctacctatatgaattgaaaccaattcttgccaattcgatagagttgaaacaatacaacactaccaaaattttgatagtaccaaaacttatttaaaatttagtgcggcaagtttttgatacaacttcaaaccaaaaacaaccctttctatcaaactgatgccaaatttgatatgtttgcagctgcacgctgctatcacacccatctggctagagtcaccaagctgctcaatcagtcaaaccgtcaaagtatcgaccaccacaacaaacgtccccggtgatgatgtggatcaccacaacaacaaaatacttctggcccaagtcggccagtaatcaacaatccggtctacggacacggtccaccccccgcacccagctctcggcccaggaggccgctcgcgctcgttccacgaaccttccccacggcgcaacccctctccgtgaacccgcccgcatcccacctccgcggccgtggaccaggcgcagggaaggtgtcgacacttcggctgcgcgagcgcatagcctcggttttaatagtcggcgaacggctcgggccaggccaacctgcgcctctcgaaaacactggtccgcctccgttcccctctcctctcggctctcttatctcacccttcgtttcgctcgtctccctcccgccgcagcaggtacgcgacgcgagctctcgtcggctgcgatgttgtgcgtgctgtttacgggtgacgggtcggactagccggcgcgtgggctcgacgaggcgctgctccttcgtcgccgcgggtttctgatttttgttttaattttcgtggtgttttttttggcgcatttgctaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctttctcggatatcgtcctggggtacatcaaccgcatgctcatggccgaggacatcgacgagaagttcgagcactacccggtgaacgccgatgatctgctcgccgccgagaagccgttcctcgagatcctcgccgaccagtcgccgtactcgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattactttgccaatcaaacaattttgaatgctgtggagaaggccaagaaagttcacattgtcgattatggcatatactatggatttcagtggccgtgtcttattcagcggctatctaacaggcctggaggcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26359 - DNA, 658 bp, Oryza sativa
  unsure (1)..(658): unsure at all n locations
tttttgcccgttcattgtttcagttacccattttggccaggtgccttttggtactgaatgaatcaaggcttctcaaacaggcgtcacaacataccgtgctatcgtagtggtccggaagacgatacctcacctgaggaaagttcggccatatcttgctgttctggtcaggttgagtgtaatacacacactannnnnnnnnnnnnnnnnnnnnnnnnnnnnnnnnttcactacgcccttcacgtgccccattttcacacaacagagtaaacaccgcccaggaccaaaacaatgtcgaatcttaagaccattagtttcgaaatatttttgatcctgaattgagggtacagtaatggactagttttttttttttgaaatttacagtaatggactagttcatatagttaatcctttgattcgaagtattttaagagcaaagtccgtatttaattgtttggttggtagaatgacgcctcaatccgcaccattctgtcgaataggaccaaggcacacgtgatgcgacgtgcatcatggtacaaagttggcaaaagcgcctggtagcggagagtgggaaagagctggctgggtagtagactagcaggagtccacatcgtcccatcaacgctgcgacgccaccatttaattccacacccaaaacaag

SEQ ID NO: 26360 - DNA, 1183 bp, Oryza sativa
ttgtgactgttgatccggaaaagttcacacctgatcaaaagaaggacttcgaagcaatgatgcaacaagcgcgggatcaattcttaaaatcattcacgcagactcgcaaaggaacattggttcagaagtataagataaaggtagttcctgatgagcctgagaccagtatttcaaaggaatgagaagggaagagaggctcagaatcggctcaaccaagtgacaaaggtgctaccgacggctcggctcaagagaatcagggtgaaaactctcaaggggtacatggagttcaaggtgatggtgtcatgggccacaaggaggaaatcttaatcaagacggcgagacagtgcaggattttttcaacaatttccaagatcgggttgattatgttgtgcacaatgctttgatcaatcagtttggggtattagtcaataccttgtcaaacatgatgaaatcaatagccgatggatcaataaccgagcatcaggctgcaggcccggtttatttgcaagggggtgtcttcccaaattatcggcctttgatcactggtgctcaactgtctgcccaaccagttcctcccattgcaccttcagctcagccgacggtaccgccgttgactcctttacctgctccagcagcattggcaccaggccagccgattaatcctcggctgttgatgagggagcagccatagcatagtgggcaggtgacaaatcggctgacacagaccaggttgctgctatgtttttaccccctcaacctactgttgatccggtccagcaacagccgattcaacaaacgccgtctagacagcaaactatccagccgattcaccagcaaggcttgatgaatcaatcggccggacaattggctagacacgtcctgaatcaggttgttccagagggtttggttcaccatatgcagccagatcatacggtaatgccccagattgtacctgagcacttggtgcaaaatattcaaccgaattaccagaactaccaagggggcaatttgaattatcaatatcgacctccttccccgcaagcccaatatcagcaaggggggctaactcaacctcagttcactcctcagtgtaatcagttcgagccaatgcagcaacaatcgcaaggagcagctcagcaacgaccatgggccgatgtgattgctgacgtgatgagggaacagt

SEQ ID NO: 26361 - DNA, 703 bp, Oryza sativa
tataaccaagccaataccacaaccatgagtgcatatagatccatcaaagaataatgtccaaggcataatgtcaaccaagccgattgaaccatcacgatgatccacaataaaatcggctatagcctatcccttaatcgccttggtgactcgtaccgaagatcaaactccgttaaggaaaatatccacttaccaactctcccttttaaaatcggagccgatagcatgtacttgatcacatcggctttacataccacagtgcattcattggacaataggtaatgcctgaacttagtgcaaaagaaatacaaacacaagcacaatttttccacaggagaataccttgtttctgcatccaagagccgacaacttaaatagaacactgccctctcttttccttcaagctcttgaatcaacaccgaaccaattgacttgtcaccaaccgataagtataacctgaaaggtatccctttttgtggaggaattaaaactggtggggaactaagatattccttgatattatccaaagctttctgttgttctgccccccaagtaaattgctgattggccttcaatcttaataatggtgtaaaaggctctaatcttccaaataaattagaaataaacctcctgacgaaatttatcttgccgatcaactcctgtaacttcttgtcctctggaggttgaatcttttgaatagcattaa

SEQ ID NO: 26362 - DNA, 14464 bp, Oryza sativa
  unsure (1)..(14464): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagtatattgtggataccagcaaaccaaagcaccacagattcctcttcctatccatcaattaggcatgggagccatactggattcatctgcctctccgatgacaacgccaagttttatagtttgttcctcattgtgagtagcaactgcagcccatagtggtccattgtgatgtggacgagggttaccgatcttccgaaaggttctaataggcagtcaatttgagcggagtcgcgacacagcccgatccggcttctgaacgaacacgctcttgagccccgcaatcgtagcaccacgtctcctctggttatcacccgtatcgaaacgcggaagacctcgccgaaaaggctaatccctgtttgcgaatcgaagaacacaaacaagaacaaggaagaatacaactaaaattgtagatgaatgattaagctcacaagttggtgtcttacaaaccgatctagtggcgaaagtgttcttaacagaataatctaagaaaaacctaaaccctaaaggtgacggctggtactgatatatagagtttacggtcgtgcaaacaacccttgatgcaaccctaatgggttccaatacgatacacggcccaaatgcccaaatacggtgacgcagcaccgggacagattcttgacgtcaaattgttcggtcgattcctgttgacttggaaagaatttggacgtgggactagaaccattggaaatattatcttcttagctttccagccatataaagaacgccataatccgagcatgtatgcgatctgggtgcccgttttagtgcagagggtcctggactccgaatcgtactcgaagtcgacttggtttgggcctccatcttgacttggacgtccttgatgatcctccgcgcctctaagtccctctctaagggtgtgttcgctggttcatgttcccatccggaacaatagacacggaaaacagagcggtccattagcgcgtgattaattaaatattagctattttttttaaaaatggattaatttgatttttttaaagcaactttcgtatagaaactttttgtaaaaaacgcaccgtttaacagtttgaaaagcgtgcgcgcgaaaaacgagggagatgggttgagaaaaaggggttgcaaacacaccctaagtgtctctttgtcctctccatgattcctataattattaggtagcaatatattctcaaaatcatacaaagaagaataggaacgagcttacctctaaattcaattgtctcgcgcgagctcttgttattggtccttgaatgaccggtggaggattgttgtgtgtatccgaaggagtgatgtccttatcatcctccctctcttgaattagagtcgtcctcgactcaagtacatcttcttctctcaagtatggttttaaatctaaatgttaaaagtgggactaaccccaaactcaggaagcaattcaagtttatatgcattatcattaacctcctcaataattttgaaaggaccatcagctctaggcattaacttagacattctaaaatctgaaaattgatcctttcgcaagtgtaaccaaactaaatcacccggttcaaacttcacttcttgcttacctttactaccagcaattaattctatactttttagtcatcttttcaatgatctcatgtattttcaaaataaattcagcatgtgccttagtttcagtgtgaaccctctcactagtaggtaaagactaaactgctccatggcctgtccctaatcctgttacgttcaacgcatcaaaaacatcaattttgatttgatgccacctctcgatcagttctgtttcttgttttggtatttaaagaaaaacaccgcctgatcttaccaagcctcctccctctacttatggatggaagtgtgcaatctggttacccaagtaaaaaccagcttagtagtttagacgtgttagtataaagcccaatgtgaaatttgtataattgacatcccactgtgcctgatgtgcctatttgtatcattgcttcctttggaatcctctaataatccattatgtttttttatggtaaagagtggacgatatggtcttatattgtggacacgtaaaatattatgagaaattatacagtatttgagaaagtatctcaaggtatctaaattttatattaaattttttggtacttcattcgaggatatcaaaattaatttatatatattagaaactatggtatctcctggtatcttttgaaatatgttaaaattaccaaaatagtatactgtgcatacacatataagaataaataaaacaatcaaacagaactagtcagaagaaagggatctacgtgtaaattgattttgaggcaaaatatttatccttggctatttgaacgagcaccacgaatcgaatccatgtctgaaaatgctcttcgaattgtccgatgatggtgtagagttttctaaaaccaagttcttataaacttttacctgcttcatcctaaaaagcatagattatgtttcctggtatcagttaggcatgggatgcatacaggattcatccaaaaaggaattgatggttcgcagtgttttgtagtttgcacttccttgtcagctggagctagcagtgatgcccagcaatttgcgatacatatgtttcgctttgatattatgcgaagagctagctatcgcttataggttcgagtttttgtcacaaactgatcaaagaccgcaaaacagctaacatgtatattttagctttcagatctgttatatctgaaaaggaataactctccccccgcgtcgccgccgcgcctccgtcgccgctccccctcccccctccccctacctcgccgccgccggagctctcctttgccggctggcgagctaggatggcggcggcggggccttcttcgcggcggcgtcccttctaaggcgcggtggaggagacgttcgccggcgtcggggagtggtggcggcgaggcctctgggctaggcagtggcagatccggcgccgccgtcgccggatctggccagcctctccggttttcggccggagtactggcggcggcgccgtggggcggcgtgtgcggaggcggcaaggttggcggcggccggtgcgcgcgtggcggcgcgaggcggcgaagtccagcgcgcgcgtgggtggtccggtgcgcgcgtggtggcgcggaggacggcgcttgcgaggcggcatggcgacatctgctggctcccgatcggcgaggcgcgtcgctgggggcgtcggctacactggctcgccagccgccccccatcgccacacctacccctccggtgtcgacagtagccacaaccaccctcccctctcttggcttcttcctctttgcaagcagaagggggtgtccgccacccttgtctcccttcttctcgcttcctccctggcagctctgctgcctagttgtttagttgctttgcttcttacaccagtgctcctctctctgtgctagtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggcatgagacaactagatcgtcagatctataatacacatggtggattcaaatccccaaacaggagtagggtattacctctcatcgagggggcctgaacctatctaaatccttgtctccgcatccatccacttttaggtctcgtgcgctacccttttattattgctgaattcatgtttcgacagttggcgcgccaggtaggggtgcgtcaagttttccgtcaagaagtgtgatggaatcaagatcaggagtggccggattttccttcaccccgaaggctggctttcggttttgacggattcgtcttctttgatggtgactccaacaatctctccctcttcgacttgggttttaaccagtcgagagaacggcgatcaaagatttacgtcatcaagttggaggcttcaatcgtcggggtcaccgatatctcctgtgcatctccacaaagatctctgcttcaggagctacactttgtggttacaagaataaccaggttcgtcgttccaatctactaatcgttattagattggtctctgatataactactaattaaattaatctatgccttgcatgtactgttgctggttctgacctccgagtctttcgatcattgtcacgggagatcaagacatcagctcactgagcacacatctctatatgggtagatcgtattgatcttataccaggcgtacaatagaagtccagactcggatttagctgattggatcattctcggactcggctgactactggatgatcaggtcaaaacaaaaatacactcggcatgcaaggaaagcactgggaatgtggtcggcacgagccccaacacttaccagtaccccagctctgggaaaagcaacgaacgctatgcatttgatcaattccagagctattggttttgcatctacatcccagaagaattgccaggcatacacatcgttaattggttgtcatgagctatcctcaataagggacaccaattaatatttccatccagctcatacgcatgtgagcatatatggctaccttgccaactaatcagatcaggagtcctagcaccatactcctacgtgaggatatatgatatattggctgacatcatcaggagatattatctcggactccatcaaaacatgctccggttttcccttcaagcactcctctgacatcatgagcttgagttataaaccactaccggatcagtacaacatggcgttgagtctggaagggcctatgtcttcgttattaccgctggcttgcctccgtcgtcgccgactagtgttctcgcctatacggttggttgatcacaccaccgttgatgggcatcttcgtcttcaccgactggtcaccttcgtcgccgccgattgatgtctttgccttcatgactggcttatttcatcgccattgacggatgacttcgttcctatatcggtcatctctccgtcaccaaggagaatattacaaagctaagtcatcattaattttcttctttatatgatatttttcttttcctctaactcactacatcaattggttcgccattgactagtgagtcgggggctagagatgctatgtcatattttttcaacaattttcataatatttatcttgattgcttgcgacataatctgagtacaaaagtgactatcgagttatggagttctatcttcctatgctttccgtttggtttgtcgatggatagttgcctttgggccgattcctagcacccgggggctcgttggatggaccgagtaacgcaagatgctaagtattatattcggaataaatcaaaagcatagagataagataaatttatttattttcttctcttaacaattgcaaaaatacccgagtagtaaattttgattcgtgaaactttgttccattaatgacgaactcatgtcactcatatgcatgtttgggaagtgcctaggccgactcccggtgcttggtggctatgactagtcaggcagagtgtttaaacgtaatgagtcatctgctcggggaaatcaaaattgacgagaggagaaatacatatttataaacacttttaatacttgaatctttctcaagtactgtatttacatcagatactactcatcctatatatttgttctgcaggatccagatccagatatgcatcaaagggattcatggctttaagcttatctcctatgttacaggaatggatcagtcagaacatcaccaccggcttgccgtcgtcgccgccgactggtgtcctcacctatacggttgggtagtcacaccgccgttgttgggcgtcgttttcttcactgaccggctgcctcgtccgccgtcgactggtgttttcgcctatatgattgggtggtcacaccgccgttgttgggcgccgttttcttcaccgactggctgcctcgtccgccgtcgactggtgttttcgcctatacggttggttggtcacaccaccgtttgttgggcgtctacgtcttcaccgaccggcttgccttcgccgccgccgactggtgtctccacctgcacgactggcctattatgccgtcgtttgttgggcgtctacgtcttcaccgaccggcttgccttcgtcgccaccgactggtgtctcagcctgcacggctgacctattatgccgccgtttgttgggcgtctacgtcttcaccgaccggcttgccttcgccgccgccgactggtgtctccacctgcacggctagcctattatgccaccgtttgttgggcgtctatgtcttcaccgaccggcttgccttcgccaccgctgactggtgtctccgcctgcacggctggtctattatgccgccatttgttgggcgtctacgtcttcaccgaccggcttgccttcgtcgccgccgactggtgtctccgcctgcatggctggcctattatgccgccgttgttgggtgtctacgtcttcaccgccggctcgccttcgccgccgccgactggtgtcttcgcctgcacggttggtttattatgccgccattgtaggacgtctacatcttctccgactggccacctcatatgacgccaactggtgctatcgtcttcacggttggccacgtcgccaccaccgcaaacaggcatcatcaccttcaacgcaagctgtctacgtctgctgccgactggtttctttacttccatggctacatgattctgccagtgttgattggccttatcgtcttcaccgccggtcatctcgtctgctactgactagtgcccttgcctctacggttgatttataccgctaccactactgatggacgtcctcatcttcattgctggtcgccttgtctaacgccgactggcttgttcgcctccacggctgcgcgtcttcatcgtcattgactggcgtcatcgtcatcgccggtttgctttcaccgccgcccattgtgacttcaccttcatggctggcctattttaccaccgttaaagaacatctccgttttcgtcattattctacttcttccgtcgccaactggttctgtcgccgccgactcgtgttcacttcatcacagctatgcaactttgtcaccatggtggagctacttcatcttcattgtcttcggcaccggcaaactctattgccgctacttcgcaagttttgctacttcactagccatgacgtctacaagagcttcgacatctcggtatgcgtcaccaaatatgatgccgtgttattttactacaacaagtggtgctccaatattcaagatttctctccggacatcctcaatacatatcttcactcaagtgatggctactcgacgacaagaagctacagttctcgactctatgttcagttgtttcccaactaatcaaagagttgggggctacacaaatacaagactctcaaaatttgacaagatgaagcaatcaatcaatcaacgagtcaactctgggagttattatcttcgtctgcgcttcagagctggcattttacttcagcgactccaattattacaccggtaggtcaagattaaatttacatgtctgggagtttggagtcatcaaacaatcaactcagatcagattcaatgagttgaacaacagcatatactttcctctaagtaaagcatctgcaacagttatagcaccaagttctactgccatctttataaatcaaggggcgttgcatcagtcttcattatgcacatgcttgcatcaaggaaactattcgagcttcgacatcttctcaacaatttgaaggattattgtcactgacatcatcaacagaacctctacttcatcggccctgacgtctccgctgttgctaaggggtgactacgtattcaccttcggttgcttctgtcatcacctactttcatcgccgacttgttatttcatcttcacggatgacctactatgcaaacgctgatgagcatcttcatcattatcatcagttgctacactgctattgactggatcaccgacatcgtcatcttcatcaatatcctgtcaagcctcttcaacatagcctattctactgctgtttgatgggcaacttcgtcatcatagtcaatcatctatgattgctacttatcatcattactgtcggttgcgtttgtcgtcgccgactattttcttcatcctcatgattggtggatttcgtcatcgcctttgatgcgtgtctacatcttcaccgtcggcttgctttcatcgccaccgaccggtatcctcgccttcatggatggcttattatgtcgccactaatgggcatcttcatcttcttaaccagctgcctcatcagttaccgactgattatttcgctgccatggctacacaactttatcgttgggcgccttcatcttcattgctggctgacctgactgctgtcgactggtttcttcgcctccacggttgtacaacttcatcacttttgattggtatcactatcttcaccaccaccaatatttttgccacctctggtgggcaatattatctctatattggtcgtcttgtctctatgccaactgcgtcagctactatcaatggaccattgtaactacgacaaaaggacaagctatatgatcaggggcttactagctcaaacacaagtattataccttcaatttggacttgttccggatacatgcaacatgaattcatgatcatgggtctattttctatgctcaaagactggactatttattattcccagtaagggttatcaaccgaatacttgcgccagtcgggattcaattattatatctattttggagtatcccataagggataatcactcagattagaagctattcatatgagctacacttggtctatatcacccggaagatttattactcgagagcatgttacatgcgtcatcctttaaagggtgtcgaaggcatattttttggcctaggcctaatatgtctgcagcccatattttcaggtgtgacctgtcacgttcttttagggacttaggcacttttttcttaggtcaaagtgcgcgtgatcaagtgcccaataccttaaaatccttttataccacagttactcaactttttaggagttggtacaatgcatcttaaaaggtgtcgaacagtaaagctttatatagctgtcccgctgacttttttatatagtcaaggtgttgtttgggtttatcaagcaattgattggatacaatatcattgctttttgtcacgtaagtgtgcatttttatttaccaatattatggcttaggctgattatatattttggtcattttccaggcggttggtaaatcctttatgagtttatttactcggatgttacactacatatgccatatatttccatgtgtggtgaaaccatgtgtcttttagggacttaagcacatctgttaaagcagtgtgcgcatggtgtgtgcccaatactttggaaatttctttattcacaacatacaagcttctttataactattttgctatgtgaattttcaatgatgtagtcaactttaggttgcacgcatcatattctacaaagcagtcggtatatcacttggatcatgttatttagggattcacaccgtatatgctatcaagtcacttagttgactataattatcaagaatcactcagttggttggattatttactctttgactatatgttcagtttgctcaactaaccacatagtcgggggctacacctattaggtgcatctagtcgatgcacctaaaatttcatttaattatttttcagccctccacagtcttctgatttggtaaaagtactcgggagaccatggcgaagatgattgaagcacttatctttggagtaatctagttcgagaaaagattatcttttcgactgtgaaggtctcaggggctactgtgaagattgtgggtaccccatacccatacggcatagttatccgactggttataggggataacttatatctatgaaatatgtaacggatcatgacttgggtattatgtttccctctatattatggaacggcctaaagtcctggtttgataagattgtaaagtagatttaggaaaccgataccgtattggttaaggtttctatcttgtaatcatggcccccatcctatataaggtgggcaggaggccctctagggggcatgagacaactagatcgtcagatctataatatacatggcggattcaaatccccaaacagaagtagggtattacctctcaacgagggggcctgaacctgtctaaatccttgtctctgcatccatccacttttaggtctcgtgcgctacccccttttattattgccgaattcatgtttcgacaagcgctgttgacaacatttaacacgcatgatcaggcaggactacagcttctccattgcttgtccctaatcacttcacagtggcacgagaaggaaaggtgaaaccaacatctgtggcttggtaagggatgaaaacggtcagaaacggtcggaaaaaccctataccatttccattttcattttattttctcgaaaatggaatcggaacggtctactcggaaacagtaacgatatcagtaatgtcggtatatctgaaacggaatcgtcggaacgggaatctaccgatatcggtcggaagtcaaaaattcatgtcggaaacaacgaactgtggtatcatcccacatttaactatgtatgaagatgaccttataatttcacccttgcatcatcacgctgccacacaacaccgttatacgatgattaataagttgacaataaggtcgacaaacaatataaaaagttcaacgatatttcaacatcaatatggctaaagcatacaatgtggtaactaccattgtaattaagttttttgttgacactatataactaccattgtaattaagcttcatgctaaactagactttttggtagtttccaggtaagggggtcacggagaagagtcaagatagtggggcccgccggtgggtcccactgtctttgtttttctctctttcttttcttttctctctctcttatccttctcttctctcggttccttctcctgctctctcaatttcttctctgttttctcacccgttctcttctctgccttcggctccttcacgcgcgcccgagaggagagaggcgccggagatggcggcctggcgcagcgcggcggtgggggaaggagagagaggagaaaggggcggtgccggtggggaagaggaggccggggcggtgcggcggtgctcggcacgacgtcgctcggcgcttggcgcggtggcgcttggctcggcggcacagaggccggcagtggaggatgggggaggaaaagagggccggcagcgacggaggccatcggggcgaaggaggctgcgacccgcgtcagcgatgtcgactgctttagtctcttaatgcctaatgggctgctcctgctcctgctagccaggcccagtcggctttcttcttcggaattttgttggaaatttgacggaaattaccgataaaaaacggttaccgacaaaacggtcggaaaaaaccccatatcatttccgctaccatttccgaaaagcgattaccgtttccatttccgataccgactgaaacggtcggcgcaaaccggaaacggtagccggaattctcggaaatttccgtaccgttttcacccttactggcaacgctttttttttaaaggcaacaagacgaaacaggagctgatggcgacgtcgaaggcggagagcatcgagtactagagtattggaggggtaccaggaacccggtcaagaaattttttttaagctatatctcacttattttcattatgtgtgtatcccactcaatacaaatttagacacccgcatcaggttaaacttaatctaaagagagtaaattaagcaagtgtcacccttctctattttattttagctctgcccccgtctgattgtacgcattgacgacgtacactgtcctgtagtatcatatggcatgacaggacctacaagattataaattaagtagataaattatgcataatatcacggtgacggtgggaagacaatccataaaaatattcctgtaaaaacgatcagaaaaatgtacattttcgaatttttacatttcagtttataattaatatgttgcacatttactttcaatactttggaattcctttgttgcctagaacctcaatcgaacaccttgcgggtgaatgtagttgtcctgcaatggcaaagaacaaagggaaataaaatgtggaatgacactcaatctggaaattggggctaacctggtgtgtttcttattgcttagataacaggatacaaaagtttagaagaaaacttcttctatttatatacaagtatactatgcgatccgggttctcgggactcccgttcacttgctctatggcgattgcagctggatttttcacattttggtccttttaaaaaaattatttcacaaatagacctctaaaaaaacttataccagaaatggtcctttttgggcgccagaatggctggcgccgtcatccaacgggacggcggctggcgccgtcctcctgccaccgtggcgcacgtgaaccgacgtggcaggaggagggcgccggccatgctggcgcggccggctgcattccgtgttctctggggagcactggcaaacagataatttttattttattttttcggatgttttttcacactcaggatcacaatacaaccaaccacaaaaaaaatttaaactagaactaccacttagctaagtctgaaaatatctagcataccacttagtct

SEQ ID NO: 26363 - DNA, 1997 bp, Oryza sativa
ccaactgtataaaaaataaactcaaacggacaaaatatgttacatatagaattttccaaaactctaccgaaacggacaaaatatgtcatctattaaaataggcgtaactttctcatacggactcggaatcagacaaataatatatgcatggacatctacagaaaaagttacatccgattctcccaagcttcgccaggttcggcgatattaaaacctccaaattccgcttgtaagattgtgttttcgaggagagaagtttttcggtagagctttggaaaattgcacatgccacatatttcgtccgtttgagtttattttttacatgattggttcatgtgagttcctaagtgtgaaaaaaatatcaaaaaaataaaataaaaataaaaaagttgcacatctctttcctctgcactagttcagagagagaggagaggagaggaaaaattctacatgtcacatattacgtccatttgagttcaattttttttatgtttggttcttgtgtgtctctaagcgtgaaaaaaatatcaaacaaataaaacaaaaataaaaaatttaggggggtgggcgtcagccactctggcgcactccccctagccacctcagcatcgccccgcaacgtcggcaggggggcgccccaaaaaggaccatttttaggataagtttttctagggatctatttacgaaataagtttttcaaaaggaccaaaatgctgatccttgcactgattattctgcaataatccgtccactacaacacacatgaccttttgcgaagaatttttcctgacatcgaagctatttataattatgtcattcagttttatttcgctctctatgggatagtgtaacttagcgacaaaaataaggggttcatcaatgagacgaactacaaatcgtcgtaacctagtctagtggcaatattattgtgacgagtgttattttgtcgtaagaggccaaccaacaaacgtcacaagctcatgacaacgttgatttatcataagtttttttttctaaatattttttttaaaaaataaaagtatagagcaggtcccctttagatttcacacgtgaatacgtgataggaaaaagtccactttgactcccttaattgtatgccgaatttaattcgtacctctcaaccagaaaaccggatagaacgactccccgaactattgaaccggtgcaatttgactccctcagcggtattggagggcggttttgctgacgtggcgctaacgtggcggtgttgacccggtcttcgtcccacatggcgcttaagtggcattagaattaaaaaaaattatgggacccatctgtcattcacacaaaaaatatattgtaggacccactgacatatggggcccaaatgtcatcctctctctccaatccttcttcctcctcccttcctctctctctctcccctttctctcccccttccccatctgcggccgaggacgctggagacgagagcggcggcggcgggcgagcgagggcgtagacgatgaggaaggcgaagaggaggttggcggctacgcccgcggagacgacgaggaggcggtcggggacggggcagttgcagaggaggtccgggtcgtcgggcgcgaagccggagtctgggtcgtcatcggggaggtggcggcaaggaagtggcccgactcgtgacgaggacgatggtggcgaggacggaggcggcggtggcaacggactggacgctggcgaggaggtcggacggggcggcggagatggagatgggcctggaggaggaggaggaggggtggaaggggaggtgttgcccgcgtcgctcgccgccgtctccgcttccccaacatgtcgtccccaccgctgcagaggccgacagatacggccgcgccctcgcccgcaccggccaccgccacctccccccagccgctccctcgtgccttcctcgttgccgcggcctcctcgccccaccgcgaccccgtatccccgacatgtcgtccccaccgctgatgcgg

SEQ ID NO: 26364 - DNA, 3174 bp, Oryza sativa
ggtcagcctgggcatggcggcggtggtggggacggtggcgtgggcggcggacgcgccgtgcctgccgctgctggtggggctgttcgccacgatgggcgtgtccatgtgcagtgtcacgcgcttcttcttcctccgcgagtccgccgccgcgctccggggcggcaggccgaccttctcctcctccaacaccgtcccgctgctcagcctcaactggttcctcctcggcatcctcacctcccccatgcttcccggcgctgcccacgccattgtttccgccgctaatctcagctcccatcgccgccgccgcttcagttcccaccggccgccgagcggcggcggccggtcgaaggggagaaaaggggagagaaagagggtaggaaggaagatgggaggaagaagaaaaagagagagaggatgataggtgggcccacatgtcagtggggctcacatgtcagtgggccccacaactttttatgcgtgtgaatgataaataggttcacatatacgtttttaattcaattgctaactaaatgccatgtcaacccatagagtaggtcaaccctgccacgtcagcatcaccacgtcagcgaaatcgtcctccaaaaccaacaagttagtcaaatatattgtaccggtttcaatagttttacggtttaggatcatggaataaattcgggccacttttaagggagtcaaagtgaatttattcctacatcttccgaagtgggctgctagcccgttagtggcctgcaacagaaggcgtttcgtgcggactccagcacagcccatgctagaaaaattggagaaaaatatacagcatatcatattatttagggatttaggcgtgtattaagagtcattttcccgacatatacttatgcatacacaatatttacctgctcatctaatcattgatttttagctaataacactaattagttattttcattgtttatttcaattttaagggtgtattgatataatgatatgttataatcatttttcacacatctacttaagcatgcaaaatatttagctgcccatctacttattgatttttaaagctaaataaaattaatgaacaagtaaattgcatagtcagtacacctttacgaggtacgtacatttacctgtcagttgtttgttttggtgcataaacgtgtttgatttgtataaaccaaagcccatgtcataactaattgcactaagttgtgtataacttctatagaatatgaaactaaaatgaaatcaatatggagtaatggaaaaacaaaataaatgcaatgtgtatataaaaaggttaaagtaaacttcactttcgacaacattttattaccggtgtttagctttgaaccaccatttaaccaatgttttcactttggactgggttagtatacctttgtgacactttggatcatcctcaactctattatttgtgtacatccaatttgtcatatgttgaagaaacagtctacaacatagggagtttattgatgaataggagccagcgtacaggactgtcgttcatatgcttgagaagacagtcggggtggttcaaagtaccacaaaagtatatatcggatatcggtactcctacaacagggcagaaaggaccccccctcctccccccattggagatttagcaaggggccgaacagagttcgagtttgtttaccgcgaaaatgtaaaaatgaacacaagcgagtatatagcttcaggccgctcggaagcgtaacaccctactcccgtgtttgagactatgtggatgccaaagtgtacaatacaagcttgtgaagtgaactagggtttctgttctacctagggtttccttttttcccctgaaaatctctttttctagtggcatgacccctccttttataacccaagggatctacagcgtcgttatgtagagcacccaaaaaatatatagtctaatgtttaatgcgaccatcacattattttgggtgagtgggatccaaacatgcataatagtcactcaagcctcaatgtgccctatgatcacaattaaacaccattcaatataatctatgtagtgctaaatagtaagcaaaagagatatttctacttcctccgtcccaaaatatacctatttttaagattggcacgggtattaagaaagcatgtgagaatgattggaggaagtgtgtgattggttgaaaatagaaagtaggtgaagaagaatggttgtgattggttgagaggaggtaggtgaagaaatagtttcattttggaacaaggcactatgctagaaatagctacatttttgggacggaggtagtaaaacttagcgtgccggtcaacttcagtctgagacatgcccgttaaccattcgaaggtggcaaccagatgtgttacacatactaggagacttgacttaatttgctaagttctagaatatctatgttgttcaacaatccacactcatgtctagatattctataagcatagaacataccaaggcactttcatcaaaacaaatggcatccataaacaaggagttataaaaaattgataatttagagtctaagtttaagaaacatacggtcgaccggccttataattagtggttcacacggaagtttatctaccaaagacccataagcaagccaactaggggtagaccactaatgaaccgtcctgaagagatcaacggaacgcgctgcactcaactacctgcaacacaactaaaatataccacaaagaaacaagtgtcaatacattaacacgtttaatgtactggcaaggcaatacaatcctaaatacatacaagctctaaataccaaggaatggctatttatggtctcataattgcattaagctgaaataatttcacaaacattttgcaacagaattttaaataagcatttgcaagacttagtatagttatcatggtatagcatcatattagtgacatattaccatcatattcatcatcataatacaagtagcatgcttgctaccctcctcagcagcaagtcaatcatacacaagtatcatcatcaacatcattttaaatatcactttcaaaagcatttataaaacacaaaatctatgccaatgaccacactatgtcgcgcataaacatgagcacggctaatcgattagtttttgttgatgcgagaaacaaaaggcttgggagatttgtttaactcc

SEQ ID NO: 26365 - DNA, 3628 bp, Oryza sativa
cgatctccgtcttggattccgcttcggttttatcttcatctccgatacttgaattaccaaatttggttgttaacagttttacactttacaaagtttgtacaacgttaactacataatgtgagtactctaatttgtccggtacccattggtaccacaacactctacgtgttgaatgcggtctagaagttacaacgtaacctttacattactcaaagcctagctttgcactggaacgacaagtgtgaatgacctagagctattaggtggctggcccacgccttaaacctaacgatatgacgtcaaacacatatgtttccccatgagggactataccattatattggataaacatagttgcctggattacccttagcgggcaaatagttagctcctcttaatcaccactaaaactaattcatactactccggcctaccaaaatataaggttagaccctaaataacttaatcaactaagtctatcccataactagcacatgtggatgtacggtaaacaatagtgggtgacacaaagttcggttcttaatcgactcaggcgaacactcctgctatcagtgcacaactaacaccatttctgcatcacttatcgtccaagtctaaattcactatttgttcttaaggcaattattgcgacgagcaaaactgagtttaaaaataattgcaaagctcgcaacatgatttacttgaagtatcattattccacattagtagaatacatgaatcaatgtttaaggtcgtttttacgagtagtacagtactgtcggtagagaccatgtgaaagcactcaaattactaattgtactgctgcagtaaagcataaacactgttatggagtttgggcttgcgcaaattacaattacagtacactcttctgagaaaacagaaattgattctacctgaacaaggcacatcaggtttgtccagggcatactaccttagggccctttcaatcaaagaaattatgaaggaatttcataggatttcataggattgaaatcctatagaaaattttcctatacggccctttgattcaaaggattaaagttttccaaatcctacaaaattctgatggaatgactttttgcgtataggttttggaggaaacttagtaagaggtccaacctcttggtaaaaatcctttgagtctatctctcttatccgattcctgtgtttccctatggtccaatcaaacgatcatttctatgttttttctgtattttgtaatcctctgttttacccttacattcctatcagaatattatgtttttcctatttctccttttttttcattcctatggttaaaaagagcccttagcttgttcgcttgctgaagctttgacccggagatatcgatttcttaactgtatgcacattttttttaaagaatagagaatcaaatattgaaggaattcttgaaaggagattggatgtatgacattggctcaaagagtcgatgtcagaatgatagatcgagacaattaatattaaattcaagcaaggaaacttttacccaaatagtatcaattaagtggtcagccaaaggagaaatgtactagctagcaaaaataaaagaacaaaatctaattaattagttaaatccgaagtgcacgtcagattcagacaagaaatctcttgcgctttttggcatatctttcttggcgtctgatattaagttttgtgcatctggtttgcaccgtgaacacgtcggcgctcagttgaaatttgcaacatgcatgcatatccaactgtttgctagctagaacaggagatgccacataagagcacgatgtgatgccacgtaggtaataactggtcaccatcttgactgacttgaaacaattttggcagaaaagggtgcatcgagaaaatctttgaaaataataaagtgcacgatatttgacagtcctagtacttcgtaataaggccccgttagataatgatgaagaaaaagactagggctatgtttagttcatgctgaaatttggaaatttggttgaaattggtacgatgtgatagaaaagttatgtgtgtataaaagatttgatgtaatggaaaattgaaagtttggaaaaaaaaactttggaactaaacagggcctaggtacgaatacctaaaacaacaaagccaaaccaatgattaattaagttttttttacgaaatacaccatttaacagtttaaaaaacatactggtaaaatttatatcctaataaaaacgaacggggcctaagaccacaaatcacatttgtgcacagttgattagcatcacaaatcagttccatgagaaggagagaacatataaatactattgtacctccaccctaaaattttagttgtaatttttagctatgaatacggacaagtgaactaaaaattgttatattttataattttgagacgggtatagcaccagttataaacatttggcatttagactaaatttggttctaattttgaaacatttgaagtttaaatgtttgaccgaatcgcgtataagtaaatgtgaaacttacagccaaatatcatctcgagttcctacaattatgacacgacgagagtacagtaatattagtaaatgttggctaaaattatcctgttcatgatcgataatattgaactaccgaaaatctgaccatttacccttataaaaacatattattgtaagattagacccgttaaatgttttaaaaaataagccctgattttagcaccatccattctagcgcagaggtctaacacgttatagcaatccacaccgccgctatccacaacaccactaccccaccgcgatggcaaatgagatttgaggtgacacactgagttaacgagaaggttagcaccattgcccttagccctgacctctaatgccttaaagtagtggatccactacttaaagagtcagtgggtgagagcatctataatgtgccataaaatggatcataaggccacacatgcacaccaacaccagatatggtgagagtggttatagggtatggtgggcctaatcttaaattaggaattttacatctagatgtgtaacccatcttcatatatattcttgtcttaagcattgtggcaatgataccttatttttacataggatatggtgggatcatacatttttccagtccaaaacattactgccatgaagcaagactacattactggagaactgatcattactcggatgccaaaagatcatatttgtcttggttcgaatagaaaggttcaacagctgtcaggcccccaacgatctaccacccgagactaaagatcaatttttaaagcccgattggtgatatcaaccgagactaaaagatgatctttagccccaggaaaaaaattgatttttaagtccgggttgatgctagatggagtatctttagtcccgggataaaaaaaaaatcgatctttagtgtgtagcaggtggaatggtaacgtgcgtgagggctgaggtgagagatcttgagtttaaatctcacatcccacacatttttttaacttggtatgcatatttagtccctgttagacatctttagtctcggatcatgtgtcccggttgcacaaccgggactaaagttcctttctccatcagtgcagcaactacacaaa

SEQ ID NO: 26366 - DNA, 36107 bp, Oryza sativa
tgcccaaacccagcttcacctcgctaattcatttgtgagagagctccacccactccactcccattttaggtggagctgaaactgtttggctacgctctagctccaagagaggtggagctggagctgtgtcaaatagacccttaactcctgaagctaaatttaggagttagaactttaccaaatgggtcctaattaagatcgagtggttatgtacttgacttgctattcgacattatttataaaatatatgctatacaatacttcctctgtctcataatataaggcactttaggtggatttagtatatcctagtagaataaatctagataaacaattcatttatattagaacgtatattattggacgaagagaataacataccaggcttcggagtgtcagaacttagacgcgcgcttatcctcttgcgttttttgaccgtagaaaacatttgacgcgtgtgctcatgaaaattgatacaaatggtctgccgttgtacacgtcgactcagctgaaatttgataaacacgtaagaattaaattactagtaaaaaattgccacgtagctttcagctggtgcataagatggtccgcgcggcggatccaccttccgggcaaggtcaggcggccgccgcctggcttcaccgttcctgtcacctctatgatcaatagctatcgacatccataaaaattaatcgatcattcaaaaataatactccctcctgttttttatatgacactggttagtttaaacattaactagtcagcgtcctacaaattaaaaaatagaggtagcattagtcctctgagcttgatggtgataccagcttcatcacagaagaccgtaattctaacattaataacattcaaagcaaataaacaaaccatataagaattagacaatacattaatggcacacatttttttacacatagatttataggtatgactgactaaagaacaggtcccatgtactcaacagctaaggatttttagccgctaatagaccaatgagtacaaaaattagataatatgtgactagtaatagagtaaaatctgtcgggtatcagttcatatcgcccattaccatctctatatgttacggtatatcttcactgatttaaaagggtatcactcggattagtactatatatgttttaaatttttttctctaattaattagttcaagattaattaagtttatataaaaatttaaccacacgcttataacaccaaattagttttaaaggatcttgttttgtattgaatacgtctactatttttttttataaacttgattaaattaaatttaagaagttagctaggaaaagtcaatgtataatagggagtaattaacaaagacaaaagtgagtctgacagtatcgaaaaggaataaagtgcaagatacattgattatcctaatagttaccctctgtactagcgcacactcgccaccatcgatcgaccagcatcaaaaaccattggcacgagaaggagagaaacacttgactttattcccctcattttgacatggctagcggcgccggaggcggcacggcggcgacggagaggctcatccgcagcgcgcagaagtcgaccaaccagctcaaggcgatgctagcgggaggcggcggcggcggagggaggagctccggcgccgtggaggtgatcctggcggacatctccgactcgctgtctcaggcgctcgcgtctctcatgctccgcgcggcgtgcgacgaccagtcgctcccggcggcggcggccgccgccgccgccggaggcgagcttgttgccgtcctatgggcagtgtgtggtggcgaacagcggcggccggtcagtctcgaagaggaaagctcacggagaaggtataaattaattatatatcttgtggtcttcattaagtttgattgctgtgtctgcaaattctgtttatgtctcttccgatttgacatttcagatgtcgagggaggatactgaaaaggtcttttttttttcctctagattttctccggaaaaggaaatggttgtgtatttggatttggagagggttagagcatctctagcagtagcccctactttcgagtccctaaaagttaaatgggggctgccctcaatgttctagaccctaaatatgtctttatgtctagtagtagcctccatatcttagcccctattttttttctcttttattttattatagaatttatatttatatctagtttaacacatagtaatttaaacataaataattctagcgcatggagttcaaccatattcaaatttgcaatttcaaacaccacgattcaaaattgaattcaaaattttcaaacatggaaatgatatatcctagaagtaaataatgaacataacccacacatgatagaaaatgcaatgaaacaaactaccgagcaccatgaagcgcccacaaatgttccacaagatcatctcgaagttgcttatgtacccgtcggtcttcaatttctttatgtatctttagaaatttttctaacacaggtttattacgtcgttggtattcctccttcctcaacacctcactgtcctcctgatcatagtcaaaatctacatcttcatctcgctcattgtcaatgatcatgttgtgcatgattacacaagctgtcattatgtaccatagggtctctgtatctcaaaatctagcaggacccctcaccattgcaaagcgggcttgtagaacaccaaatgctctttcaacatcctttctcactccttcttgaacttttgcataatgtattctcttgttaccttgtggattagaaatggtcttcacaaaagtggcccaagaagggtatatgccaacagcaagatagtaacccatggtgtatttatttccattcaccataaactccaactctggagctgtccctaatgtaagcctttgaaagagtggtgatctctgtagtacaatgatatcattaagagaacctggtagtccaaagaaggaatgccaaatccacaaatctttagatgcaacagcttcaagaatcatggttggcccatccacatgccctgagtattgtcctttccagcctgttggtcaattcttccacctccaatgcatacagtcaatacaacctagcatccctgggaacccccttggagtgtttatagccatcaaccttgtagtgtcctcagcagttggtgctctcaagtattgatcagcaaacacatccaccacagccttgacaaagtgcttgaaagcttctatcatggtgctctctgaaatcctcacgacttcatcaagactatcggctggaatatcatatgcaagcatgcgaattgcaccatacaccttctgcaatgcagtggcaccgagaagacccactgcatttggtctctgcctgaagtagtcatcatgagcctccacactagccacgatgcgcaagaagagctcccttgacattctgaacctcctcctaaataattttgcactatatacaggaggatctgcaaaataatcagccactatgcgtaaattgccagcaaacctgtccctattaattatctcacgacctgggactgaaccacgatgctttcttttggtcctcttatgctctatgtctgtaagaagagcagctgcaatgtagtagtcatcatcgtcagacaactcctcctgatcccaccaatcggtaatgagatcatcgtcgtcgtagaagtccatgtaaaaaacactgccatcacaagatcataaaattaataagaaaatttagagcatatgcacacatccaactacacatacacggtacagagtataccccatatacagtatgcaacattcaatctatgaaaagcagtggaatcgtactagtacagtaccacttactcctgtatatatatatatggttctaatcgatccattgcaacaattgtacagtgctactaagtataaatacagtgatatattcaccgtgtttagatccagtttttcttcaaacttccaacttttctatcacatcaaaactttcttacacatataaacttctaactttttcatcacatcgtttcaatttcaactaaacttctaattttagtgtgaactaaacacaaccattactagctgagaatttagatttttcttgccgacaaagtccactacaattctccaaaaaaaatattaaaaacaagtcagtctccaccagaaccatctaccaccacatgtccacaggtgtcaagaacagagttattcagaaaattgattagtactctaccactgaacccccgcaccacatgacctacttagagtttctccagaaaaatcaatgggggcaggaggccagcgtgggggcagacggcgtgcaggtggacgacgtgtgtgcgggcagcctcggagggcacgcgacggccggcgtgtggccaggcagatggcgggagatcggcggccgggcatgcgcatggactgccgccgaaggccttgagaacggtgggcaagaaaggtatggaaaagtcttacctttctagggcagtcttgatggaggtgctgggaattcgtcagtactcgccggagaagatctgtcatcgcagccgtgcgggaataacaagaaaatgcgcgaagcaaaattatatccgcgccaaaaaaaatgacgatgggggcgtgctccggagtcccccaggactggggccttggggggaggatttgagggcctcctcactttgggggctgtagtagggtccctgctggatctagtttttttatcttaacactcaaaaattgaataggggctggatttgaggtccctgctggagatgctcttaggattctgttgcccccaaaatctaaattgttcaagattcaattaacatattagaaatgaaccagaaaaaagccccgataatcatcgcctggcagtgctgtcagttgtcacgaatcattaatttgttgtattcagcagtgatgtcatgaaaaattgtcacaattacaaataaatgaatactgaatttgagcttgtgattttgaatgcagcagggcagatggttcatcccgaagaattatactagagcttggagatcgtgacgattcctatccctggaggaagtacgggcagaaggacattcttggcgccaggtttgcaaggtataacacgacaagtctagattgacggtttcagtaaacctttgaagaacgtttggtttgggttgtgaacttgtgatgacttgtgagaaaccttgcaatctccggctgcaatttttttcataaaacgcaacgcaacttttttcgttgaggatcaataggaatctgtgtttttttttgggtcaaaagcaacaaaataaagaataatcataataaattgagcttgaaagtgatctgaagctgtctgtgcttacaggagctactacagatgcgcccagatgttgggctgcacggcgaggaagcaggtgcagcaatccgacgacgacccgtcccggctggagatcacctacatcggcctgcacacctgcggcggcgaccggccgtcgtcgccggctcccaccaaccccgccgacggcccgcgttgcgacgcagcaaccagtagtcaccgtcttctgccgtcagctctgcagcagaagctggaggaacatgtcccggcggcgtcggacgacatgatgatggcctgcacgccgtcgtggctgttcataccctcgccggcgtgctcgcagtcggagcttctgtcggagggggaggttccggagctgcgggtggtgcggcaggagccgtatgatccggtggagctggtggaggagcacaagaagccgagcgacgccgacgaggactccctcgccctccacaactccgtcgtgccggattttatgtagcaaatcgcaggagaaagttcttttggtcggatcgcgatactatgaggtaaagtcagagagacccacacgggggtctaatctttgtgggtcccacatgtcagtaagtgacaatgtccctctgactttacgtcataggagactcatcccttttggtccgctgccgagtgactagtcagcgtgtgtttcatcgtatagtcagctctgagtaatgtgtccaactggacaaaacctactgaaaatctgttgaggtgcattgtaaaatgcctaagatagcatgtatatatccttcaaatggagtgagtacacatatagtgcccctttttcacactatagtctataggcatcttgttgtcattgaacacttgatacaccattgaaaaaataatcaaagatcaaccaaagcacttacgctggatcgaagactaggtaataggttccaccgtaaggaacataagcgatgtcagcaaaacacactcatgcttacgatcaaaatgcactcatgcgcgctcacgctgtctgtggatgcaaaactgaagaactcttaactctgtccaactgttacaataactgaagaacagaggaaacagagtatgagcagagtttggcgctgcataaattaactagcaggttgactgatttcagatcgtatcttccagtcagctgctacatgcatacgaaatccaaagaagaatgcgactagcaaagcaaaatgcaaagttacgaatccaatggaacacttttggcactgaagattatcagctcataatctgacaacaattgagttattcgctgcatacatatatagttggtactccgtatggctgtactaaagtgccttatgatggccaattaataaattgaagatccatgctgttgaccagattttttttgagtcagctaaatgaggggatgttccgttgagagttttataaatttcaaaatccatgctgtatgatccgagaaagagagccaagccaatcatgcaaacttgcaatacctaaaagaacaatgtacatatgtccaggggaacgaaaaacttgtggcaaaagatcgcaaattggacaaactgaatgaagaccattttattttcctacagaagaaaaagaaaacagaactaaatcgatcctgctcaggtcaggggtgagcaaccaaagtggctatcaatctgattaacagcaacaacagcatattacataaatctcttattcagttattctaacaagaacatataagagagaaccatgcatgacagaacgcactccccgtactaaaagcattaaacttttagccatttttaactacgaactttccacgttggttcatgatcagaaaattattttcttagtttaagaagtagggtgtactttgtttgctagaagaggaattaattctttgtgacaatatatttacagtttaaacaccttgttttgcaggtaaatacagtgaacaagaagtagaatcaaatattgatcaaaagttgttcctgcaacgagacgtggttagattatcaaattaatgttggctaattctcaacaagacaagaatagattaaactgacgcaggcacatgttctgatctgtgaaacaaaccgaccacatagtaggaatgaagacttgacttgtactaaaataatgctaaatatttgacaccgagctgtcaccatgatgctcatgatggataagataggccatatactacataagctgtgattaattagtgagatgctaactggtcacctgtcaccgtcttgacccgacttcaagaagttgttaattcaacaaagtgaattcgatttggcagtcttgaaaaggaataaagtgcgtatatgatatgcatttgaagatgagcctatgacggagctcacaatttagattagtagttctcgtatcctcacattagtttctttacattacctaaaattcttgttccgacctgtcactctcagaggagggtcctcttaggatcttttttaaccttgtttgtaaaaactttggtccctctctcttctccttatatgaaataggcagagcttctgcttttaccctaaaaaaatgatatgcatttgaagtatctctttcgtagatatttgagtatcctagtcctttacccttgaaagcacacacttgcatgattagtcagtgagacttagtatcacaaatcagcagcacaagaggaagagagaacacataaatttctcattgtgagatggctggcggcggccggggcggcggcgcggcggcgacggtaaagcacatcctcaaggcgcagaagtcgaccaaccagctcaagatgatggtggccaacctgctgccgccggcgccggcaccggtgatggtgaaaggcggcggagcggggagctctgcaggcgtcatggaggtggaggtggaggtgatcctgtcggacatcgccgactcgctgccgctagaggcacctggaccgctacttatataggggaaggggtccgtattacaaaatactgtccatatccctaacagaatatatagttacagataaaatacaatcgtaactgactaggatctcaaatatttccttgatacacaagtttagaatttaacccgagtcttcctaaagatattctatctatacatggcaccccatacccagtcggactatacatgccgtgtagatatggggtatccataatctccacagtagcccctgagacctttgcagtcgacgaaataaccttttctcttagcgtaaaatgataatccgagtgcttcaatttcttctgcatcgatctcccgagtaccaaaatcaaagactgcgaagggctgaaaaatataaataaccaggtgcatcggctagatgcacctaattaggtgtagcccccgaatatgtgattagttaaaaactaaacatatagttaaggaacaaatatcatccaatccgagtagttatgtagctcagcagatatgacgttcagcaaaacatccaaccgactgctttagctttaatataccaagaaagaagatataaagaaacctgagtgaaaaacacttcaaaaggtctacaaatgaccatatttgataagaatccgagtaaaaactcttaagatgatccaccaaatatgatagaaatcatggcaattaatgagtctaaatagcctaggctatgacccacgccataataaaaaataagcatataacatgccgagagaatgaccattaaaaaaccagtcatctcaaccaaacccaaacagcttttgcagcttaaaaaagcttacaaaagtagtataatacctttctgtagggtacctttttatttgcatcgtagtaattccaaggaattatctaactacatcaaaaaggaatttaacagcatcgggccatattgtggtgagcaaaaattgccgaaacaaaaaatgcctaagtccctacggatcaccacttagccacgccgattagcaaaattgggctgaagtactattttaggcccaggcccattagtacttccgataccctaataacaccaaagagaaacagaatgtctcttcgtcttcctcaccgagactctcgccactttccccatttcccgctacagtgcaaaggctgctccggcgaaactagggttaaccgattcgctcaaatccaccttccaaaattccacagaaatcatccgtgcacccaccgcatcaatctccccttcattctcaaccgcatttcagaccaaatctcgccatctagttcgcatccatggcggaagaaagagaaagctttgagaaccagtgggcgccttccgatgtaacggaggagaatctgaaggagatggtggcgcatggcgttcttccggcgaaggagatcatcggatggcgtccagcatttggggaagcatttccaacctccgatacacacgagacggtggtattttctctcttcttttatggtggattttcccttccaacttcaagtttcttccggggcatcttggatttttacggcatcagcttacatcacctaaatcccaattccatagtccacatcgccaacttcattcatgcattttgcgctttttcaccgcatgttcttcctcaagccccagccgaataagagcaaaccatgcgtagttggtggagccggatttcagttgaggggaactttgggacaaaaatacttctctatgctcttcaagacttcaaacaaaggatggcatgccaactggttttatgtacaaaacctcgagccagctcttcccgagtactcctgtctccctccagtatatcaagacacttggaattcactcccaatgggagacgaggccgcccaggtgcttactctaatggactgcatgctgaaactgaaagagcaaggtctgcaaggagagcaaatcactcggcacttcatcaagacccggttagccccaatcaaggagagatcccgcactgcatgatcccaaccgagaggacccagaggctcttgaatacaagattatgcaggagagaatgtataaaatcttctctaatgccattgtagtcagttactctcatgcactaccagtggtgccgtacaacgctttcaaccctccttctccggtatgtatcactcgtctcagcctttacaagttacatcctttggtcttctttaaaagtaattgaaaatgtgaatcatcatgcacaggaattcaccttgataaagtctgatcctccaactgttcaacgacgctcatcacgccaaccgactggtcaagctagtggggggccaaaaaatcggtcggttgtacaacccggcccctcaagatgaaccactcagtcagactctcggaagaggaaatcagtgctgaccgacgatgagggtcatgacgccaaaaaatccggcagcaaaaaggaaggagctgagagacagccaaagctggctaactgtagcgcccgttccgtcgtggcgcctagcgggaaaactatctcttaaaaaccctatttgcgaattccgtttctttgcttgttgtctagtgtccgtgccatctcagacctcaaatccccgatctatcgtcgagttcaatcccgaatccaaatccttcccaaatcaaatccctccacaaaagtctttttcgcctccctcgggttcgatgggccgaatccctctcggcccatcttcccctccctccctggctctctctctctctctctctctccctctcccccgctctgcccgtgcgctgcgcacgcgtgcgcgtgagccgcgccgagccgagcgccctccgctctcgctgccgtttctcgccgacgccgcccaaatcgccacgccgcccgttgcttcccgcgcgggcacgccatggtggccgaccggccagtcgccgccgccgtcagcgcctgccgcacctgcccgcgcctgccgcccgtgtcgtcgctccgctccaaaccgcctggccgtcatcgtcgtcgtcatcgcctcggccccgcctctccccgcgctagcctccaagggatggaggcagagctcctcctccctctgccgcgtcgcccccatcccctcctccttttcccaaagtggcaaggggcaagccccctttctcccttcttttttttccttttcccctcccagccggcgtcatccgcctctatcgctgttttggccgcgagcgccgagtgccagctcgcgccttgaccgcccaaggttggtttccaaaccgacatcgtcgtcctataaaccaaggcgccctcccattgattcctctcgttttgctcgctgccaccgcgccattgctgcccctctgtctcgcctccgccgttcatcgccaagcaccgggagagccggtgcgttcgtggacgcggaaggggactccgggagctcgccttcttcctcttccctggcccgaggccggagagatcactccgctgccgtccgccatccgttccggccggcgtcgtcatctacctcccgccggcccgcgtggcagcaacgtaggcgccacgtcggcaccacctcggccgcgactgggtcaagtagaccccggtccgccgcttccctccgccccctcgcgcgcgcggtccaccgcgagccgtgaggctgcgcgtgggcccgccgcaccgcgtcctccgcgaaccgcgcgcatgcgccgcgcctccctccccaaaccctagctcgccccgcgtgcaccttggtcacggtgagccgagtcgccgacaagcgggtcccacccgggaccacgcgggatggacctagcccaccggctctctctctccctccccgcccgcgcgcgcgccttgggccgccttcttgggccggccggcccattaagctcggccgagccgcccctttctctcgggccgcgccctagccgcccgagaaaagtctaatttccctcctgccttcttttcttttcttttctttttcaaaaaggatttaaataaatccttttcctttagaccaaaaatccaataatcttagaaattcaatatcttcccaacagtaagtccgtttgactccgttcaacttccaaaattcatcaaatctcgagatctatctaatggcacacttagaggtcaataatagggctttattttcgccgtttgctgagttgtcccgtttcgcgtgtagtttcggagcccgaagacccgcagtgcgaggatttcgaggatcaagctcatgatctcgagcgaggcaagccacctttgaacatcttgagcctatatttgaacttaattatgttgcttgaaaaatattatggattgataggatcgcactcaatctgcttgtcccatctgcaaggcagattggcagacctacctaatttgttgcttttgaccctcccattgtaattgttataccatgctcccttgtacccacctagtcgcgcctcggtaatcatgcactctgcacgggtatcgacggtcgccttcaaacttaaaatctgagaaacatcttgggtaaaacttgggttttacaaaagacttggaaaacccgacacctaggtcggtgcttgcgaactaaatgaatttccaaaaccgcggaccggggaacgtaccgggtgtacggtttcccgctcttgcacttaaggaccgtttccttggaatttcatccgaacatatgacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgaactggatgatccgggttagtaatgtcgtgtgggtaaagtgtacaccctctgcagaggttgttaaaactgttcgaacagccgtgcccacggtcatgggcggatgtgaggtgattcctagcgtagtttgtttgactactgccttgtgaaatttgctgttgttgaatgggtttgatgtttggaaaatctgcggctgatgggatcagccaggcccgggtggccgtttgaaagctgttggccgggagtcaatcttaatcaattcaaaagactgatacattgcacatactccgaccggacgagacgcactgtctcacccatgtcgtttgagaagcactcccttagttgtttcagaaaagagttcaaataaaatcaattgcaaaaacaacagcctttctttgaagcctgcattaaacacttatttcccatggcttgctgagtactcccgtactcacccttgctctatataaataatcccccccagttgctgaagaagatgaagcggatcccactgacgaggagttcttctaggagcaagctggctacgatgagttttagggtttcggcctagttcccaagtcgcgcctgtgatgtttggtccaagtctggcttccgttccccttttgtaatgcagttgtgagctcgggatctatccgcagcccaacatgactgtactcctactctataataaagagacctctgttgctgtgatattctgtcttcctgtgataccagcactgttttctgggactggtatcggttaacaggttaatttggagcgtcacgggctagttctgctcgggactagttcggggcgtgacactaacccgaggaagaaaacatccggtcgtcccatgccaaaaataaggaagtcatccaggtgtgtatcatctaacaaaatgcctctgtatcattagtcgctcatcattgtagcagagctgacaacgtgtatcgaatttgcagaaagccatctgatatagatccttctggaaaagaccccacgccgatcggcacagagactggcccctcagttgaaaccgggccgactaccgaagatcacccgagtaaagatcaaccagcatctgataatgcacaagctagcaatgagcccccgactggaaactagtcggccgaagctaacgtcagtgctgaacaggagcccccaactggaaaccagtcgggcacaactcagagcgaagatatcccgaaagcagaggcccaagccgatagccctcctaagaaggatgccaacgctgacccgggatccaagtctcctgttaaggttcaaggatcttctcgtccccgaccagagataataacaggtaaagctactcttctaaatccattttgatccgataaaccttcttcatccgtctaatcatcgtccatgaatatataaggcccaattatcggtgaagaagaagaagtcctccggatatgatcggctgaagattctcgcccacccatattgatcaaatggtgggatgatgaaatgcaacctcaagggattgtaatcaacaagcaaaaagaagacgaggaattgtgtatgctgaaaaaggctctcggccaagccactcgtcttgtaaatgtaagtcttctcatacatgtctcttatcatcctgtcggccactttgctgaataaggatacttttgtattacagagaatccatctcaggaaagaggcgaagactgcaactcttgaaaaattagttccctatcttggaactctgaaagctaccagagatcagctgcacgaagccaaggagcttgccaagaagactgagcatgacctgagagaccggatcgccgagctccaagattccaactttgagctgagcggctcatcaaaaggtaactcttctcattgcctgacttgcttcatgttgttgttcatgtgcgactaaccaaaagggaacgatatagcgcaagctgccaagatttccgagctggaaaggcgagttaaagctctggaaaaggacaaggccgaactgactaagcaaagggactgggcccaaaaagacgtcgaaggtaccgacggccgaagcactaaaaaatattcacctcttcatgaccactcattgatgtaggtatatctgtgcagatcgcaaaatcaaatcccaagctcaatttgacgtcttggtcagcaaaatcaagaagcttgagggagctagagatgaggttgccaacgccgccacactactcgtccaagccatgttcttcaataacaatggtccgagttcatttgatgctgacgagatcttcgacaagctgagaattgctccggatacatattttaagaatatcaaggaggctggaagtatgggagctggcctgtcgctggcgatgaccaagtccttgtacccgaagatagacattgaagctgttgacggctttgcagatgggacaagtgaagaagctgctcttgatctcatcagtgaagctcaaaatgctgccgacaagatagcggctgatgttgttgaaaggttccaggacactgacctcaggccgactggatcaactaactctgatgatgaaaaagctgactaacattgtgtttggatgatgatggagggacaatttgtacaatactgataaatgtatgctatgcttgatgatttagacttagcttctgatttcttaaaagtttttgtcaaaccttattgagcttagaacccgcaaaagttattaaaaactttcagtcctcatcaaccaagtcaaaaaatcaaacagggcaatgacaaatcaagtaagcaaattgaattgataaaaatcacactccattattattatagtagcccccgactgataactcaaggaaaaacttgatgttagcagtcaaagagggaaatacaaaagtaacgcctaagcataaaaatggcgaagatgttcaatattccaagagttgtcgatattagtaccgtcttcacgcttgagtcggtaagaaccttgccgagtgacttcggaaattatgaacggtccttcccacaagggagataacttgtgccaatcccgtgtagtctggatttttctcagaaccaggtcgccgactaaaaaagctcttgatcgaacattgcgattgtgataacggcgcatcccttgcaagtaccgagccgactgaattaatgctgcttcacgaacttcttccagtcggttgaggtcatctactcggaagaacagcaacattgcttccgctccatagagtaggaagaacggcgactggcccgtagcccgactgggagtggtgcgcatggaccaaagtacagacggcagctgttctacccacttgccggcatagggatgcagtcggtcaaaaactcgcgcttttattccttgaagtatcataccattggcacgttcgacttgtccattgctcatggggtgtgctacggagacataacaaattttgatgccgaagtcctcacaaaaatctttaaatactccgcctgtaaattgagtgccgttatcagtgatgatccgattgggtaccctgaaccggtgcacaatgttgatgaagaaatctctggctttgtctaccgtgattgtaatgaccggtttagcttcgatccactcggagaatttgtcaacagctacaaagagatgagtatatctaccgacagcctttttaaacgggccaaccatgtcgagcccccgaaccacgaacggccaagacaacgggatggtttgcaactcctgagccggtagatgagtttgtcgggcaaaaaattgacaaccctcacatgttcgcacaattttgtcggcgtcggacacagccgtgggccagaagaaaccctgctggtatgccttgccaacaatggttcgtgcagcagcgtgattgccacagatgcctaaatgtatgtcctttagaaattgccttccctcctcgagagacacacagcgttgcaggattcccgatggactttttatgtacagctcggtctcgtgaatgacatagtgtctgctatgcctggagatccgctcggcttcatctttatcttgagggagttcttgtttgggcaaaaatcttataaggggctctctccagtcagcttcaatcatgcttacatcttgagtgaccgtggcctcgattatttctttccttggtacggttggctcatagagatgctcgacgaatacgtcaaaaggagctgcttctcgttttgaaccgaagttggccaatctgtcggctgcctcgtgtcacgtcctgataaattcatcccgaaataaaaatcattttctaaaaggaataatagaattaattaaaattcgaaaagaaattggcaaacactaaaatacatacaagaaaaattcaaatgtggcctggagaatttttgttaaattctctttggtctaaaaggagccctcaaattttacttgaatttccagagcaccggaaataattattaagcaacaaaaacaattatcaaagtttattaaaaagaaaaacctaaaaataatccctctccctcctttgggccaagtctggcccaaagcctccctctctctcccccggcccgcggccgaagtccttctctcctccctctttttctctccctctccttccctccctccttccccggcccactccctcctcctccctctctccctgggccacccctcccctcctctcctcctgggccggccgcccggcccacgccgcgcccctgcctgagccgctcccctcccgcgcacgcacgccgcgcgtgcgctgaccgcgcgcccgaccgcgtggggcccacgcgccaggccggtcatctccttcctcccgcccggcctcctctctctctctcccgtgaaccctagcttcgttcctccctcgaatccgcttgatttaagcgttggattccaaaattaattggggggaattaatcccctttccctcctctctctttcccccttaatttccccttgaatggcgcccccaatcgccgggaacggccgcgccattcccggccgccttccattgccgccggccgtgtttcccgccgccgttcctgctcctcccgtggccggctccctcccccatcccataaaatggaatccccatcctccgttctatcgttttaacctcatcccgagcctccccgtggtcgtatcacctctccccgccgtcctcctctctctcccgtgccgccggccgcctccagccgcatctccctcctcgccggagcgccgtccggtcgcgccgtcgcctcctccagcatcgcagccgcctcctcttcgccggcctaccctctgttttccgcggagacctccggaagtgcctccccgccggcaaccgtggtattgccgccacgattccgcctccggccgcatctgccgcgtcccctgtgcgccggccgacgtcgccaccacctctcccggcaccggagtgccgtcctctttcccggcaaggccacggcgtcgcccgaatttcgccggaacgccgtcgcccgcgccggcctcttcttcctcctcgtcgacgtctcctccggcagcccccttccgccgcgcccgtgcatcagccggcgctgccgtcccctctctcggcacggtgacgtagccctccacctcgtccacccctcggtttcgcccggaagccgccgcacgtcgccgcgaacctctccatccgcctcaccggagtggttcggccgcccgtccctctcgcccgtgcaccggtcggccgcacctccaccaccttcggcatcgcagccgcgacgtcgtcctcggcatcgcttccccttcggccgaacaccgccggtgtccgtcgtcgtcttcaccgttcatcctcgccggctcgtcgtctcgcggcgccgcctccgtcgtcggcatcgcagcggcgtgttccacgccattctcgccttcgtgcagccgctgccggctgccctcgtcgtctcctcgccggccccggtcgtcgtcgtcgtcgtcctctcgtcgttcccggtcgtcgtggcgttcgtccctccatcgagccgttctcgtccgtcgtccgcgttcgtcaagcgagccgctgcagccccgtcgcgtcttcgtcctcggctccgcatcgtcaagcgttgcgccggccgcgtctcgccttcgtccaaggatcgccgccgaagtcgtcccctcgccgttcgtctccgtcgttcccggccgcctccgccgcgcccgttcgtcattgtcgttccctcgcctcgttgcgtggtggtaagggtccctctccctcgctgccccgtcctcgtcctttcggtgtcgcccgtgctcgttgtgcggttgtcggccccggtacccgtgtaccggtgtcggtagtcgtccaggtgtgcgtgtggtgaccgtgttagtgtgcccactcggtagccgcatggtttccacgtgtgcaacccgtgtggtgtctactggagtccgtttgtcggccactcgcctcggttgacacacgggatccgtttccgtcgacccgtggaccgtctctgtgtactcggtctaccgcggtcctttttgttgacatgtgaggtccgcatgtcaacggcgcagccttcctgtcttttctaggctagcgcttacacatgttttataattgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattctgatttaaattaatgcattatcgctttatttaaattcctgcgttatcactgttttatttagccatgcctatttacctttgttatgaccttattattattgctattgttattattaccttgttcaccctggaataaacaaaaccccaactagtgggtactctattcatggttccactagtatgaatttaggtagatgcttcgctgtttaattaggcaacattaggtggttttataactttagactttgggaatattcatatcacttggatactttggaatggttggcttttgttgcaattggacacacacctccccctctattcaaaacccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggtacagggctggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgaccttgattaataatattgtatagctctaggatcgtgtttacaaaatagctttgggcaactaagtgacttttaaatgctgtttactgcaaaacttaaccccgatattattatccccttgtaccccccttgcattaatcatgcatctgccggtgtggcttgctgagtactgtggttgtactcactcttgctcaatcttttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatataatcgatataataaagatgtgccttttgtatcatgtttgtttggtgtaccccggcatttcctgggacggggattaatacactagcgttcgggaaaaggcaattttctcggtcgcgacacctcgttattatgccgaagaacatgggtgagctcaagtccgtcgaatttgtcttccaacttgcgtacctcctgccggtaagcggtcatattatcatcaaggcaggaccattctttcatgacttgattaacaaccaactgaaaatctacacagactatcagatgccggattcccaaagagattgcaatccttaggccccgtttggcacaactctagctcccaactccaacttacctggagcgggagctgtgccaaatggtccagattcacctttttttggagtggagttggcagagctactcctagaaaatgaactacgggggtggagctgggtttttgctgctacacagctccactccaccccaaaagacccactaccctctaatattttagtgtatttacacgaaaatgccactcaactaccctttcaccccttctttcctcccgttctctctcctcccccaatcttcctcccaatcccgagctagtgcggcggcatcggcgggctgcggcagcgttgacggcgacgggcagcgacagcggcgggcggcggcggctgcgggatgacgacgggcggcacgcacgcgcggccggaggctggcggcggggggctgcggcagcggcggagagcggctgttgggggacgatggcccatcttcttccccatcctccgacgacggccacaaccggttgtggcggcgtctgcgttggcagcatacgggggcagcaggccgcggcgcatcggcggcggcaggcggtggcggtggctgcgggcggtgttgcggtggccgcgacgggcggcacgcggcggcggcgtcggcaggcgagtcgcgtgcgggggcgtcggcaggaggcagcctgggcgacggcggcggcctgtgcggcggcgcttgcgcagcggcttgggaggcggcggagatgcgtgggcttctcggcggcggtggctcgtgggctgactggctacggcggcaacgtcaaggcgacgcctagaaggtgttcgatgaaatggcgacaaaggatgtagaaatatggagctgagtaatctagccaaacacttttttacctacctcagctcctagaggagctagctctcactggagttggagtttggagttgggagttggagttaggagctctaccaaacggggccttagtccgtgaaggagcgcctcatattctgccatgttatgggatgtagaaaaatatatccacaatatgtagctcagcctttctccagtcggggaaatcagaacaacccctgctccggtgcctgaaagcctctttgacccgtcaaaatgcatggtccaatactccatcttctctacaggcacgccttcttggcactcagtccactcgacaacaaagtcggctaaagcttgggacttgatcgaagttcgcggcttgagggatatatccaaggacatcaactctaaggcccactttgcgatccgcccatttgcttcgtgattatgaagtatatccccgagtggaaacgatgtgaccaccgtgaccgagtgaccttggaagtagtgggataatttcctgacggtaattaaaacaccatatagtagcttttgaacctgaggatatcttgttttggagtcagccaaaaccttgctaacgaagtagattggtcgttggactttttgaacgtggccttcttctacacgctcaacaaccaggattgtgcttaccacctaggaagttgtcgacacttataacaacagtggctcttgcgagtgtggtgaagctaagactggtggggtagtaagaagttttttgaagtcttcaaaggctttttgtgcttcgggcccccattggaaattgtcggttttcttcaacagcttgaaaaagggcatcccccgctcgccgagttgtgaaacgaatcggctgagcgccaccatgcagccggttagcttttgaacacctttctaggagcttggcggtttcatgttgaggatggcattgattttctctgggttggcttgtatgcctctatgggacaccataaatccaagcagcttctctgacggtactccgaagatgcacttttcagggtttagtttcatcttgaaagcgcggatgctcgcaaaagtttcttctagatccgcaatcaaatcatccttctacttggtcttgacgactacgtcatctacataggcttcaacgttgcggccgatctgagttgaaaaacatctctggatcatgcgttgataagttgctcctgcattcttcaatccaaaaggcatggtgatgtaacagtaagccccgaagggcgtgatgaatgaagtctttaagcagtcggattcctttagtcggatctgatgatatccagagtagcaatccaaaaagctgagtaactcgcagtcggccgttgagtcaactacctggtcaatgtgaggtaacccaaaaggatctttagggcaagacttgttaaggtcggtataatcaacagacatgcgccattgccccgtcttcttccggaccaggactgggttagccagccagtcgggatgaaggacttctttgatgaagcctgctgctaacagcttggtcaatttttccttgatcgcgtccttcctatcttgtgcgaaccggcggagtcgttgcttaataggttttgcgtcttccttgacatgtaaagagtgctcaatcacctctctaggaataccaggcatatcggatggtttccacgcaaagatatctttattattttgaagaaaggtgatgagcgcactttcctatttacagtctaactcaacgcctattacagcagtcttggtaggatcagagggatctagtgaaatcttcttggtcttggcgtcgctttctccggtctttggcgtcttggtcgcaggcacttctccttcgcttgctgtggacgcagccagtcggatttcttctcgggcgagcgtgatctcgcgggtgtgggccatctcgcaactttccttgtcacacgtgacggcttgcttgatgtcactccgtagggatatgactcctcggggaccgggcatcttcatcatcatgtaggtatagtgcgggacggccatgaacttggctaacgccgggcgtccgagtatgacatgatatgctgtctcgaagtcagcgacctcgaaacaaatgttctctgtacggaagttctcccgagtgccgaaagtgaccggaagagtgatctggccgagtggtgttgcggatagccctggaatgactctgtgaaagggcgcattactcagctttaattccgtgcgagggatctgcatgtcgtccagagtcttggcgaaaaggatgttgagtgcactgccaccatcgatgagggatcttcgaagcttgacgttacgaaccactgggtctagtaccagggggtaccgccccgggtggaccactcggtcaggatgatccgagtggtcaaacttaattgttgtctctgaccaccaaagatattggggcgtgtcgggctgaacagcgttgatctcccgttcggtcagcttttgctttctcttggattcataagccaggggtccgccgaagatgtggttgagttccttgcgatggtcttgaaaaccagtcggggcatcatcttcatcatccttcttctttgacgtgctttgatctccgtcggaggccttgcgtgcattcttggcgtattgttctgcaaactgtttgtagacgaagcaatctttggccgcgtgattggaattgggatgatgcggacatggggagttcatgatattgtcaaaagtgttgacgcgggaacgctgtcgggaggatggtgtagtggttgccacaagttcctcgggcttacgcttgcggtccttgtgattggtacttccactcccccctgtagtcggcgtatctttcttcggcttccaagtggtgcccgattgcttggacgcggtaatagcatcttcggctttggcatactcattggctttttcgaacatctgcttgaccgtcttgggaggcttgcgcccgaacttgccgactaggtcctcgtggcaaatgcccttggtgaaggcggcgatgatgacgtcgtcggtaatgtcggatatcttgttgcgttgctcggagaagcgtcggatgtaatcttgaagggattctcccgacttctgaatgacgttgtagagatcaaactgtgtaccagggcgttcaaaggtaccctggaagttggcgatgaagtggtcgcgaagttccgcccatgatccgattgtgccacggggtaacccgtgaagccaggaccgggcagaatccgctagagccacgggtagatagtttgccatggctttgctgtctcctcctgctgcatggatggcgagaccgtagacggtgagccaagactcagggttagtggtgccgtcatacttctcgattctagcggcttgaagccagctggccaatccacttaacgtaggtcgtttgtgaaggcagctactccatccacgttgtcgtcggagcgatctggtgaatgatgaggattgtggcctctcgccgcgcgtcgctggttaatggtctcgcgaagatcgatgggacgcctgcggtggggggagcgggggcgttcagcttgacgctccctgtgccggtcagggggtgaatgaacggatcgttcaccatgatccctgctcctacgattggatccctcggcgacgacattgaggcttggctgatgatagtcttgagaccgaagaggtggaactcggctgccagtcggcgtgcgggtgcttgcgcagttagccgggaccgaggcggcgatcatggtcttggtctagttcaagatgttgacgacgtgatcagcttggttgagcgcatcttcagtgaggagggtgtcgaggagggtgatcgctacaaccgcgttctgttgtggggcacgaaaaaccgtcgtcccgtcaacgtcgtcttgcccgatgagctctcgtgctagtcgtccgggttccaaggcgcgctgtcgttggtcctcagcctccttggcagcccgttcgcgatcttgttgttcacgctgcagtcgttcttgttcttgtcgttgtcgttcttcctccagtcggcgacgttcagcttcttgtcgcgtgcgttcttcttctgcttctcgggctcggcgctgttctgccgtctcgttgtcggccatgaatacaccgaagaagagaggcgtgtagttgtcctcgtagctttcgtcgaagttagtgtagtcgtaacgatagccgaagtcgtcgtactcgaggatctctgttggtcgagaactgacaccgagggagctgaggtagctgtccaattcttccgtcgagaccgtcccgagaggttggagtataacgccgacctccctagagctagatcggatcggagccgaagctggatcccatctaggtcttcgggtgggaaacgccttggtcgtgaagacagcagccagatcatcgggaagtctcattaagattgagggataggacccatcgtcttgatcaggtcgtgttggagtagattggatctcgtccgagtggattgaagccgactcgatcgagatgatcttggggtagatctcggccgagtttgggacaccgaacggggcggagacctggcctcttcccgattggtttggatccgagtcgaggagagaaatcttgccgaagtcgttggtgatgaagtcgaggctgccgaaccggaacgcctacccggaagggaagacgaagtcgtcgatgccggagacgaaacccatcgcactagtcggcaaaaaacttgacgctacccctacctggcgcgccaactgtcgaaacaagatttcggcaatactaaaagggagtggctatcaagctggaaaagtggatgggttaagagacaaggaattttatacaggttcaggccttcttatttaagaagtaataccctactcctgtccgaggattgatccaccgagtgtgttattgatagtatgatctgggagaaagttatgcccctagaggcacccggacccctccttaaatagggaaaggggtccgtattacaaaatacagtccatatccctaacgaaatatatagttacagataaaatacaatcgtaaccgactaggatctcgggtatttccttgatacacaagtttagaatttaacccgagtcttcctaaagaaattctatctatacatggcactccatacccagtcggactatacatgccgtgtaggtatggggtatccataatctccacagtcagattcggcggtcaacagcgcgccgccatcgtcttcctcctcctctcttctttgccagatttggtggccaacagcgtgccaccgtcgccgccattgcgctccctttcttcctctgtgtcgcactgtcgcccttaatcccctcctcgccatcgccatccatcccctcaccaacaccatccgttttccctccagcggccaggcagccagatccggcggtcccgagttcacggccgccgtgagctcgcccagaccacgaagcttcgtgctttcttttttgtttttttttcattttcttttctatttttgcaccgccgcgagctcaccgagaccacgaagcttagtgttttctcttttttttttccccttttcttttccccttttttttaattcaccggctctgtatatccaagtgaattactgtagtcttcagaaaaaaataatgtataccgtgcttaaagtctagtaaatgcacttttttattatgtggtcaaaatataactaattgcttaaattagatattagtatagttttttaatatatatgatattgtggggggtaatctcaccctatcaaataaaaaggtgactgcactggaagttcatactacctaccaaacaaaatcttctacatccagtatcttcaatgcaaccaaccaaacaatatctagccatatccagtttagttccaatcagacaaacaaatacctgcatgtgtatgtccttaaccaggctaagctcagcccgaatctgggagatgggccaggctagaaggatgcgagcaaccaaacacatccttagtgtgtcctactgaaaaatatatcgaggtgcattgtaaaatgcctaagatagcatgtatatatccttcaacagaaaatctatcgcacggcgtccaaaacgttttctccgccacggcttacagcttgcagctcacagcttccttcctctctctgtgctttttcccctcaattcacagccaaggttgtcaggatcgggatactagttagtatcgttttactcaaagtaatatcgtatcgtagagtcgtatcgtagtatcgggtactataagattttcttttttaagtttaattaatatttatattaattatatgtagccattctatataaaaaaatgtagtaatgatatatatcatgcaaacagaggcatttattaagagaaaccacgttggttttgatatatttaactgattttatataaatttgaacatatttatttacattattttcataccatgttattttaaataatattttatagtatcatagggatcgtagaatcaggataccacctaaaattttgtaggatcatatactaatgaatagtaggatcgagatactatgaaaattaggatactatgtgggatcggtatcgtttcgacttggtaggatcgtagtatcgtaagatactaggatacgtatcgggataccgacaaccttgttcacagcgctcgccggcgtgcgcagccactcccctccctccctccgcctccccacaccggcgagcctgtgccgccgctcctcttcctccctcaatcccccacgccggcggtgctgcggcgccgctcccatcacatccttcctccgatcggaatcggctcctccactcggcgcactccactttggccgattcctccatcctccacgccggcagggctgcatcatcgttcggttcccttcgtttctttccgctggtacccatcgtgctctggctgatttctcccctctccccacgctgatggcgctgcatcggtggcgagatccttcacgcgcaatcccctctcgtgcagcagactcaaaactgcaggtatctgattcatcttaatttctaagtcccatttcctatgtcttctcgcaccccaactttgcaacttactgattcagctccctatctacatttgtgttctagggtttacaggtagtgaggctgaagcggatggggggagtcatgtttgatacctgagctgttaaaattaacaggttagttactcatctcatgaaacttttttgtttgtggttggaatctattttttgtgatgcgctagtacaatatggacacacatacattttgtttccagcaatttttattagaaggggttgatacctaagatgcactactttattgtactaggtatcaggtagattacagacatacattgtgttttgatttttctggtttgataagaggggagatgagatgcatgaactgcatctactcactgcttactagtattggtttcaccaaaatttatctgacaggccaatatttttgcccagtttacatggtcccggggatactagtgtactataaacatatatcttgcacacaatatatactactctgaagcattgcactagaggaagctattgaaatgaagcgataaatgtaccttctattactctgtatagtgataaatagacattttttttgttgataccatgggaggaatggcatctactgattttttttaacttgattttgcaacatgcatcactataaatctgacattacagggatagagtaacaatgattgaaagcggactaattgtcatgttttcctttatttgttttggtgcacagagtctatatggctacatattcagataattcagattttgtacattttgcgcctagtggtccaagtcgctcaccacgggttaagaaatccaaccaatgtaatgctggagaacagaggaagaaatgtaactcgaaaccttgtaccaagcttaaattctgttgacagaaaacacgaggcctgggagatctgcttaactccagtgcaggtccaaaactcgccttcggatgtgtgagcgtgccagttgatttgatcctgcaatcaacaagaaataaagacaaagaaaccacaattaatcctataaacgatagctgatcggctaggtgccgatgacatatcatttatctttgagccgatgtcatatatgtatcgatcggcaatcatgaataaataagaagaaactaaatctactcgatcggctgtagatattaacaatatatatattccctatatcgatatatacttaaatcaagtgattgagatagatcggacgccatgccgagacagtataaatcatttatatcgaaatatatactaataatgggactatatatatgtttatagcatagccgatcaaatagatctagcgtgtatcggctaatactccgataccactctatatcaatatattaaagtaagaaaaatatatcaaacagaagcctaatatacttaaatgcaacaagatcttaacataaaggacagatttaacatatcaatcaagcatatggaataaaagtagttaaatcaggtaagatcggctgaaaccccgatactaccctaatcagcaaccagaagacaggctagagattgatattctaaacacgacttaatagatcaaactcaactgatgcagcattaagtatgaaaagaagaacaatatctagacaatcaagccgctgaaagtttcatagagtggtggatatccgatataatttgaatcaacatcgatatttaacctaatcggctgtcctctaccaacttatgttagccaattgtaggttagataacgatattgctaaaaattatgttagataatttgtgattaagcttttttttttactattcctctttttcattgtatttttactaggtatcattctttttcttttcattctttcttccatatgtttttcagagtagcaatctccatgttgcccttgacacacgaacaaacagtagcccttttggatttggtgacatcttcatagttgagtatcctgaatcgcctcaccaagatacattgtaagtatcaacaatttttttttgatttatctcactcacagtcacatccttttctgtacatgtttttttttacttcacaccttcatttttttatgtagacacgactgcgggttctgtgttatgaggatgctcgagtgtcacaatggcaggagtcttgttggatatacgacggtactggtttttttgctaccaaaaatcggttgtttgttccatctctagagaaatgctcattggttctcatattgtttcattttttccccagagagacaccatgaaataccgcaagcagttatgccataggttgatttaccatcgcttcaacgacctacatccacatcgcgtcatctaaagctagtgatggtgtttgttttaaaatgtaaaggcaactccatagtgcttttgaaccaaatttggtcgttaacacatgccccccaagtccggaatatttggtaatgtttcggatttgacatacatcgactatgagtaaatatcgcacttgctgttttctgaccgttacacagtgctttaaataccaaccgttgcccccgagaatcttcacaccgtgacttccgttttcaccgcttaagcgaattccgtcctctctctctccggcgattcccccgacgcgcaaggcgatttcctcctcggccaaatctccacccgcggcaatgtcgacttccgccgacccgtccgctgcgccatcaaccagcccgtctgctacaccatcagccgagtacgcagaggtatgtatccattggctagatgcccttttcctacacagtagattgattttcctcatctcatcttgttttcttcttctctacttcttctgtacttgtagcatctttccaatcttgttgcggttcccagtttgttgcacgatcaacaatactttcttggtccaatcggcaatcttgatcccactgaattcatcatagccgaaaccaatagaaccccttttaggtcggccaatccaaatataagtcattggaaaaatacttttaaatcctggccttctcttgagaaaagctggcctgtatggtacaaacggatgtcggctaacaagcaagcccattgggatgagattggaatcggccaagccctagcccttacaatagcaaactcggccaaagatgaacccctgatagctgctgctacttatttttggtccaacaccctcaatgccttcctcttcaaccaagggccgatggccctaactctactggatatcatcatgctcactggcttagatgtgacctcgtcggctaaccccatgaacttgaatccagaacaccttcgagttcaagactaaaagcattggaggctggtcaggatatattgcagcatatatgggcaaaggaccagttacccctagagaacatgtggccttcctgttgatgtggttggaaaaattcctcttctgcgggttaagctatggtcctacaaccaattggtaattcttagccgaggccctagaatcgaagaaacaatttcccttgggcaaaatcctcctcggctacctatatcaaatgttgaataatgcatcagctaaagtgatcgtcggctcagtagttggggcaggtggaccatggtggttactgcaaacttggctgaacttggtagtcatgaaagttgtcaatcggtcatttgtgatagaagccgaatttccaaggttggagccgatcatggaagatgatggagaagaacacactcatcgtagatgcatgtcatacggagaatatgcatctacgccagccgatgcgggagcgaagctatcggctgaacttctgaaggattggttcttcagtttttatgatggatttcaaaaggatgcccgagtttggttcttctatgctgactcaatggattttgaactaccagccgattttagatttgaagacattaatcatgaaaaatttcagcaatctagagaagttttcactactgctatcagcccatgtattctccctgttggcatccatcaaggaagaaatattcaggtctcctacgagttttatcacccaatgacttcggctagacaatttggaatgggacagctgccaatcggcctgtactttgctgacaagatccagtgtagaggtgacatctcttcaaccttaataatggatcggttgctgaacatcccaggaccccaacttggaagcattgagaacatagagttggcaaggtccaggaaccgggcatttgacagatggtggagtgaatggaagctgcatttgttccatcaatcggcttccatgtatatgacagacctgttccccgatgccattcctcaggtaaatcttcactttatcaatcttgcttgaatgactggtaaccgatttgaaccttgactaaccttttcttctgatctgcagacaacagaatcctctcctcctcaccaaagtaacagtggcaaggtcattaaatatgcgccaggtctaattccaaatggaggtgcgccatctccttccgtcatcggctacaacgcccccaagacttcagcgcttctccgagggcttatcagagaactagccgatgccggcaagaagcggaaaaccagatcatcggctgaggatactttagtcccagctttaaagaagaaaattaagccgaagaagaccacaccagctgacgatctgcctgctctagatccatccatcgaacaagctctggatgaagaagtaattggagatgatgtcgatcaagctgcagccgaaataagtgacacagaaaaaacaccatcggcttcacccaagtagacccctccaactgcttctgccccagtccacttcttaagagtaagcagctttctttgactccttttgtaatcgttttaccttatggccgattcctcacagttttagtaattacagaaaaagaaaactgctatgaagaagaaatcggctgcgccaactcctaaaccggttccaccagtaagatgctctcaatcatctcattaactgatctgggccaattatgtctaacatttgtcccttttgcagcctcctccttcttcttcacctcttgtgcagatcgaatcaggcgaccgcaccccatcggctgcagacagtcatcatgttgaagaggaagaacaaccagctactcctgctattccagtaagttttgttgacataaatttgagatcggccaatcatgtcttgatccttaaccatccatgatattatcttttgcaggttttagccgatctgttctccttcgacatcaaagattacctcgatgaaacggaagaagacaccaccagcaaggcaacagctcctctgtctgataatgtgaagagaactcttgaggatatctctaatcggctagaagcaacactagataacctggtgaccaactgtggctcgatccgggtaagattcacagatatccaagctctccttccagataatttagccgatgcccttactctagccgtctatcttgagcaacaccaattcaagctggagaaggccaggcagaggttagccgatcgccgggagcgcaaaaacatcgaagctacaatccagcacaatcggcagcttgtgcatgcagagaaatccaaacttgatcagttgtctgagggcccgatcaaatcaaatatcgatcggcttgaagctcgtaagattgatctcatggcacaactccaagaatgcaatgctgagctggatatggagcacaagaaactagccgatctcccgcaagctgtcgaagaacagaaggcaaagctgaaatcggctatcaagaacgtcgctgatatgaccaaatccttgagagtcatccctgtaaccgacgctcaagattcccaagccatagaagaagtagaacagattagacaaagggctatatcggctatccagcgatatttgtctcagtgactttctatgtaacaaactttagaaaacttttgtaatcgggtaagataccctagtaactttggtggctggataaaccctgggccgaattaacatatttcccaaatacgcttaaaaatttgcgattttccatgtatgtgcccccctaattttaaaatgtccaaaacattgataaaattataaaaacgactaagggcaatataaccatatcggccattgcacatcggcaacctgcaaccgattacaataaaaaaaactaagggcgatataaccatatcggccatctcaaggcgatgtaaacacatcggctatcatgtatcggcaacatcagccgatcatgcgttaacacaaacactagggtaatatttcttcaagtatttgccatttagtgctctgccataaacttctccatcgagtcctcgcaacatgtaagctcccttagataccaccttatgaatctggaacggttcttcccaattcggcgaccacttgccgaatttgctatctcgagtcccaatcggcaaaatcaacttccatacgagttcaccttccgaaaaatctttgggcactactttcttattataatgccgggcaactcgctccttatcctaagtaacttttgcaagagctcgtaaccgtgattgaaccaaatcctccctttcatcggcaataaggttataatactcatcggctgttaaagtaacttgcagctccgttcttcttg

SEQ ID NO: 26367 - DNA, 1727 bp, Oryza sativa
atcttcttcagccatgaaaatctgattataccccgcgtttccatccataaaacttaatatcttatgtcctgaagcagcatcaaccaactgatcggccactagcattggatattcgtcctttggggtagctttattcaaatctctaaaatcaatgcataccctcaccttaccatttttcttgataacagaaactatactagaaacccactcagcatatcggcaaggacgaataaaaccagcatcatacaaacgtttgatttcagccttgacaggttcaagcatatcggctttgcatcttctcaggggctgctagtgcggtctaacccctggtttgagaggtagccgatgttcaacgattgatcggtgagtcctagcatctcataatattcccaaacgaagcagtctttaaactctttcaaaaactctatcagcttggttctaaattctgaagataaattcttactaataaatgtctaccttggtcgatcacccggacctatatctatttcttctaaatctcagccgacatgaaaccttgaccttgcttgtcattgaaatcatctactgtatccttggggtaaacgtttgaaccctccacgacgccctcaaagtaataggttgggtctccatctttaattggttgtatatcagaatcggacacttttagaaaatctccatcccaaacctttccagataaacaatcaaggccatccatctcccaaagagctaaatcagcactggcaacattaactgacctgtcggctggcacaatctcaatcttgtcgccttgccattgaatcaagcatggatgcatggtcgaaggaatgcaacaattggcatgaatccaatcccttccaagcaacaagctgtaagaacatttcccatcgatgacaaaaaatgtggtaggaattgttttactgctgactgtcagttccatgtttagaacaccctttgtttctaatggattgccaccaaaatctttgagcaccatgtttgtcttgatgagatcctcggcatttctacccaatttcctgaacgtagtataaggcatcaaatttaccgcagccccaccatcgaccatcatcttagacatcagcttcccattgcatagccatttatatataatggtttaaggtgtcgattctctgtccccctaggcttttcaaagactgcctgttctggcaatagaaccaacttagcggattcctcttccaccttgtcgacatcggcttgatcgatccaaaattcggccggcaaggtaaaaaccatgttaattgacgctgttaccacactcttcccttttgccaacctcttggcatcatcggctgcgacatcattggccccaggagcttgacccttaacatgccactcctgcttcggttttgccttcctcagccgatgattaatttcttgctcgacctcctgaaagcgttccctattcgccaacctttgaacccttctcttctgattctttgtaaaaataccagaaggacaccactgagtcttcctatcttcatcatcctccaagtaactatgttggtttactgggcccaatctttgatgaacagggactcttgtttgcttcagccgattgtttccattgtatgatcggctcgaactttccgcaacatcaccgcatccaggacaatcctcgatagttggtaacctcataccctcgttctagcagaacctaaagaactcacagccccaatgaggatcaaaactac

SEQ ID NO: 26368 - DNA, 662 bp, Oryza sativa
ttcttgctttcgggttgagctgcatcggtttcgatcttcaacaagaggtaaaacttgttatggcggtttgcattctcgggattggtgcttccatcttcatgacactctaatcttgtttatgtaattcgtcgagttatcatatatcttacataatttttagcaatatcgttatctaacctacaattggctaacatctgttggtagaggacagccgattaggttaaatatcgatgttgattcaaattatatcggatatccaccactctatgaaactttcagcggtttgattgtctagatattgttcttcttttcatacttaatgctgcatcagttgagtttgatctattaagtcgtgtttagaatatcaatctctagcctgccttctggttgcctattagggtagtatcggggtttcagccgatcttacctgatttaactacttttattccatatgcttgattgatatgttaaatgtgccctttatgttaagatcttgttgcatttaagtatattaggcttctgttcgatatatttttcttgctttaatatcttgatatagagtggtatcggagtattagccgatacacgctagatctatttgatcggctatgctataaacatatatatagtcccattattagtatatatttcgatctaaatga

SEQ ID NO: 26369 - DNA, 1405 bp, Oryza sativa
tcgccaccgtgtgccgtcgacggcggcttcttgtcccacatgaacttgcccctttactcgttgagccgcatgttctccagcttgagaggcttcagctatggcgccgcaccacgcaacaagtagctcatcagttccccaccattgatgaacatctcaatgcttgacagttgacactactttacttacctgggtctcgaggagagtgatcctggcaaaggcgtcgtcgtgcttctcctccatctcgtcaagaatctcctccatggccttgctctccttgagcgccatgctcagtttctcctccagctccctattctcccacaccaacctctctatctacatctgcatctcccccaacagcccgtgcggtggcggctagccgaaggggagagaaagagagaagggaagaagaggggaggaagaagagagaggatgacaggtggggctcatatgttagtgggccccatattttttttttttgtgtgaatgacaaacgagtcccatcccacatatacgtttttaattcaaatgccaactaagcggcacgtcaactccacagtgtaggtcaatccgccacgtcagcgaaaccactctctaaaaccataaagggagtcaaattacacctgtttcaatagtttgggggtggagatatccggttttgcggtttaagatcatggattaggttcgggtcacatttaaggagtcaacgtggatttattccgaagatgtagcgcgtagcctcgataggccgaattcctgttccagcctaacaactatgggccccgcgcgggtcggccgcaatttcgtcctggcccatgtgaatttggccctgaaaatatctataatagaactgaggcccattgttgcgcgtgctgggctgaaaagaagaaatggagaaagttggaaaacatatcacgtatggaaaaagtccagtttgactcccttaattgtacaccgaatctaattcgtacccctcaaccagaaaaccggatagaacgactccccgaactattgaaaccggtacaatttgactccctcagcggtattggaggacggttttgctgacgtggcgctgacatgacggtgttgacccggttttcgtcccacgtggcgcttaagtggcattagaattaaaaaaaaattgtgggacccatctgtcattcatatcgtgggacccattgacatgtggggggcccacatgtcatcctttctctccaacccttcttcctcctccctctctctctaccttctctatcttttctctccttttttctcttccccatcggatggtagtgccggtgaaggacagggggcggcggtgccggcgtcggggacatggggacgcggtggggcgaggaggccgcggcggccaggaaggcacaagggaacgactggggggaggcggcag

SEQ ID NO: 26370 - DNA, 22385 bp, Oryza sativa
  unsure (1)..(22385): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctagctcagtcgatttattctgtcttaattcaggcctttacgagttacgatcaatcaatcgatcgatcattgaggtgtcgccagccgcgccgccgtgccattccagttccagctgcagctccacctcgccggactcgacgccggcgagcctcagcaccaggccctgcgccgccttcccctccgacgccgaccacacaacggagctcccgctccttgggaccacggcggtgccgtcctctttactgtcaacgccggagggggtacggcggcggctgctcgccgcggccgcctccaccagcggccggagctcgaagaacgccgcgcccatggggtcgtcgacgaacgggtcacggtcgtagacctcctgtaagcaagcaagcggagattaattgatctctagcctagctaggagaacacaatggagtacatcgatcgatcgatggaggattggaaggtacgaacgagagtgacgaggagatggttgagatcttgaacgatgagcgtcaggtcctcgttccacactggattggtgtttttcctcactgtacgagttctcacctcctgcagtcaggtttccattgtcagtgacttaaataaatcttgaaacaaatctaacggtttaaaattatatgaaagttacatacatgttacattatattatagatatatgtaagttacagtgcaattacattacgattatactataattatatcagtcaaatttttaggagaaaatttgtcaacaaatatatagcaaaattaatgtataaacgatacgctcaatccaaaacatacaatgccataatcacttgttacatatggcacatttttttttaacgaccaacaccagaccgaagattctattgacaaattagaaaaaatatatatataactaaagccttggaagctataaaaaaaaagaaccaagaaaaaatcatccaactaggcaactgcacccatgagccaaccacctactgatcacgacagctccacacaactgaaacctagcacaacctggcccccggccgctatacaagagcggtcgccttctggcctacaactaagccagaactataaagatccgctcatccctcgtactaattcagcacactatgaacttacgattgaatcgatcctttgttcacaaaattcttttcttttttaatccttcataaataaaattgtaaatatcatttttttatattttattttaataatcctgttgtttctcgtaaaaaattatgattgaatcttgatttgctatgatttttaattaattaaattaaatggttgagaacttcgttcctcgttggcaaggatgttgtaagaattttcgaagtactcatgacactgctctttccaagatatgactgttgttacgcgtatagctaaacaatatgactgcattttcgtatttctctacgtaccgaattgcacgccaaacaggtagtttgtcaccaactattagtttttgcccccaaaccaactcgatgtcgtaatcttgaggcaatggttatgtaactgtttactaattttggatgaagattcacaaacagaattcaataattgtgtactccttatcttgggttggtaggtgtcttcttttttgtgtgagaaactttttattttgtatgctactctataataattagttgtaactcattgagcaaataccaggattttctattccattatctaaaaaaccaactcgatgtacgtcaatgccgcatcatttgtgattacccatatactccagtaactaatctttcaattcccaactcgtgtagcagttatcttgattgttgtcagtacattcacatcgatgtgtcatgagataataatgcaactaattaagcatttgaagcaaccaatatgaatgcatgcattggcagcgaaaactacatattttagctctgaccgagtcacgaccgcaccattcggcagcttaagttggtccaaatcaatcgatgaacaccataaattgttatgataaagcctctacctaagagcatttgcaatggtccaacttgaataatagcccctgtaccgaggccactccagggagtggtgatttaatttccagggactcggtttggtcaaaccgaatagatgaggtccctcttcaacatatgctgggggcattccagtccatacgaaaatacagtgcacaaaaaacggctacagacgcgattccagcgtataacgtggcatggaaggtgtttcatcgaaattgtaatggcatgtttgtgaatagtcgaatagtaatgttattttttaaatccagtaaatctttaatggcacgtatacgtatgcacatctcgcaaatcaattcctttcacttagctaatgttataccccagaggtttcagatgatccatttgaacatatttcagttaatttggtacaaattcgttcgaaatacggagcaatttttaataatcttatggcatgttcaaattgtagccaaaataaaccttaccaaattttagcaataccatttttttaatttggtaatattgtcaagttttgacaggattttctatgtatttactagagtttggtaaaaaactaaattgatgcagtatttagcaagattaccaaattttagtaaggtttgttttaattacaatctgaacaggccttcaataataactcggcaatagtacgtactagcaagcttaattagcaggtcgaaagagtgaaagagatcacctggttgccgagcttgaggacgacgtagggatcgctgctgaagacatcacggacggcaagattggtccctcgcaccaccttcaccttcaccaccccgacgatcacactgctgctgccgcactcctttgccatcgatatctatcttgctgagcttgagtaagacagttcagagttgtgtcctctcaaattagtcttgctcctctactcctactatatactccctccgaccaaaaaaaagataaaccctgggttttcgtatccaacttttgattgtccgttttatatgaatttttttataattagtattttcattgttgttagatgataaaacatgattaatactttatgcgtgacttgtattttttaatttttttttcatatttttttttaaataagacggacagtcaaacgttggacacggaaatccagggtttattttttttttttgacggagggagtactatgtacttatgcctctatatacatctttgtttgtgcaagtccgcaaggcttatatataattaattgttccacgtaagcatgcatgcttcacgcttggattaattaaaggggactaattgataatgtgacgatcagcaaactgatcatgacactggagaagaccttatcacttgaaattttacacatttaatacagactcaggaccaaatgtgtaaaatttcaagcacatgatgatcaaatgatcaagaaccagttcatagatctggagaatgataaaccatcgtaagagcaggtacaatagcaaactataagccagctgcaaacatattttaaggagataaataaaaagagagaagagcagcggactacaaatttatagccagttgtagcacggactctaagacacgctgtgtgtatgataagtgggaccaggtattaatagtgtagtatgtaactattgtatgaatgagttattagattagctatagatgaattagagttagtagtcggctatactattaaacttgctctaagcaaacatggacataaaaaaattaggagatgacataacgaagcttaacccaataaccagtcagaaatcatggtggtgtcgaagacgccgtggtccggttgtcagtggcatccatcattaattgattggtcaggcatactgacgccgtgttctggttgtcagtggggatgatcctcctgccctgagaggaaaagaaaccagcaaaatgacaggtgcacagttcaaatttctaatgccaaaacaagaattgagatccctaaagtttgaaattattgcagctaatacaatactccacagagagagatctaaagttcttcaccatatttcgtacaaattaaaagccaaaactctaatgcatggcccccctaatatcactacaccagcaaaatggactgcagcacaagcacgtatggataaaaccacaagagtaaaatacaccagcggtccttaaacttgtcaggaggtttcacttaggtccacgaacttgcaaagtgcatatcaaggtctctaaacttggtttattgtattatcccgatccaaagccgcgtttgactgtggtcttgtctacgtggcacgccacgtggacaatgacatggaatttttttttcttccttcttccttcttttttttatttcttccttcttttttctcggtggtgagaggcggcacgaggggaggggttgtcgcagtggtgaaaaaagaaggaagaagggagaatttttttaaaaaaattccatgtcatcgttcatgtggcgtgccacgtaggcaagaccacggtcaaacacggctttggaccgggatgatacataaaccaagtttagggacctcgatgtgcactatgcaagttcgtggacctaagtgaaacctgctgacaaatttaaggaccgcaggtgcattttactcaaaccacaattatggatttgaaagaaatgtatagtgcagctatatgaccaaaggaacataagtaattaacgccagcacttacatgcttacaatatggcaaaagaacataagtaaaccctcaatccaagagcctcataaattggacctcaaataaaaggcaaatgtctcattgcaagataatctatgagaagaacagagaggaacctaaaacatggcaaaaaaaattgctacgtgatgttttttttttcctccatctgaagacttactgctaagaagaactttaggcctagataaggacagataaggacattatgatctgctcctccgtttcaggttataagacgttttgataaactgttacaagtttgactaagtttatagacaaatatagtaatatttataatactaaattagtttcatcaaatcaataattgaatatattttcataataaatttgtgttgggttgaaaatgttattacttttttctataaacttggtcaaacttaaagcaatttgactttgaccaaagtcaaaatgtcttataacctgaaacgaagggagtatctatctattataatattttactaagactgacttgaaagaaggcaccacgttcattttgaaaaccagaaattgtcacataattatttggagaaaaagaaaaatatcttaagtgttagatcatggtgggttcggattataaaagtgtagatcaattgatattgttctatataaaatacaattatatctgcagaaatagaatttaagagttgtatatgaaatctagagcttataaaaatagaacctaagaatcatatatgaaattcaaatataatttcacatataatggtacctatataaataaaattttggagttacatattaaatcttactctatgtgaattatctagcaacgggcaaaactgcagttttgcgcaaggcaatccccctagtttaacatgaaaaatagctatgaaagctcaatagagattaacgaaaaccattgcctctttattaatatcacaaattgcaagttttagttctagatatcatttgtgaactacctagattacatagtcaaactatgatgctagaaccatacaaaattgtcatccaataataaaccatggaaagtatgtatctccgcctagtgcactgcccacttccgtcactttgactagcaccatcgttcagcctgcccttcacatgatatttgcacctctctccgccaccaatagctccctcctctttttttttttttgacaaagagagttttatcgatcttagataattacatcaagaggatacaatcattctaagaccaccctcggtctctgcatagctctctcctcttggggaaggcgattgaggaaaactcattgaagaagttcatatcatttgggacaaccttcttcttgtgaaaatggaggactgacatcaaatctggtgcacatatactgctctctctgtggcaagcattggtggcacgcctagtagtagttagcggtcgaccggatggtagatgccggagagaagtttggaagttccaaccacaactagccacaaccgtgatgaaggaggtggacattgaaaagtccttcaatttgaacaagaaagggaaacaagattaagccaaccacggaacaagcccgaccgcggttgctcctccctcctaatcggtgactaatagccgtcagaactggaggaggaaagggtcagccgagagaaagcatgagtcgtttttgagtcacctcatcaacacggagatagggggaataaaaaaactgaaactttaaatacaaatttaaggaggaaaaaaagaaatatcaataagaagtaaagtggattaccgagaatagggtaaaattatccaaaaaatttagggtttaaatgcgccaagcgatcagttcgaggaagtacctgaaataattttctttattttatggagagatcataaaaatattatagtccctgtacaaaatttgtagacggagagtagtatgtaacatagttttaaataaaagttgtttcacatggttcgaaattatcataatctacgataataccaaacagaaattaagaatataaccatggtttacatcctctactgatttcacagaaagcacacccttcagggaaaaaaaaagaaaggttaggaaaggaaacgagacagatatggtctgacgcacttgatacgtgagccggttgccaaagcttgaacatcccttttggtcgagtcctctgatcctctcacgcaacagtgatgaacagtgcgtgcaagcgatcgatcgttgtcaaacatgtgcaacacacacaaatgcacatagcacactgattgtccaacgagacgaatatatataaaatgtggtggtgatatacgaggacaaactacaaaggcatatatattaacatgcgacattaattagtggtagcataataacatcaacattgttattgtttgtgctaagcccgcgagcttattaggacgcttttatgtgtggccgggcccgatttggtgattgtttttgtagtactgggccgagctgtctgtaccgagattttcctttgcgtttcacgacgccaccaagcgtcgtcaccgggcgcggcatgggaacggggcatgggacagcagcggccgacaacgcaggccggcagccgggtgcgcggcgcgcacaccgaaaccacctaacccacatttggccgcaagtggttccttcgatactcccataatataaaagattttaactttttcttacactatttaactattcgtcttataaaaaaatagaattattatttattttatttgtgacttactttattatttaaagtattttaaacacaactttttgttttttatatttgcacaaattttttttaataagacgagtagtcaaatagtgcaagaaaaaatcaaaattctttatattatatgatggagcgaatagatatagcttttttaagatgttttggtctatctatcggtacaaatttagacgcatatacgatgaagtactcatgcataaatctctacgtctgttctctatctctactattataaaaattgaagatgtttttgtcagtattttaatacgtcaaccgtatttgagtcggtttttaaattcgttcgcttttgaaaatacatatccgtgtttgagttgaattttaacttcgtttacttttaaaaatgcaaaagaagtcgtataagaaatctctgtaataaaactcgcatgctaacttgagatgaaagtcgtacgcctaattacagctcatgattttctaaaaaaatatctaagcgaattccgacgatgaatttcatttagctaaaccgtataaatataataaaattaaaatataattcacatgtttcaacgcacaggcattttttctacttacttaaaaagtataaaatatttccgtcgtccataataaaaagagagcggaaaaaaagtcacgcaaaaaataagggatttgctatagagcagcatgctgtttttttttatcagccgaatgttggctagacagtccaaataataaaacaccatcgaaaaaaaaggcgaaacaaaagttcggtaaaaatacaaggaaaaaaaacgccgtccaaaagaacagcaaaaaaagtacgattcgtaatcatcgcaaaaataacagtggcggaaaaaagccatgaaaaaacaaaacaacgcatatgtaaagaaaataaaaaaacagcgaaaaaaacgtctcattggtaggcaacgaaaaataagccggaaaaaaagaatcccaaaaaatgcagaaaaaaatcattcgatttctacaccacgggaaaaaataccgtgtcacaataaaaaaaatccagcaaaaacaaaaagacgtgtccataaaaaaatttaaaaaggatgaaaaaatatttgtcaaacaatgggatattgtttcaccaaaaatatgtttcattgttctactcattacatgaaatgttccagaagatgcaacatttaataatatacagaccgcaacaccatcaatgaatatatgaaactttgagtcataatgaatgaaacatagaaaaaatatcatatgcaacatgtattatattttacaaatacctaatactttttataccacgtctgaaatatcacgctataagcattgaaacatcacaaattaccaactaaaacattcttaaaacatgctatgtgatatttacaaataaactagtgaaacattacgaaatacttattgaaacatctaaataaaataattgaaacataaacaaagatttattgctacaaaaaatgttttgattggaatatagtcatatcgtatcttgttataaagatttaactacaataaatataatagtgtaatcgaatcacagttttaatatatggttatttggaaaaaaacatttgaagcttgttaaatagctacatgcatgaacaataagtagtatgtcagctgactgatgaaagagagaaatgcattggttgttgaaaaagaaacgacatgtatgttggttgtaatttggggcaagtgttatacggtgcgtctggtccgatctttttagctggatcggacgttcgaccgtaagcattttcctatgattccatgagaaaaagtttggcacaacgtaacgcgagaaacaaaaatccggttccacgcaacgagaaaaaagagcaatccgattcgaggaaaaaaaatggcaagaaaaaacgcagcctaaaaaaaggttcgcgaaaaaaaatcatttcgctcaacgtttaaaatctgattccaggaaaaaaaagtcgtcccggaaaaaaacctcttcgacaccccgcaatgttctatatatcctatctctatgaagagcgaaatttgttttcttcgttcatcaatttcttcttcgtatcggtttttcggtgatgtgctttttgggttttttcacgcacgcattgacgtacttcccgagtcccgcgggagtcctccgtgcgttactaaatcagtttgggtcaagtttttctgcacgtatatatccaattcgtgatcacaatttgatttgataagtttcaagaattttttttgtccattggtagagacaacatccatccaaagatcgaccgcatcggtgctgatcaaatagctaggatgcccacagcccacaaaactttccttgagctgagtctgccaaataaaagcctcatcgtgacctaaactcctctcgccacctagctcattgctcccaccaagcagccaaagctaatcaccgcgagcccgtgatgtactctcgagtctcgactatcatatcgtccatacgataatcgaggcgagagaaagtttctatgcatctatccataagatttaaattggttcaaccaaactactctctgtactcgttaagaaaatcatttagaataatatttaagttaaaccttaggaatataaatcataaataactctcaagttattgtgtttgaaaatataaaaattatatgaatatatttgtcttgaaaaatactttcataaaagtatacatatatcatttttcaataaatatttttatagaaacaagaaatcaaagttgtgttttggagaccgtgtcgctgttcaaaacgacttcctttacgctctctgcgtcgtccaaatagtgtcaagtcttaatttcaaatccaacctatgacaaaggtctataatttcaaaaaaaaaatcaatagctctaactcttgtttcggatcggttatcgatttatttgactatagatatttcatgtgtagtttgacgtaagtagctaaatgagtgaggtgtagttactaatttaagtctctccagtcctctcacttaattttatcgtagtcttatttgcctttcacgtttctctagctagatatgatatattgtaacttttccagtagcaacgcacgaacactttgctagtctatttaaaatctgaaatgtctcctaataacagagcaagtgatactcatgccgtactacacactagtacacatacacaaaatatttttccgtgcggtcaaaatgcatttttccgtacggaggtcccgcctagctgcacctaggtgtctgcgaaaatccatattttcgcgtgcgggtggcccaaccgcacgggataatccatcttcccgtgcagtcgggttaagtggaccgtacaagatgatcgattatcccctacggtcaaattataccgcctgcacgcaaaaaaacgaaaaaaaataaaatccaaaaaatccaaaaccctaacgaccctaaccctagaatcgccggctgctgccgcatgtggccaccgtcgtccttgtcatcgccgtcattgtgccaccgccgctcccgaccgcgccgcttccgagccatccgatcccgaccgccaccgcgatcggccgccgtcactgctcccgggcgcctcctcctcctcgtcattggcgtggcgcagatccggccggtcgctcgccgtgccgcctcccgcctgcttccgttcgccgcctcgttggcggcagcagcgagccgggcgcctcccacaccccgtgcgctcggtggggaggggaggggaggggaggagaggagaggaaaagaagggagagatgagtgattgagggagaataaaaggaaaaaggaagagagaaggtgaaaattttgaagtgagtgagagggaaaagagggagaggtattttcgtgtgcggtccacttaagaggcccacacgattttcacgtgcgggcctattaaggatctgcacgcgaaaatgggaggccgatttttcgtagatgcacgcgaaaacggtccgtctgggaaaatgggagttttcaggaaaatctgttttctaggagtgacaataacgtgaaatactactacctctgtttcatttataagactttctagtattgcccatattcatatggatgtttttttttcagggacattcatatagatgttgcatacctagattcattaacatcatgctagaaagtattgtaacctgaaacggagggagtagtaaaatatttcagatcttggaatcgaaaagccaacgtgctccattaacatgttgctactcctaattaagttttttataggacttatcctattagtttgatgataaccttccatcaaaacaaatctaatactacaaaatataacgtatctagtgctaaaaatctgtataagaactctgttcagatccgtgataccttttaaatctcgtactaactttgactagtaatatgcccgtgctatacgctacgggactattctatttatctttattaacatttaaaatttcatgttagcaattttttttatgatatgtacaattaagctttaattcaatgcatgccttaatcaaatatatttcacaaaaagtacaataatatgatattatataggcacaataaatctggaccagaattgattacataatcacttagtatacaatatagagggcaatatacgtttaaaagtatgtttaaaaagtaaatgagttatttcattaatttgttgcgggtgtaaacaagtacaaaaacaaagcatttgatgcctatgtagaataaggaataattaagaatttgccactcttacgagtggtgataaagtatttgtcactggacccgcatgtcattgacatatgagggcccacatgtcaaagaacacgagtggcaaataattaattgccacatcttaaaagtggcaaaaagttaaacgtgagcaatgctagaaagttttataacctgaggtagtacttgagtaactgtagatatgcaccaattttttaatgatccatttgaacatagatttttttttttgcaaaattctatgttctaagattcacatggtagaaaaaaaagggaaatgggtaaaacggaagatttgaagtggcatgcttctccaatcatacgggaataaaaacacaagaaacaggataggaacactttgatagtaccataagaaaaagaaatgaaagtttagcaagagatcataccccttgttatttttcctataaaagcaaagcgcaggaatacaatcctattatttttttctatcttttcatatgaataaaaggggagatatagggaaaatttcatacgaacttaaattgtgtgaaaatcatttaccgacccaactggcgcgtctattttgtagtgtccaatagagattatcaatcagcaagcggtacaaaaatttagtacaagtttctacaatcatattaaaaacataataagttgtaaaagaatcaaccagggttttccatcccattcacagaccagcatgtttgacatattaataactgaatgttaaccagaaaacatttcattacccaaagactaacctttatttaatgcaacccaacaaaatagtataagatattagtcctttttgcgcgaatataagatattagtccttatcctgctggtgaacatttaatttgttactaccttactggtggccattgcatactccctttatttggcactaacctgtactggtcgccttcctccatcttattttaggtttctactttaccataaatacctgtaatcttttcagtttttcacaacgtaatgcttatctgctaaaaaaactgagtgtttcagttgcaatggagaaagttagtacaagattctatgcatatccaagagtgttcaggttaagaagtgcagggctaaaaacctcatattttaaatttggccatattaaacctaacaaataacataaaagtatttctgggataaaaaggaaatttaaaatatgaagctcatcatcccacaccatcctgaatttgaaatattacagatgacatttgaccatatggacatggcttcgtcaaaggccttcaagtaaggagtactaaacagcattctgtatcttttctacctaattaagctgtacacttaaatcctattcagggtaacaggttctttcagaaatacttgccgcaaccaaaattatagttactcattcccttctgctatgatggctagtgatgcaaggaatacaacatgtatggattgggaaaatatcatcaggactgaagtcactgaactgtgattcaaaactcaaactcaactccagacctaaaacattcagacctcaatttcagtgataaaagtgcagatcatgtcatgcattgcaccacctctgttcgtaacaaggcactgaatggttctaagttctaacgttcagtgcacgggatttgatcgtcataaatgcatcaaaaaataaaataaaaagtgtcaactttccatagaaacaacaaggttcgttgctgttagtatctgtggagattatggataccccatatctacacgacagttataatttagtcggatatatggtaccaaatatagatataatatctctatgagtactcgggttaattctaaacttatatgtcaagaaaatacccgggatcctagtcgggtacgaatggtattttatgtgtaaatcccataatccgttaggaaaatgactgtattttgtaaagcggactccttcccctatataaggagggtccatgtgcctcttggggcgcgattcttttttcccagtttatacaatcaataacatactcggcggaatcatccccggacaggagtagggtattacttcttgaataagaaggcctgaacctgtataaaattctttgtctccgaacccatccactttcctaacttgatagccacccccttttattattgccgaaatcttgtttcgacagttggcgcgccaggtagggtagcgtcaagttttttgccgactaagtgcgatgggttccgtctctggcatcgacgacttcgccttccctcccgagcaggcattcaagttcggcagcctcaacttcatcaccaacgacttcggcaagatctctctccttgactcggattcaaaccagtcggggagagaccaggcccccgtgccgttcggtattccgaactcggtcgaggcctactccaagatcatctctcccgagtcggcttcaaaccactcggacgagatccaatctactcttccgcgaccagatcaagacgacgggtcctatccctcaatcctgatgaaacttcatgatgacttggccgctgtcttcacagtcaagacatctcccactcgaagatctaggcgagctccggctttggccccgatccgatctagatccagggaggttggcgttatactctgtcacgcccagaaattcactagtaatttccgaacttatttgtgcataaaatcctcgtccaggaatcagccgaggtacacaaactgacaatttaatatacagaatcatcaataatagtgttacatactttcaaaagaaaagaaaactgcagcggaattaacggtctagcgatggcttcagctccactcccacaggcaactcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcatcatcatgtctaccatgcgtcgcgatactggaaagtacccgaatagaggctgtgacaataccctttgcacaacacaactcaccacagtgcaccattcctggatcataatcaccccctctataaatataaccagaggcatggactccccagcgacccccacggacttctcgccgcttctcagtctggtgccccgcaatgaatcatgctatacagaaggtaaagccgttgcccatgctggcttgtggttggtacggttaatatttcacaacagtagctcgtgaaccggtccttaattgtcatgagcacgaccttcaaaaccatgtgctcacaacccaccattgtcaagttttagttatcaattaattatcataacacgattaaacatcgtgagctaccattaaatataatcataagtgatagtgtaacattagttatcccaattatgtgataatgtttctaagcatggctaagcaattatatatacatagcatttagctgaaccaaaccaatatataaggttcaagctaatcaatttgttacccaaggtatcaaggaataaagtaatcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaaaacgatgatgacgtcatgatgatgacctcatcaatggccgaaccaagatggcgacctcgccggagattggatggtcggctgcgactttggaggacaagaacacgtagaggacgacgagacgaacccaacggtacccaccctcgaaccaaacggcgaacgacgacggccggcgacgaggtctagcggcggcgcggcttcggtcgacggcggcgacggggctgcggtggtcggcggcttcgggggtcaggcggccgggcttgtccaccctcccgcgcacctaacggtggtgacggcgaccggcggcgacgacggaggcggcggcgcgacgcggatggagctcggccggcgacgacggcggggtggagcacgtggcggcggcgctacgaggcacgggagaccacgggggagggggcaaacgaaagaggaggactagggggtcctatttatagccttggattgaagagatcggactcctcccgcaagaaatcgatccgggaaatcaaaaactcggttttggagataaactcgaaaacgagctcgattcggataagatactcaacgattagctccgatttttggggtaaagatagaggaggataagaggaatatttcccctcaactaaattggaaaaagagcaacggggaggcgagatttggaaggaagaggcggcggcactgtgcacggcacggctggctcgggctctgcctgagttggaagatgaacagtagctcagggagggaaagtagacttttccggctaggctgagaggagaggaggcggctcaggttgggccggcggaagagagaggaaggaaaggaaggaatgggccgaaaatggcccaagctgaggaggaggattttattactttcccaattaaaataatcacttaaatgatctttgaattgttaaaaatacttccaatgctcaaataatttcaagaaaaatcctcaaaatacttggacactcaaagtacttaaaaaaattacaattagaccatttaatgattaatttaatatgtgggtaattactgaaatgctctttgtaagattaaaaattaggaattgagctccgaaaaatccgagaatattccagagagtataattaaccatggagaatttaataaaaattaaatccatccatgctttaaatttaggaaattttatttcccacatttaacttcacttgtaaattaatgaacatttaatataaattctaataataatttattaaataatttataaatcctgaaacaaaaattcaggatgtgacatactccaacccctcgggacagtctcgacggaagagttggatggctacctcagctcccccggcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacagcgccaagcccgagaagcggaccaagatcgtgcacggcaagaagctgaacgtcgccgactagaggaagagcgacagcgacaggagcgagaacgactacagcgtgagcaacaagatcgcgaacggattgcaaaggaggctgaagatcgacgacaacgcgccttagaatctgggcggcgagcgagagagctcattgggcaacaagacgtcgatgggacagcggtctttcgcaccccccagcagaacacggttgcagcaatcactctcctcaacaccctcctcaaggaagacgcactcaaccaagctgatcatgttgtcaacatcttgaaccagacaaagaccatgatcgccgcctcggttccagccaactccgcaagcacccgcaccccgactggtagccgagtccctcatcttcgatctcaagactatcaccagccaagcctcagcattgccggcgccggatctagtcgcaggagcaggggacatgatgaacggtctgttcgttcgcctcccgaatgatatagggagcgtcgagttgaacgaccacactccccacatcgaaggcgccccatcgatcttcgcgacaccatcaaccagcgccacgcagcaagaggccatcattcaccagatcgcgatgacgacgacgtggacggagttgctgccttcacaagcgacctgcgtcgagtggattggccagccggctttaagccgtctggaattgagaaatatgacggcaccaccaaccttgagtcttggctcaccgtctatggtctcgcaatccgcgcagcaagaggagacagcaaagccatggcgaactatctgcctgtggccctagcagattctgcctggtcatggcttcacgggctaccccgcggcacgatcggatcatgggcagagctacgcgaccacttcatcgccaacttccaaggcacttttgaacggcctggtacacacttcgatctctacaatatcgttcagaagtctggagaatctcttcgagattacattcgacgcttctccgagcaaggcaacaagatctccgacatcaccgacgacgttatcatcgccgcctttactaaaggcattcgacacgaggacctagtcggcaagttcggatgcaaacctcccaagacagtcaagcagatatttgaaaaagccaacgagtatgccaaagccgaagatgctattacggtgtccaagcagtcgggcaccacttggaaaccaaagaaggatacgccgaccggaggagggagtggaagtaacaaccacaaggaccgcaagcgtaagcccgaagaacttgtggccacaacctctccatcttcccgacaacgttcccgcgtcaacaccttcgacaagataatgaactcccaatgtccgcatcatcccaactccaaccacgtggccaaagattgcttcgtcaacaaacagtttgcggagcaatacgtcaagaacgcacgtaagccctcaaacggagatcaaggcacatcaaagaagaaagatgatgaagacgatgccccgactggttttcaagatcatcgcaaagaactcaatcacatcttcggcggacccctagcttatgaatctaagagaaagcagaagctaacagaatgggagatcaatgcggttcagcctaacacgccctaatattcttcggtggtcagagatagcaattaagttcgaccgctcggatcatcccgaccgagtggtccacccgaggcggtaccccttggtactagacccagtggttcgcaatgtcaagctctgacggactctcatcgacggtggcagcgcactcaacatccttttcgctaagaccctggacgatatgcagatccctcgcacggaattaaagccgagtaatgcacccttccacggtgttatcccaggattgtcagctacaccactcggccagatcactcttctagttaccttcggcactcgggagaattttcgcacagaaaatgtttgtttcgaagttgctgatttcgagacaacatatcatgctatacttggatgaccggctttggctaaatttatggccgtcccacactacacctacatgatgatgaagatgcctggtcctcgaggagtcatatcactacggagcgacatcaagcaggccgtcacatgtgacaaagaaagttgcgagatggcccaaacccacgagactacgctcgcccgcgaagaggtccgactggctgcgaccacagcaagcgagggagaagtgcccgcaaccaagctaacgaagaccgaagaaagtgatgccaagacgaaaaaaattcccttagatccctccgatcctgataagactgctgtaataggcgctgagttagattgtaaataggaaagcacgctcatcacctttcttcagaataataaagatatttttgcgtggaaaccatctgatatgcctggtatccccagagaggtgattgagcactctttacatgttaaggaagacgccaaacccatcaagcaacgactccgccgttttgcacaggacaggaaggatgcaatcaaggaggaattaaccaagctgttagcagcaggcttcattaaggaagtccttcatcccgactggctggctaatccagtcctggttcggaaaaagacggggcaatggcgcatgtgtgtcgattataccgacctcaacaaatcctgtcccaaagacccttttgggttacctcgcattaaccaggtggttgactcaacggccagctgcgagttactcagcttcttggactgttactcgggatatcatcagatccgactaaaagaatccgactgcttgaagacctcgtttattatgccctttggggcctactgctacatcactatgccctttggattgaagaatgcaggagcgacctatcaacgcatgattcaaagatgtttttcaactcagatcggtcgcaatgttgaagcttatgttgatgatgtagtcgtcaagaccaagcagaaggatgacctgattgtggatttagaagaaacttttacaagcattcgtgctttcaagatgaaactaaacccggaaaagtgcatcttcggagtaccgtcagggaaattgcttggatttatggtatctcaaagaggcatacaggccaacccggagaaaatcaacgccatcctcaacatgaaaccgccaagctcccaaaaagacgtccaaaagctgactggttgcatggtggcgctcagccggttcgtctcacgactcggcgagcgggggatgcccttcttcaagctgttgaagaagactgacaatttccagtggggacccgaagcacagaaagcctttgaagacttcaagaaacttctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagccaattccaagacaagatatccttaggttcaaaagttactatatggtgtcttgattaccatcaggaaattatctcgctactttcaaagtcacccggtcacggtagtcacatcgtttccactcggggatatacttcataaccgcgaagcaaatggacggatcgcgaaataggccttagaattgatgtcttttgacatatcgttcaagccacgaacttcgatcaagtcacaagctttagctgatttccttgccgagtggaccgagtgccaagaagacatgccagaggaaaagatggaatattggactatgcattttgatgggtcgaagaggcttataggcactggagctggggttgttttaatctccccgactggagaaagattgagctacgtattgtggatacatttttctgcgtcccataacatggcggaatacgaggcgctactccatggactaaggattgcaatatctctaggtattcgccgactaattgtccgtggagactcttagttggttgtcaatcaagtcatgaaagagtggtcatgtctagatgataatatgatctcttatcaacaagaggtacgcaagttggaagataaattcgatggactcgagctcacccatatcctccgacataacaatgaggaagctgacagactggccaattttggttccaaacgggaggcagccccttctgatgtgttcgtcgaacatctttacgaaccaaccgtacccagaaaagaaacaatcggagccatggatactcaaggcgtaagcataatcgaaaccgattggagagaacctcacataaaatttttgagcaaacaagaactacctcaagataaaaatgaagccga

SEQ ID NO: 26371 - DNA, 6797 bp, Oryza sativa
gctatcgacaaattctccaagtggattgaggctaaaccgggcatcacgatcacagcagataaagctagagattttttcatcaacattgtgcatcggtttggggtacctaatcggatcatcactaataatggcactcaattcactggcggagcatttaaagacttttgtgaagactttggcattaaaatttgttatgcctccgtggcacaccccatgagtaatggacaagttgagcgcgccaatggcatggtacttcaagggataaaagcacgactgttcgaccgactacgtccctatgctggcaagtgggtagatcagctgccgtccgtactttggtctttacgcactactcccagtcgggctaccggccagtcgccgttctttttggtttatggtgcagaagcaatgttgctgagtgaagtggaatttgaatcactatgatttcggaacttcaacgaggagcgctatgaagagggccgagtagatgacatcaatcgactagaagaagcccgtgaagtagctttaattcagtcgactcggtatttgcgagggttgcgccgttatcataatcagaatgttcgatcgcgagcctttttagtcggcgacctggttctgaggaaaattcaaaccacacaggatcggcataaattatctcccttatgggaaggaccgttcataattgctggagtcactcggccaggttcttatcgactcaagcacgaagatggtactctcatcaacaattcttggaatattgaacaccttcgtcgattttatgcttaggcatttcgtttgtatctttcctctttgactgctaacttcaagtttttccttgaagttttcagtcgaggggctactataataataatggagtgtgattttttatcaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttgagatatcaagcacaacataaattcatcagtattgtacaaattgtgcctccatcatcattaatcatcaaaatcattggtatattaatcaatatcagtcttttcattatcagaattatcaggaccagtcggtcgaagatcggtgtcctgaaatctctcaactacatcaactgctatcttatcagcagatttttgtgcatcgctgatgaggtcaagagcagcttcttcgctcgtcccgtctgcaaagccatcaatggcgtcaacgtcaaccctcggataaagagatttggtcatcgcacgccagacttgctcccatacttctaacctctttgatgctcttgaaatatgtatctggagcaactctcagcttgtcgaagatttcagaagcatcaagtgcactcgggccgttgttattgaagaacatcgcttgaacaattggggcagcagcgttagcaacctcatctcgggctccttcaagttttttgatcttgccaaccaggacgtcgaattgagcttgagacttgatattgcggtctgtatcaacagattcacattaatgagtcagcatttggaggataatggcttttgaggtattgattgttgataccttcaacttcctttaaagccaagtctttttgtcttgctagctctgccttgtcattctccagagtttaaatctgcttctctaactgagatatcttggcagcttgcactacattgatcacggttaatcaagattgcaaagataacagtatgagtcagttgagcagagtttgtgcataccttttgacgagccactcagttcaaaatttgattcctggagctcagcaatccgatccctcagatcatgttcattcttcctagcaagttcttttgcttcgtgcagttgattcctggtggcttcgagggttccgagatgagggactaacctctctaaggttaccgttttggcttcgttcctaagatgaatcctctgcaagacagtttaattagcgcatgaattaaatggcaaacaagatggttgagatcaggtgccagagagcttacatttacaatgcaggttgcctgaccaagtgcctccttcagtaggcataactcttcgtcctctttttgcttatttatcacgatcccttgaggctgcatgttgtcatcccaccacttgaccagaataggagggcgtgaatcctcagctgcttgtatccggaggatttcttcttcatcaccaattattggccctagtgtatccatgaatgaagatgaagcggtcaaataaagtctgttggatcaaaatgatttcagatagcgtgtctacctgtgatgattcccggtcggggacgagtggactttggtgtcttcacaggagatctggtttctgattcactgtcagcatccttcccgagaggcctgttcgtttgagcttcaacctcgggaatcttttggcttgaccctacatccgactggtttccagtcgggggctcctggttagcgccaacttcagcttcggccgactggttcgcagtcgggggctcgttgctgggttctacattgtcggttgccggttgtttgtcactcgggcaatcctctgcagttggcccggtttcttttgaagggtttgcctctatgtcagccggctcagggtctttttcagaaggatctatgtcagacggcttcctacgaatttgagttatgttgttagtattatttcaacagcgggtaagctgcaagacaaggaagatggccaaatgatttgtacctggaagattttctgatttttggcaaaggacgactggaggttttcttcttcggattagttggcttcgggggttttccggtcgctcctttgtctccgagccttccggtatcatcgccttcgtcgtcgcttagaactagcttcctcttgcaagaatctgactggccgactggatcggaagcacttggttgagcgtcagaccgaatttttggtcctccactcgcctgaccagtctgctggcaaggtgatcggcgttgagcaattggaggatccgatttcatcaaggcaaattcctgggcatgatattttgaattttcaattagcttaatagaggacaaaagcatacttttgaggaaggttgaaatgtttgaatgcataccggtggaggagggttgaatgcattgaatggcacaatgggcagcagatgtgaatagctgacaacaatagcgtttgagaagatcttgtacattctttctttcatgaccttaaagtcaagagaatctggatcttcctgatttggatcatgcttgccgtcaaactcaaaagccgtgcgggatctctctttgattggagctaatcgacttttgatgaagtgtcgagtgatctgttctccctgcaaaccttgttccttcagttttagcatgcgttccatcaattccactgcctgagcagcttcatctcccataggcaatgagttccatgtgtcctggtaaaccggaggaagacaggaatactcgggaagtgcgggttcaggattttggacgtaaaaccagtttgcgtgccagcctttgtgtgaggtcttgaagggcatagagaaatacttttggctcagtgttcctctgagttggaaaccagcgcccccaaccacacatggtttgctcttattcggttggggcttgaggaagaagattcggcggaataaggcgaaatgaggcctaatgcccagaaaagcttcgcaggcatgaacaaaattggcgatatgcactatggagtttggattcagatgatgcaagctaatcccgtagaagttcagaatcccccggaagaatcttgaggttggaagagaaaatccgtcgtagaagaaatgagcaaataccacgatttcgtgcgtgtcgggggtcgggaatgcttcgccgaacgccggtcgccacccgatgatttccttcgccggaagaacgctgtgcgccaccatttccttcagattatcttctgttacatcggagggcgcccactgactctcgaagctttctctttcttccgccatgaatgtaaactggatggtttaatttggtccgagatatggctagagtggaatggggaattggagcggtggacgcggggagaaattttgtgaagtttttgagggaggattggagcagattgatgaaccctaacttcgtcggcgcggttctgtactgtagcatggagcggggaatggcgagagtctcggcggggaagacgaaatgacgtttggacttcggtgtttttagggtatcgggagtactaatgggcctgggcctgtacggtacttcagcccaattttgttttcagcgtggcccgttgtgatccctagggacttaagcgctttttgctttggcaatatgtgctcacaatgatgtgacccgatgctgttaaaatcttttttaacgcaattcaataattctttggaattattatgatgcacataaaaaggtacccgacagaaaggtgttatactatttttgtaagcttttttaggctacaaaagctgttgggttaatttgagatgactgatttattagtagtcattctcctagcatgttatatgcttattttgattatggtaagggttatagcctaggctattaaacttcctaattgccatgatctttatcatatttggtggatcattttacgagtttcttactcagattcctatcaaatatgcctatttttggacctttgagtgtttatcactcggcccttcttgtatttttgttcttggtatgttcaagttgagaagcagtcggctgggtatcttactaagtaccatgcgtgcttcgctatataaccactcggttcttgactatatgtttagttttttcaactaatcacatagtcaggggctacacctaattaggtgcatctactcgatgcaccatgttttatttttgcccttcgtagtctttgattttagcactcggcaagttgaattgaagcactcggattactgttttttgtttcgagaaggctattactgtcaactgcgaaggtttcgggggctactgtggagattatggataccccatatctacacgacagttataatttagtcggatatatggtaccaaatatagatagaatatctctatgagtactcgggttagattctaaacttgtatgtcaagaaaatacccgggatcctagtcggttacgattgtattttatctgtaatcccatattccgttaggatatggactgtattttgtaaagcggactccttcccctatataaggagggtccgtgtgcctcttagggcgcgattcttttttcccagtttatacaatcaataacatactcggcggaatcatccccggacaggaatagggtattacttcttgaataagaaggcctgaacctgtataaaattctttgtctccaaacccatccactttcctaacttgatagccacccccttttattattgccgaaatcttgtttcgacagtatcccaaggacaatctatatgaaacatctgaaatttatagataacacatgtgaattcagagcaagactttagtactggaagttgtcgaataatgtcaatttagagctaacacatgtcaatttaaagctaacatctgaaattgaaaaataatgtgcactgctggaagactaacgagtactgaaatggtgtgctacttaatagggtactgaaattgcaaaatatagtgcactgctggaagattaacaaatacaattaagcatggttgaaatagtaaataagaaaacaaaagctgctcaccacaataaaccggtcttctgaattaagtaaattgtattcctctcccactcagtacgtttgataagctttgagtcggtcaaattcagtcactcaattttcgtaaattaagttaagtggtcatctggatgaagcaaactggaattcatgcaactttggaatgtagccacattttctaaatagaagcctactgattttgacatcaccatttcaccagatcatttttcggtgacgcctacttatttgatctttatataatttttaggttagtactataataagactgccatgttgcagcttccaggtagacattatttcttgccatgatgtgcatgatgcaattgagataaataaatcatgggcaattttttctcctatataaagacaaagatgaaaatatccccttcatatcacgaaaactgaaccctgattaatgattagttttcccgttgcaatgcacgggcacactattaaacacatacaaccacagaattggtgtccaaaaccagctatatgacacaggtatttttgccaaaaaaaaaaaacacctatgcctcaacctgtaaaatgaagtactacatgtcatcgtcgtttgcactaaccttaatcactgtcccattttatttgccaacataaaaccagctaagcttgagtgaacgtatccgccggtaggagtcagggactgtacacagtggcacgaatcctatgtacaataaaagctagccattttaccgcaagaaatatgccaagatgacatgttgttcataatagttagcaaacacacaagggaaacaggggaaaaaaagagtagaacctacaagtgaggaggaaccgtcgtcggcggtaaacagcaaggggtcccaagaagcaggtagttggctaacgacgatttttgattgggtagcttatgctcctgccagatgacgaagttagtgtgcaaaccaatcatgattaaaataaaaatgagtatattcaaaattcactcagaacaacccagaaatgatagggctgcaggaa

SEQ ID NO: 26372 - DNA, 1274 bp, Oryza sativa
tcctgcagcccttcataaatattcagacgaacatttatatatgttggcgcgatgtccttcgttggtcaaatgtatgcggaagcaatgtggggcatcggcggcgtctggcgttgccggattgagaggcaccggcggcgtttggcgaagcggtcggattgagacgcgtcggtggcattgatctggaggacgttggggagggccgaggaggaagttgacggagcagcttccgtcgaagtaggggatggcgccgttgttggtggaagggctcgccgtcgatctcgagttggctggcaaggtaggtacgaagccacgcggcgtcggggttcggaggcggcggcgtagtgggggatcggtcaccgcgacaaggaactgcgctccgggcgagagggattgcgcatgaggggatgggtggggggtcaccggcgatgatcaatcagcggcggcggcggctgctgcgctcgggacagagggagcgatgggagagagggagcggagattgcccggcggctgtgctcgggagagagggagcgcaaattgtgtttgcacgtgaggaaacggggatgggaattgggaagcagagagaggggcaatccgggaggggcggggtttgcagggagagagtatgggggaggtgggagtaacgtggagcgttggatttgattggggcgatcctgaccgatcgatgaggaatgaggatgtaacacactgttggtgaattatagggtagattactgtagaacggaaagagtaaagggcactaggcacgcgtcgtggtgcttgggcgattgtcccgtgagagtgtgagacggtgagagctaatgaggagcacggccaaccatgccccgccacaacgcaccaaacgcagcctggtgcgccgcacaccgaaacgacctaactaaactaggcgcggcacgcaaagctgccggacgcaagtgctcgcagaaaattgctgcgaaaaaattgccgtactaaataaaaacaactcaattcatcgtcaacatgctccactgacacaggtatcccacgagcaaatttatcacgagcattgctttatcttttttaagtcaaactactagtttgagttttcgctccgaattaataatttggacaagaacacagtctctaaaaacaattttaatcatatttttcattataatataaaagtattggcatatatatatgattttattacattactttttaagcctaatcgatacatgtaatcatcatatctgatagacaaatattttaaaactgatttataatcaaaggtt

SEQ ID NO: 26373 - DNA, 8299 bp, Oryza sativa
cgtacgggggttgctttttttgcaggcgacggtgacgcccgactcggagaagctgtacgactactgcgtctacgactccgacatcgccaccggctacggcgtcggcgcgctcctcctcctcgccgccgcgcaggccgtcgtcatgctcgccagcaagtgtttctgctgcggccgcggcctcaagcccggcggatcccgcgcctgcgccctcatcctcttcctcttcgcatggtaaatcaccatcactccgcttgctactactcgatcgaatgcttcaccacattaaccaaacaacattacgaatgctttgcctcttttttctttctactcatattttgggatctcgcgcctcttcgttgcttgcttctggatctgggttgctggtagtttaatctccgcggtaatttttagctagatctaccacttgtggtttgagcacagaacgcgcagcttcagttcagatccggttgttggtgggcaattaatggaggatgggatctagtggtttgagcagatctactgcaacaaatgcttgcacataagcatttagtgaggggaggatctagaggacaattattggatggtttatttatgctggattggctattaatttagagctcataaccattttgcttcagtggaccgggcctattgagctgttctgctcattcactacctaatcagttagtataattttagtctgaaaaaactgagcatcagttcgggcagctgttattcagaagcaaagaggttcttccttcagatctattaggtttactatctctttcatgctaaccaaaaatatattttaagcacatgactgctgcctcattccgctgattgttggtgaagggtcaaattgaattgtggcacactcaaagtggtgatttgttgtccacttataaggaaattagtactactatttttttcagctcgcacaagaggcagctttcactttatgggggcttttaactatttgccacttttagatttggcaaataactactccctccatactcataaaggaagtcgtttaggacaatgtttaagtcaaaccttgggaatataaatcatgaataactctcaagttgttgagtttgaaaatataaaaattatatgaatagatttgtcttgaaaaatactttcataaaagtatacatatatcacttttcaataaatatttttatagaaaaaagaagtcaaagttgtgttttggagaccgtgtcgctgtcctaaacaacttcttttacgagtacagagggagtatttgccacccctatctcaatgacatgtgggtccacatgtgtctatgacatgtgggtccagtggcaaaaagttaattgccacatctaaatgtggcaaatggttaaatattcctcactttatggcagctcctctgtcacaaaagctaaacagttaaaactccaagagtgggggagacttgttcacttttcttaggcttgttttagttcccaactttttcttcaaacttctaactattccatcacatcaaaactttcctacacacacaaacttccaatttttccttcacatctttccaatttcaatcaaacttccaattttgacgtgaactaaagctgtgcttttgcatttcattagtctcacggaagctctatatacaattgaacaattcttttctgggattttaaggtagtacctcccattcaagaatttatcctttcaaagttgcaatagtttacttgaataagtggtagatctactggacttctacatgagtggcctgcatatgtttaattgctactcctacattagtggctgcatatgtccaactgctacatgagtcactgcatatgtccaactgcctcaaatttacttgccccacaaagcgcaaagtgcttgtcactggttgctttgtactactactaggtacttcctccgtttcacaatgtaagactttctagcattgctcacattcatatagatgttaatgaatctaaacactatatatgtctagattcattaatatctatatgaatctaggtaatgctagaaagtcttacattatgaaatgggggagtaggatttaacagttgaactagtgttcctacagtaggtgcacacttgaactaaatattttttattttttaatttaacattacgcagacgttgataacaactattttgggtgtgttcggaatccccctttcccaactcacccctctctttttccgcacgcacgcttttcaaactgctaaacggtgtgtttttttttaaaaaaaaagtttctatacgaaagttgcttaaaaaaatcatattgatccatttttgaaaaaaaaagctaatagttaattaatcacgtgctaatggactgctgcgttttccgtgcggagagtttagttccaaactcccccctccagcgaacacagcctgtcttgttccgtgggtggtacctgtgttattaattagctcattgactttaaataaagtaatgagaccatgttacctggcctgacacagctcactatactagttttgtgggatcatagggagtagtatttaatagtagccatgcacttgtgattatctttttacaaattataattgatttgtgttgtttctttaatgaattgttaaattaattaacttggttatatggtcttccttgaaatcaacaattgggatatcccaaaaaagttctgaagtcaacatcaattgaaagcttgctttcttggtgtccttggctagccaaaccttcatgtagtgtacacctgtcatagtctacagccaaatgtcatcaaatctaattcccttcatcttcctgctctgacgatgcttgttgtgtccatcactacatatacttaatccagaactgcatatccatcatattctaggtgttccaatatgaacagatgtttcaacacctatggtttaaagatatactgatatgcaactgtcatccgttcaacagttttgttatgttcccttttcccggtgcttttcatgttctaatctattggtttttgattgaccaaagtacatagggtaaatggtttagctttgttctcatttctgcatttatttgaatttaactactactgcctgaatctgtaatatggaaaaattagggtatacgccaattaataagtcaaatcaaatgtacttgccataaaatgattactcaataagatgttttctgatcgttggcaggttgaccttcctcattgctgaggcatgcttgatggccggatccatccggaatgcgtaccacacccggtacagggggatgttcgttggcgagtccgtctcctgcgagactgtgcgcaaaggtgtctttgctgctggtgcggccttcaccttcttcacagccatcctcagcgaattctactacgttagctactccaagtcccgcgatgctgctgggggtgccccgtacggtggctccaacattggcatgggcacttacagctaaaaggagcttgctgaacaggatgatccggtccttgagcttgttggattcaaggtggagcatgtgatcgtggagtgcattgttcttgttaacacattaccttagttacggtgtaattggttggggtttactatcccgttaggttgtatgagattacttggttgggttgtacactattcggattattggattggattctgaacatggaatacacgtatcctagtatgatgatgcgctattgcctgctgacatggtcatctctcttgcttgatgtaatctgtcaccagatcttcactaatacgagatgctggtaaaatggaggtagcatggtagtcatgtgtgttattagttgacttaacgcacacattgagttatatgactatgtatcacagtttctggtcaaagtaaagcttcacaaattctgttttatttctggctaaacgaaagggcgttctttaaaaattcgtatcaaataatttactcatgctggatgcgacatttattcatctttagaaccataagagcaagtgctatggttgatgtgactaccatctctaaatttatttatatcattcacctgataaattaagagacaactcatacaatatgttaactctagtacacaaataccaatatatctaatactctcacgttttattcttgaaatttatgtggaggttatcacttgatttaggggtggctcattatctctcttctcacttctcttatctacctcatcactcaatccgatgtgacattctttgggacagtatatgtagcattatagtacttgccctgagggaactagaaccacctttcccactaaggctctgtttgtttcaacttaagattattgtaatctagattattgaaccagattattataagctggattataataaaccgacataaaataagctgttagttgtttgtttggattattagatgcttgttagctgttagccactcaataatctaaaataaactcctttaaagcggattactagattatagtaatctggctttatagattgtaataatatatcataataagctatctatttgtttcagcttgcttataataatccagattataaccatcctaagttgaaacaaacaggcactaaattgtactccttcattcgtactttttagccatttcaatttaggttaaaataaattttttcgcctctttcgtttatcttaaaataaatttaagagctaagtttcttatttgataggctaagtttctaatataaaatggctaccatgttaattcaagaaaattttggctgaattggtttgtaatgatcgtagatatgaagctgtgttcatcttatgctctcaatttagtatcttgttaatttaattttcagttttaatgtaactaatcaatgagttgtaattgatttgaactttttctaaatttagtttaaagcattatagttaaaaggtaaccaatgtatttaatatatgattaaaattttgatatttataatatactagctaagcaataacctattaggtaacgaggccatacatgcattttttttaaaaaaaaggaacttactatcaaacacaattttacatagaaaatgatataggacgaaattcatatgtgtatatttatctaaataaaaaaatactttagtcagtttatcgtatcttatactccctccatttctttacaagtcaaacttactttttatgtttgactaaggtttataaaaaaataataatattaaattagtttcattaaaattaatattgaatatattttgatagtatgtttgttatgtgttaaaaatgtttctatattttttataaacttgattaaacttaaaaatgtttaacttagaaaaaagtcaaaacaagatataaaaaggtccgttggccacggcactttgccgcctcccgtacgcattgcaattgtgcccccaacgcattgactagagaagatgcttcgatgtagatggtgacctgcgttcacctatagatcgacctcgatatccagacatcgtgataggaacggtagaatagtcaggacgccatatagtatagaccatattatctacgtcgtattggagtaaaatgtttttagataaattatagttcgagaaccacactatatatgtagttatttgtccacaagctgacaaaaaaaatactatcaccgatacattttctattttataattttacatatgtacccatggtttagacaaaagcttttaaaaccactgaatttttgaaaaaaaaacatattcaagtacacatgcctttcccttttataaaaaaagtagaaatgtcttttttttaacaaaaataccatcatcaccgtattattattaggcaaaatttgctacaggacactcaaaaatcatgtaattagctgagagacaccgcaaaaacgtgacactgctcatagacactatcaaagttgtgcaattggccgtaggacaccggacgtattattttattatttccagactgaaagtggtgagtttttttttcaaaataaccggagtgcccctgcgcctcaccatctatcctagacttgggtccccggtcgaaccaaacccggtcggattcgtcacctggtgttggcgggcggatgagcaccctgggcacaacaccggcaaggcgagcggagctccacatgtaagcccctctctccctctttgtttctagatggggcagcggagcggtgactcgtcgtgccggccctggcccttgcacacgaccgtgcagcgtcgtccctgccgaggcatcgcaccagcccgtgcctcgccgtgccggcgccggcgctctcttcctcaggcttgcttgaagaaatagcagagagagagagaatgagggagagaaaataaaagaggagaaattccctttccacaatcatcaaagaaccgtgttgaatcaaacactacaatagtgcaattccttcaaatccaccacaaattcagagaggaattaaatcacaaactcaaccagaggaacaaacaaatcaatcgtgtaatcactagcaaagctaggcacagccatggggatgcccacgacaaggttagcactagtagttcttgtcggcagtggcaagcttgcacttgaccttccggaacaccaccgccggcggcgcaagctgcagcttgagcgggcacgtcgcgggagtttgcacttggtgtagtgcgcctggtacctgacctcgccggagactgtcacctccaccttggattttgccttttcaaaatccagtatcctgtgtcccctagccaagataggttgtaagtatactgtatttgtttttgattttttttctagtaatcatgtgatacttgacataaatcagatgcaattaccatttttttcacactgtttttttctattctgttccaatgtagtcatgactgaggtttctgccttttgaggatgcttgagtgtcacaacggcaggactcttgttggatacaacacggtattttattcctttgtttgacattttttaatttttttcaccctatacatacattttttctgcttctaaaagctgactgtttgtatgtttctctttctcagaaggacaagcgacaataccgtgcgatgatttgccacaggctgttgtaccaccgcttcaatgatctacaccctcatcgcgtcatttgaagaactgttttttttttatcctttgttgtttgggggcaaaagtgccaagatgtaatgccaggtcgtagactcttttgtataggttccctcactgatcttgatacagtttgcactaaaactaaagcagtgtgttttgtagactgacactccctagccaaatagtatcattttgtagtttgcactaatacatgtgattttcaacttactaactcatatattgcttcgaaaaggtatctttttcatccaacttgatgttctagatcagcaacccttcttttaaaaaaaaattcaactatgatgcctatgatgtttttgccaataagtcaccatgctgtgccatttaccaggtacttaccacactggtatcagcatggtattcttttttagctaatcatttagcatgctaccatactggtaccaggtatcagcctggtaccatactagtattaggtaacaggtaccatactattaccagggtaacaccctggtatcaggtccatactggtgtaccctggtatcaggtaccaggtactaggtatcagcctggtaccatactactagtaccaggtaccaggtaccatactggtaccagggtatcaccctggtatcaggtaccaggtaccatactggtaccagggtatcaccttggtacctttttttacaccaggcacctgcatggtaccatattggtatcaggtaccaggtaccatactggtaccagggtatcccattttgtaccaggaaccagcatgcctttttttatcaggcagagcatattgctggtacctggtactagctagatgaaaccagggtgtaccaggtatcctttttagttagaaaaatatttttttggctcatagcacaaattcatatgcataactgcaacatgtcataacacaatgtacttatgttatagcacaaatattcataaacgcaacatatcagaacacaagtacacttttgtgcccacattcatcacagtgataacataattttcttagccacaccacaacaaagtatatcaaatattacaataccattgtttttttaaaagtagaagcataggaatgtttcattttttttgaagaatcacatgaactgtggggttttaccacctggtgggatcatcacaatcctgcatataaaaagaggacagtaccaaaatcatcaatcttcttctcttttttttgggcga

SEQ ID NO: 26374 - DNA, 13833 bp, Oryza sativa
cgccgatgaggtattgcccgtgcaagccgaggatgtagttggcgtcgctgacgaggtatcgcgcgtggtagcgcgcgatgccgaggatgtttttggtgtcgtcgacgaggttgccggccgtcgccgacgaggtggcgcgcgataccgaggaggatcttggtgtcgccgacgaggtatcgtgcgcgcgatgccgaggaagatctgggtgtcgccgacgatgttgcgggccgtggccgacgaagatctgggtgtcaccgacgaggtagcgcgcgatactgaggaggatctgggtgtcaccgatgccgacgaggtatcacgcgctccgcgcgcgatgccgacgaggatctgggtgtcgccgacgaggttgccggccgtcgctgacaaggatttgggtgtcgccgatgccgacgaggtatcgcgcgcgatgccgaggaggaacctggttttgcgccttgatttttggatctgggatatttaggacatatcaccgtaaatcgcggggaccgaatcgtaactaccatattaatgttgtctccttcgaacagcattccgttttgtagcgtctctcttttgatattgaagttgaaggtaagtctataaccgtttgttacccgaattggggcgcaaaaccgctccacataaaaggctccctcctaatagatgaagaataaatatggtagagaaaagagatgatgtatttattaatggcccactttaagaaaccatgggttgtaaaatatagtttttattgtgatgtcttattgacatggcatcatagacattacttatgaacactatgaattaagactgccctcatgcatcatcaacagcagcagcaaaaacagcgcgattttgctatatctcactcgaaagattttttcttatctctcactcgattttctcactcaaatttacagtgcattttcttataaattacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaattcaaagattaaaaatatgtgtgatacaatcataaaaatctttcgaaagatgtataggtactcccaaacagcgcgcacttcaagggggagagcccagctgacgtggcgtcacccagccactgacgtgtgggcccccaccccaccgcttttataacctcgccgcctcgcctcctcctctctatcttctcgctcgcctctccctctcgctgtctctcactcgcactcgcctcgctgccgccgccgccgctgcggcgcctctctcgccggcggggaggggaggtgaggtgagtgagcccgattccgcggcctcgtgagccgagcccacgtattgtcgcgtcaattttcggctgattttttccctttttttttgttgtgattctcaaggtttttcttaggtgtacggatttgatggcggtggcgtcgcggctcgcggtggcgcgggtggcgccggacgggggagcggcggggaggaggaggagaggagggggcggccggtggtcgcggtcccgacggcggcggggagggggagggggcgaggcggggccgtggcagcgagcccaccgacggaggaggcggtgcagatgacggagccgctcaccaaggaggacctcatggcctacctcgtctccgggtgcaagcccaaggagaactggaggtgaggagaggagattcccttgtgtttgttttttttttctttttgcgaaattggatagcttgtcactgcttcactagtggtagtggtaggtagttttttcctctacaaaaactaggggttggtagaatggttcgcatggagacatcattatcgtatcgggttcgatggaaatgtggaattggagaatttcctattggcatagcctaactcgctgctttagctacgcaattgcagttttagttataaatcgattgatttcgggctttctattgatgactgatgaactggtttatatggctctagtactctaatgttgtgcagacaaactgtttagtcttatgcgttgttaatgcaactgtttgatcatttttttattggtaattttagctgtgattgttatttctacctgatctgctagcaccattcgttgggcatgaaagttctgctggtgcctgcattcagtttttgtggcattggcaatgtcatcttgtttgttcaatttactcccgctttgtttgatatggagtattccagttagttattttggttatgccataaataaatttctgatttcacagaattggcacagaacatgagaagttcggttttgaagttgatacattgcgtcctataaagtacgatcagatccgtgacatcctgaatggacttgctgagagatttgattgggacaagatagttgaagaaaataatgttatcggtctcaagcaggtagtattctgctcttatttcccctataataccaccttacatgacttagaccaacaattaacgtggagaaaatttccatgtgcttcactggagtgccgtaattaactctaatggaaaaacaaacaaaaacattacagtttgttctgacaattttagtttgttccttaattcgaggtacttgtatatggttgcagggaaagcaaagcatttcactagaacctggtggtcagtttgaacttagtggtgctcctcttgaaacattacatcaaacttgtgctgaggtcaattcacatctttaccaggtaatgcgcactgcatccctgtattaacttcttgctttatgtgattttcagttatgatttgtgcattgccatgccatatatatcttcagtccgaaagtttttttttttgccagcagttgatccaatccgaaacgtctattcttgtaggtcaaagcagttggagaggaaatggggattggatttctcggaattggttttcagccaaagtgggcactgagtgacataccaataatgcccaaggtagttttggccttagaccttgtaaagctttagtttttgtatgaattcagtgtcgcgtacatatttaacttaacttacaagaagggttcctataaattttaatgcttcagttttttttctttatagggaaggtacgaaattatgaggaattacatgcctaaagttggctctcttgggcttgatatgatgttccgaacatgcactgttcaggtgagtgtaattatatgttcatgtactaattttggaattccatcttaaagaaacttgaaaacttattgttacttctctaaacaactttacttacttgagtcatgaaggttaatcttgacttcagttcagagcaagatatgataaggaaattccgcactggtcttgcattacagcctgtgggtacttttgttatcttccctgatcatttactttgccctctctcacatgaacctggtttattcatttaatggattgttgccatttaacagattgcaacagcaatatttgctaattctcccttcaaagaaggaaaaccaaatgggtatcttagcttaagaaggtgattgctttattgcttttaaaagtacattgttttgttgtatgaagttgccaacatcattcatgatctgcagccatatttggactgatactgacaacaaccgctcagggatgcttccttttgtgttcgatgactcatttgggttagtatatataatttcataccattcgaccctcttcccccacccagaacactggcaatttgattgaagacctcattttggccaaagatattttacacatgaaatgaaggtttccatgttactgaaattctgattatagtttgtttctttgatgcaggtttgagcgatatgtggactatgcattagatgtcccgatgtattttgtctatcgaaataagaagtacattgactgtactggaatgtcatttcgggtctcttcctgtttgtgttaccttagtgcttgttctgttatatgcagtagagctttggctatagaatacagaacttggttattaactagactaacttgatttatatttgttttgcaggattttatggtaggaaaactcccacaagctcccggggagctgcctactttgaatgactgggagaaccatctaacaacgatatttcctgaggtttgcccttaaatttgtatagctgatcatcatggcatgttgacactgtaagcttaatgtaataactatttgttcttttgtatttggcttgcaggtcaggctgaagcgatatctagagatgagaggtgctgatggtggcccatggaggagattgtgtgctttgccagcattttgggttcgttagcttactcctttgcacttcttttgtatttctgtacactttgcagtgtggtcttggtgtcaagtagaagtaaacacaaagagtttggacatgggtactgtagtaatttatatcttccatgttctataggaagaattttgaaccagttttggaattggtacttgtatacaggttgggctgttgtatgatgaggaatcactgcaaagtatttcggacatgacctctgattggacaaatgaagaaagagaaatgctaaggcgaaaggtatcttgagttatttgtgctctctgtccctgccaagttatataatatactgttgatccataaataaacttttgttttgccttacaatcacaccagttttaacagaattatacaatcttttttgtcagaataatttgtaaattagcaaagtaacccaggttcggaagttacaacatgctactagagtcacctcggccttactgtatttaatttgattaggtacctgtaaccggtttgaagacacccttccgggatggatatgtaagagatctagctgaagaaattctgcagttgtccaaggttatttactttcttgaatgtacattcttttataacacggagtgcatgcagattatatctgcctgtctgtaatgctcctttttttgttattccagaatggattagaaagaagagggtacaaggaggttggtttcttaagagaggttgatgcagtgatcatcaggtgaagatttcaacattccagcatctcttttcattgatgatgatataaacattttcatggttttgctgggctctagataataaaaatgaagagtttaactctgttttcagacaataattcgtagcctactttgttgcaggagtgaccccagctgagaggctgctcaatttgtacgagacgaagtggcaacgcagcgtcgatcctgtcttccaggagttgttatactgatgctgagaaacctcttacacagcaaaactggacagtctgtagatgtactccccccatacagaaaaaaaactcatgtccattctattccatgcctcggcagctaatgtccgccgtccgttttttcttgagcctgaagagggaaaaataaccgccgtgcagcaattcagcttcacggactcaattgtttctgcctcctggaacatttgagttcggaagcctttgtaggtgctgtctttgttggggccttttacaacttccgatttccctcgtcaacagggagatgggacaaaccactgtttgtaccagaccctcttttgttcctgatgatttttgtatgaaaaataagcccatctggtgcatgatggaaactatatatatatggttccagaaaatgttggaataagtatttgacaagcacgtggagttagttcatccagctaaaagaaatatcttgcagatgtaatggctggtgtatttggtggtctccatgaaagtgcctttttattcggtacttatatgacttgactggttgtttcctgctgccttccttttggacctttctatcaatctatatatgctatcctgataggtactcaccctgtcattttgttatatgacaagtaatcagatattactgcatggttttcctttgttttatctctcttagatcacatggctcttcttattattccctgtgcctatgcccatcttctatttatttttcatcaacaagctggtgaatgatgctgcataaacgaaatttcgtcgtcgtcgtctcaagaacatgatcaagtttgtgcattggtaatgtataagcaaaaaacaaacgtgtgcggcgtgcatgctctctgtccctagtcttctgaccaagcccgtcttcctgtcctgaaagcacgcacgccaccacccaccaccaaccaccaaccttggtttggaacatttcccttactcgcacctactccctttcacttacatgtgggacccataagcaagaggaacatatgtgttgtaaagaaacgggccaagatgtgcttaatcttatcatagtgttttactggaaataaatacgcttccaaaaaaataagtgcgtgtaaagaaagataccaatgctactagctagacattaaagacaaaaaggataatccccgcaaaaaaaaagacaaaaaggataatgaaaagcatataataatttctccatcgaaacatactatcagtagtgtctatatcatccacggcatcttaaaaactagagtgcacacggcaacactaactgctattcctttcgtcctaaaataaatataattttactaaaataaatgtaattttatattatttatgtccaacgtttgaccgtttgttttatttgaaatttttttatgattagtatttttattgttattagtagatgataaaacatgaaaaaaaatattttatgtgtcactattttttttatttttttataaacttttcaaataagacggacggtcaaatgttattattttgggatggaggtagtaactctcttatatcatgtcttatgtcttatctgtagcatccgagttaaatctttgcatatttcgcatgtattctcttcatattaactcaagtgatacatcaactatccgtggagaagatagggagggggtgagcaggggtctcgatcgcctcccctaagcccctaaaactacactacatttgttgtagtttttgtaagatttaaaaagataagtatcgtggatcctctccatcaaataaagtttgtgttttttgtttcgccactatcaacaatttatctacgtgacacaattagaagtgtaagtgacaaacccgcgaaactcacttatcgactaaaataaaccacgagtccgtttatcttgacctataaatagattcacggctgacccacttacacccttagacacaacagtaaagtcgttgaactctatcctagttgaagtcacatgataggcctatgatgccccatatttcagccttatccatatcatcaaaatcctacacatcaatctggtagaaagtattggttcctcgagaaaaagacaactgctcaaaaaaaatgatactgtcactgtttggtatttgataaattctgactataagttcttaatcttttattaataactcttgaaatgatataattatacaacattagacgtataaaagaaactcaaactaccgctatatatagagagatattcactctaatttaatactccctccatccatttcaggttataagacattttttacttttgtcaaagtcaaactatttcaagtttgactaagtttatagacaaatatagtaatatttataatattaagttactttcatcaaatcaataattgaatatattttcataataaatttatcttgagttgaaaatgttgctactttttttctataaacttggtcaaacttaaagcagtttgactttgaccaaagtcaaaacgtcttataacctggaacggagggagtattaaattttagccatcatatttattctcactaattaaaacgttgccagcaaaactatcagcttattgaaacaaaggacacagaaaagacgccgctgatgtggtgctggaaacgtgggtgcatgccaccaagatttaaaaactaaatttcacgaatattacatcatttttttcatctcttttaacatgtgttagaaaatacatttgtaagtatgtaagtttggtgttacacgtacagtggtggtataacaacgaaaaaaaaaacacctcttaacaccttttgtttgatccaaagcgtgataggcgatagccgcctccacacaaacaatcacgaggagcagagcaggcagccgattcgacacctaacccccaattccaatcccgtatttaatccctccaattcccaaatcatccaagcccgattccacccaaaccctcctctcatcgcccgccatgaaatcgctccaatcgttcctcgcacctcaacccgacggccaccgccgccgcccttgacggcatcggcatcggcggcgcgcgcctccgtccgtcgcgcgtcaccgcgtgcctcgccacgcccacgcccacgccgccgcccccgacctccgcgcccctcgcccccgccgcggccgcgcaccgcgagctgtccgccgcgagccgcgccgtggtggaggacgaggcgaggtacatcgtcgggacgtacaaccgctcccgcgtcgtcctcgtcgccggccgcggctgcaagctgtacgacgccgacgggcgcgagtacctcgacatggccgccggcatcgccgtcaacgcggtcggccacgccgaccccgactgggtcgccgccgtctccgcccaggccgccaccttcgtccacgccagcaacgtccagtacaccgtcccccaggccagtctcgaacgcgtcacgcccaccgctcaccacgtgttcgacgcattgcccaaccctctcgtcacgccaagctcaccgtgatcatttctttttccgcgtgcatgtggcgctcgccaagcgcctcgtggaggcctccttcgcggaccgcgtcttcttcgccaacaccggcacggaggccaacgaggccgccatcaagttcgccaggaagtaccagagggtggcgcgccccgacggggacgcgcccaccgagttcatgtcgttcaccaactgcttccatggcaggacaatggggtcgctcgcgctcaccagcaaggtgcagtaccgggagccgttcgcgccggtgatgcccggcgcgacgttcgccgagtacgggaacctagaggaggccaagaaggtgattcagtccggcaaaattgctgccgtgttcgtcgagcccatgcagggcgagggtgggatccatagtgccaccaaggagttcttgcaggggctgcgggatgcttgcgatgaggctggagctctcttggtttttgatgaggtatgaaacatatttcttctattactccttatgtttagtatgttgtgggttggtgttgattgagtaatcaatgctaatctcacaagttgaatccaaatatatataaaactattggtaaccactacacaatttgtattaaaacagagggaattgtacaaagtaaaagttgtttacatgcatttagtttagaccagagatcacactccataggaaccttcattttcatacttattcaaatcagtgcaaatgtccaaagctgccgatcatcaatgaacagttctgaaattctatgtctctgttgcattcagaaagggggcgctgatctaatctaacactcctgttacatggttactaaacacaggtgcaatgtggtctgggacgcactggttacctctgggcgtatgaagcctatggagtagtacctgacattatgaccttggcaaagccattggcgggtggtctccccatcggtgtagtcttggtcaccgagaaggttgcttcagcgataaactacggcgaccatggtaccacattcgggggaggccctcttgtttgccaggctgcattgaccacattggacaagatccagaaacctggcttcctagcagaggtggccaagaaaggagagaacttcaagcagcttctcagtaccaagctgagtggaaacgcccatgtgaaagagatccgggggatcggtctcatcgtcggcatcgagctcgatgttccagcgggtcctttggtcgatgcatgcttggaccgcggtgtcatagtgctgacagccgggaaaggcaatgttgtgaggcaatgttgctgattttttacagagtgaaatatatctcatcttcctgctggctccttcatcattttgtgctggtacaagagtacttgtagcgtgttcggatcctcttagtgtccagcgatcacacatatatttttctggtccacatacacattcaattgtgtcatcacttttaaaacatgtccacacagtatcttatccctttgaaattttttgcaggcacaactgtaggtttcattgtttatgtcataatgaaccaagaatttcttgttgtcatcatccaaaattagctgcacaaaatatgatccaggttccggcccatttattgttttgtatttggtagctctgtatagcatttcttgaaactcctcaaacattgcacgtgtatagaactttgagtcttgttcttccattggatagccagaccacatttttgggtctgtttggactgttataaaccgctgattgtcatccctgtcaagacaagattgggcaagtttctcatattggaagatgaaattcctgattaaatcagctgggtggacaaaatctttgaataatttgttcatgctctcactcctttgggaggtgctcatgaatgggaagaagtaatccatgaaaaaacaggggacccactttttcctgttatcatagaggtgttgcatatacttgttcccacacaactcatgtctatcaatcattgcatcccaacttgcatcaaattcttcttcgttcaaagaattatcaatgcatgacttcaagtctgtttcaaacccttccttgccgtttaacagcacaccaaggttagtactagcattcctatgcacatgccacatacagcgcctatgaatagttcttggcagcacttttgcaattgcaatctccattgttttgtcctgatcagtcatgatgcattgtggctcttttccatccattgctttcaagaatgtttcaaacacccattcaaaagtttcaaccttttcatttttcaggaatacacacccaaataggacagtctggccatggttgcttaccccgattatcggagcaaatgggaggttatacttatttgtgcagtatgttgtgtcgaagacgatacaatcaccaaatttcttgtatgcttcttttgaggcaccatccacccaaaataagctaccaaccgtattatccgagtccagttccatgctatagaaaaacgatggatcttctgcttgcaattcctggaagtacttgatggtttcagccatgtctccgtttgcagtagtccgttttctcatcgatgtcctcagattgctaacatctttctttgtgaatggtatgttacgcatggtaccatacaaatcagacaggacagacatgattcttctagtggggatgttgttgttgtgccgtaattctattagctcatagtcttcatccgacacgttacggtgtgattctaggaaccttagagaattggggctcaaaggaggatgattgtgatctaagtctactattgtcaccacccacttttcagcccttttaacgaccaccattctcgccttacaatcagttttccgtatgctgttgcacttcctggatctgcttccaatacttgattttgcattctgctccttacttgtgcgttcagaatagcaagcgaactcatatctgttgtaatctttggtgacattgcttcttttgcaactcgaaacctttctaccgaaacctcaattttttgcatacctattgtagtacacgcgtgcctctttgtctgaaaagaactccataccaacaaatggtaccacaggttgtgattggacaccctccatttcagatccttcagttgtagttgctggttctatttcaagtccatccccagcatcaacttgcaaaatactcgtgggtcctgccactattccagctttaagcagtgctgccctcagaacttcagcatctatatccttctcacccacacttgtagcctgctcattcacacttgtttcagcctccatttcagatcctccagttcgatttactggttctatttcaaatccatccccagcatcaacttgcaaaatacttgtgggtcctgtgactattccagcttcaagcagtgctgtcctcagaacttcagcatctctcacccacacttgtagcctgctcattcacacttgtttcagcagaaacacaagccccagcacccatgttttgaagatcttccattcttctttcaatagaactaactgacgaactcatacttttttccactcccccttcacattttgatagtgcaaaacaaaaaaaaacattaaattctgtacggctcaaattagacaaacataccattatcaggttagtaccaattttcatcaaacttttttcagttctacaatcagaagtaccagattactaaaaaataattatcagcctttttgcaagagcacaaacattgataaatgagcacaaaacataagtgtaagattaccatggacaatattaccagttttcttttttcaccagttttgatacaaatttagcatttctacttacagaagtatcaggtatcaagttttaaaacatctatctagtataaggtatccagttttaaaacatctagtatcaagtatcaagtttcaaaacatctagtactaggtatcaagtttcaaaacatctagtattaggtatcaagtttagatgaaaatacctatcaacgccgaggagtgttctggttgtggtcagcgccgatgaggtattgcccgtgcaagccgaggatatagttggcgtcgccgacgaggtatcgcgcgtggtagtgcgcgatgccgaggatgtttttggtgtcgtcgacgaggttgccggccgtcgccgacgaggtatcgcgtgcggtggcgcgcgataccgaggaggatctgggtgtcgccgacgaggtatcgtgcacgcgatgccgaggaagatctgggtgtcgccgacgatgttgcgggccgtggccgacgaagatctgggtgtcaccgacaccgacgaggtatcacgcgctccgcgcgcgatgccgacgaggatctgggtgtcgccaatgaggttgccagccgtcgccgacgaggatctggtgtcgccgacgccgacgaggtatcgcgcgcgatgccgaggaggaacctggttttgcaccttgatttttggatctgggatatttaggacatatcaccgtaaatcgcagggaccgaatcgtaactaccatattaatgttgtcccgttcgtacagattccgttttgtaccgtctctcttttgatttttgatattgaagttgaaggtaagtctatgaccgtttgttacccggatcggggcgcaaaaccgctccacatagaaggctccctccttcctcctccctcctcgtgtggcgtcgcttcccctatccccgctctctactttatccagggcctttcccctgcttacctccacccaccatcccccgccgccgccgccgccgccccagattcctctcgcggagacctcagcctcagccctcaggggcgcggccggtttagggtttccccccgccgcagaactggtgccgaggctcccgcgccgccgccgctgccgccgccaccgacgacgagggaggaggagaggcttagccctctcccgcagcgaccgcgaggtacgtgtacgcgcgttccgcggcatctggtcctggcctcctagatccgatggatggaaggatgggtggggtgggtgggtgggtggtttgggacttgggagtagacgcgttagggatcgatgcggtcggtttgccctcgggggga

SEQ ID NO: 26375 - DNA, 3890 bp, Oryza sativa
ggcacttttgggagagcacatttatttgtggggattcacccttgctggccgctgttgtgtcaataggccctctcaacttaaggacaaagtttaaactttgatggccctagatttgttgacactttgattggctgcaacctatagtttgttttaacatggaagtgatatggaaagtaggagaactactgacaatgacatttggctgtgatgaatacttgagtcgcagatatatgagaagttatgaatttaaattaggcacacctgttagcaatgccagccaaatgacacgatggattgggttaaaacctttgggtatcttaactttgtaggaacagtttgttcagatactagcagcctgcagccatattagttatcttaaattttaaaatttgattttctttggtgtaaaatctggtcaatttttattagacagttattatactcatcacggggtcaatacacacaaacttatcttaacttttagcgttcgttggaattacatgactgctcatttggacagtcacaatcttatttatgaaataatttacattactgacaaatatccttcgtgattctatatattgatttggtatttttccttcaaagtggcacttttcttatgtaattgcattcttaaattttaattgtgatataaagtactatttatgcaaaatagaaaattgaaatgctaaaatggattatgaattgctacgactcgtgaatactaaacagtaagatgtaaaatttagttttcttttgatgctgtcatgtttatccaaaaaaggtgtttaaggtatatgagggaggaacaaggctgcagagggcttgcagtggttgcttaacttggggaacttgcgatcacctcagttaactctctgtgggtggccgggtgcctggaggccgtgtggtgtcacccagacaacattgcatgataatcgtcttccttgtaggatgtcttgttgcttgggtgtgtcaaacttgctgtaacaagctttgggtggtcgggaagctttttttttcttactttcttacatcatctttctgtctttaactggtatacctaggtccacagttaagttgactgaaaaatctatatatattttttcctgttaccaattgtctttgagctaccaaccaaaccaaattattgtacatttcaggtgcagcctgtttttcattgacatgggacatacattagtgtagaggcaatattagagtcatatattggtaaaaagatttacaacctccattttatgatcagatgacctgcagaatggcagcaggcaagcaaaagaaacgtataataaggtctactaactcagatcaaaacaggacatggaagaagtcaaaagttgagtcttctaattgccatataagtttgaagtctcaaattgctcttaaatgggatgactatcaaaagagagtggttccccaaaaggaacaagttgggattttgtggtcagacttggcaccattcatagattccagacagaagcatgattcagggctgctgatgttacatatattcctccagagacattttccttggagaacttgagaagtgtgctgtcctataaggtgtgattagtttatcctttgtatgtaagctttgttcttttgccatctatttttcacaatgcctgccttttcgtgctaaagctttaattgctttagaataatgatcttgatatcttgatgccccattacaggggtatactcttattacatattaatattgacaattgtgaattgattataggtttgggatacatgtctgacagaagctgacagaaagtttctcatacagtttcttccaactgagattgatgcagaagaaaatgttcatttattgcttaaaggccaaaattatcactttggaaatccttccctcagctggcaagttctctatgatgtgatttctgtgatcacttccatttgcacttctagacattttagctgcattttttattgcgttctagtacaattttagaaattgcctctgtaggggcctacttgtttcatcttcattctagtgtatgttcaaaaaatatcaataaggtttgaaacaggtggatatatgcttttcctcgtagaactcctttttgccttgcatagatgtggcgtgattctccatttgaatattttattttattttgtttggcatattctcatgggaacaagttaggtatgttttacatccatcatagaagtcatgcagtttgtcccttattcattttgtgtttttgttgaacatataattgtttgtcctgctaaagctggggcttgggatgtgttgctccagctcacatgccaactctctttctaagtgttacgtaaatgtgatcagctttctaaaatattctacctggtatttatgtacgccgaacaattactagctccaatatgaatatatgattaatagaataatgcataagctaacataatgtcaaaatgtacttttgcatatcaaacaaaacctttaaattggatttcaagagctaccaaattgagggactatgactcattctggaaggctcatactaacaccaaaagccactgataccccagaatgttccctttacactcatcatattttgtaggcaatacatgttgatccacaccattaaaagtgatatagtgggctagttgctgacattagagttcatttttatcctatttcatgcataattcctattaggcatgtggttgcacacattgtctgtcacgtacatgaattacaatcgatagaccgttcatgcatgtgaacaatcactattttcccatttgatactgtatcagcagtattcagttgttattttagagatattattgagttgttatctatttccttagttttagagataagcatcccgtgggtcaactcatctataaatggggctggcatctctttctgtcaaacaaagacgaataaacaagtccctaaacagagccctggtcttccccagttctattacagattaatctagaatccctgcctcacatcaccgtccattctagttgaagttgtcaccaagcgacctccctccagcagatgtttactaccatgattgtccaaggatcatgaagtcctgtttatgatgcaggtgctaacagtaattttattatagtaacaaatgtaatgttcaaaaaatattacacactactaggatatacactctggagcatgagagaatatcgcatcagctaaatacagtaatttataccatacaataatacaagatttggtaggaataaggaacaaaagcacctaaattttgatcatgtataaactgaaatagaacaaagaaaaatacgtataagacaaagtcctcaagcgctctgagaggagtgctgaaatgagaaaaggacacattaccattaaaaattagtgcaaatgtattatagaaataaagcaataccaaggaaatcaaaataacaagaatattctggattcactgttttcatgtcctacctatgaccaatcctaaagtctttcatggagcaccacttcagcggcacgacttgacttgctggcaacagaagacgcaaaggagtgcagtgaaggctgcaacagtgagttgtttgggagacctggcctatcaggccctattgagtgaaagggagatgagaggagagctccactgggtccattaggcacagcaagtaataacatcctagcagtagaagtaatcgatatatgtagtaacaccatgatagaatagtcaactcaatgactagtcaatactagtctcctattcggtagatggtatctcgactcggctttacgatttagcaacaatgtttggatctaataatcttgtcttacctcgatgttttattttgactatgaagcaaagatccaattttttggagttgatcttgcaaaacta

SEQ ID NO: 26376 - DNA, 1207 bp, Oryza sativa
aataacagatatctaattttgaccaatcatatgtaatatactttactatatggaatatataattcgatgttctgtgatattaatgcttgtttaactttttcagatcagcagaacacagcacaaccttgttaagagcatgaagcagtctggtgatggcattaaaaccaagcatcttactcgtgtaattggtaaccttgataaattccatgtaaaaccatatggaacattaatagatgatgaacagaggagactgcgtgaacattggttagtaacattttaattttaacatttttatcttgtttttgggttcaagattcttatggtaaattatttgcatataggttgaacatatcctgcaatgatatacctgctgctttcgaggtccttaagaacaatagggtgacaacagagaaactgagaaatttacttggtcttgagctaggcgaaaagaatgtatctatcatgagaaaggttcgctgtgactaatcctttcaattcttgtttgaaagtcttttgattttccagatcaaggtattttacttgaatgtatgaaaaatatagtggatgatatcactttgttcctactactatgtgtcttgtatttttcatgtatcatatcatacacagcagcaaagttactattcgacatgatgttcattctaaaactctgttaccatgtgtataaaatactgatttgtaatggatctactgtggaagatctaaaaaattgtcattactgaagggaaattgctgtgcagtgttttcttactgatatgttgtagtaccttgtcattttctagagaaagttaacacaataacactcgattagttgtaggggttctacttatttatacggacataatttcctttgaaaagaaataattatttgagtactcaatagatgattatggtttatttatttttgtttatgatgagaaggcagaccagttagcaggcataacaaaagagcttggtcaacatggtgcctgcgaaaatgacggcagcactgatttgcaggatgctctggtagaacagttgtctgaagatatgttgcaaggtggtaatgatcattgcccatctcgtcaagattgtgatgatgatgaaaccaagcatattgaaacatctgctgaccatcatgatagtcagggtagggagaactctgatttgcaagcccaagattacaagggcaccagctgtgcagatagaa

SEQ ID NO: 26377 - DNA, 8293 bp, Oryza sativa
ccagttggaagcagcaacacagatggaagcctcttcagtgctttggcccagtacagactaccgtcatcgtcgctacacatgcaatctggtaggtccagccctagccagctccttgaaataaggaaccaagttcctatgtctggaagttttgttcctagaactcaaggcacaaatcttcaagctcctagtatatatggttacacccagaatctgcccagtagttcaagcagtcatgtagcatctgtaggttctctgaataacatgcagtggacaaacctgatacaacagaatcctggaatgcccaacttaacgaacaggcaatttcgaggtccctggaccagataaatcctgagactttagaaataggttgatttaggtacaatcgaggtgcacaatgagaagtctaggtagggctggaacagaatgattctgggcaccaactaacatagtgtggttttgagctgttctaacgttgtggcttcagaatatctgtacatacatttctgctatgcctgtatgtatatatctgggcgtgctgggagtctgaaaagagttggaaactaaggattcccattttttgcagttgatccgtttattttgcctcaataatttcagtcccagattccatttagaggctgtctcaataatttgtttcaggtcttggcctctcagcaaaataaggtttctcaggggaatgtagtagttttctttagttgtgaacttgtgcttgataggtatcttgttgattcctaagatgtaatgacatgaggattcgatttttattcactctatttgaaatgagttctctaacttagccatattttattttactttactggaatgtttaactgattttggtttgtgcactagacaaggctaaccaatatgatggttcatatctgtaaaaacgacgatgtctgcatttattttttcttgcatgcgctatcttctcaatcgtcataagaaattcaattcaaaggtattgaaacacgtggaaccattcgtttgcaggctgattcttggaagtcgtatgtcccagcctctgacttcatggttcgtgttgatgcttagcaagctcaagctgtccacggcgacggtggaatgtgctattctggaacgcggtgccggaaacaaaattttgttgaaattctgtcaaagttaatttatcagaactactagctgcatgtacaaatagggggcagatgcacaattgacaaacaaagtgtgaaatgtgtaatagcaagtaaaggtatggatgtattttcataaaaaatttaataccgtcaacatgtccatatccatcctccagtccaaagtgggagtaaaatttggcttcttaaaaaaaagaaataaaaaaacctaaaaaacagagataaaattaatgttggatattaaaataggggtaagaatgaaattgcctctttagaaaaccgtgttcagactagccagactagcaattgaaggaccagtatactgagagctcggccaattcatccattctagacttctcctactgtggccaattcggccaattcatccgtttggtagccaccattgctgttgtgggagagccggctaccacttgaggagagacatcagtgacacatgtgggcactatttatcctcctagagacgatgttgtgatgccccgtctctcttccatgtcttcggtagaccctacaagtaaaaaaaaaatgttctatatgttcggggatagcgattacgatattctagatgtctcgatctatttaaaggcgttgtactggaggttccctattagtatagtgctcttgtggtggtgtcctcatcagattgggttcgcttggacgaatcacttatttacggctcagttacctgtgttgtcttccacattgattagacgttagtcggcggtgaaacgagtgaactttgatcgacataatcatcagccgatgatttcgaagattctacttcatgggctgatgatttcgaagattctacttttctgatttacgaaaaagaaggaatatatatagctctagtaagctattgggagaaataacagttatgcatactcacgctaactgaaatattccctatatactcctgaaatattcctcaatcccttttatactgtggggttttgctcattacattgtctatcttcgaattttagttttgatctttattagagagaatccattatataccactaagtttgtcacggctctacgatttgccactgactttatcacattctataaaatgccaccgacttttacttaacttctactatttaccatcactgtccgattagcctcctagcactatataattttgtccaaatgaccaaaatacccctaggaaaaaaacttccataatttggacaaaaattcaaaatatcatattagaaatataagattgtaaaaatccaaaattttgccaaaaacttaatatctgatatttcagaatttttgtccaaattttgaaagtttttatcatatgggtattttggtcatttggacaaaattgtacagtactaacgaaggctaaccggacgacaatggtaaatcgtagaagttaagccaaagttgatgatatattatagaacgtgacaaagtcagtggtaaattatggacttgtgataaactcggtggcatataatagattctctctttctctcttactcctttttcatcagttgatcttaagctgaccattcatttctatcaaaaagtccattttacattttggtataaagaaacatataaatttatgtagtatattgttatagggtagaaatttgttatatgataatattataattactagcttagagccaatgtattgtaacagaaaacaaattgagtctctaccttattaaatcaattaataagcacttatttagttcaggcaatactataattttctttattgaacaagtaggtgattttgaaatttggagagagccaataatgaaacgggagatgactcattgtaatataatataatataatataatagtatagattatggagcccacatgtcagtggtagcctggtaaggatggtgtggaaatggatattaccacaactaacattttaaatagtatatatgagtttattatgcgatatattatttatttgtagaaatgactaaactagtattatttatttgttattaaaaattatttatgtatcgtataaatagatttcttttacagcaaatatgttgtattaattttcataaaaaattatggtcaactaacaaaagagtatggaagtgatccaaagtatgcaatggaaagagtaaaacttacggaaataaaaaggatgggcaaagtttatacaatacactgtaattagttttccttaagttataagatgtaattttgtaatcattattcatttataaaattatgtcgtagtttttttaagtaaaagccaaaaaaaaattattatgtaaaaaaaatgtcaaaacgagaaaataacggtcaaacttaaccgagcaatgtctctaagaaaataacggtacctccctcttcctctccaacactcttgtcggatccaaaaaaacctcccaaagatccgctaagccgctatcccatcctaccgcgcgcgtgcgccatcgccatgtcatccttcgactccgtcgcggccgtcgccggcgacggcgacgccgacgacgacgacgtgctccctcccgctcccttcgaccccgccgccgacggcgcccagggcggcctcggcgccctgcgccgtggccaccgcttcgccacgtcctactcgtccttcggcaccgccgcctccgaggacgacctggctggcgccggcgccgggaccgacggcggcgtcggcgccggcattcccctgggctcgagctcgaacggcggcgccgcgtatgggtacggcgggtcgggggacgtgatgaatggccacgtggaccagatcggcgacgtcatgggtggcggcgtggtggtcggcgacggcggtggcatcgacgacgacctcttcgccggcgccggagacggcgacgacgggcccgtcctgccgccgcccgaggccatgaaggaggagggcatcctccggcgtgagtggcgccggtgagtgtgctccactccgatcatcccataatctcccaaaaagcatcaattcgcgcgcatttcttgatctgatctgccgcctcccccaaagcttgatcgaaaaagaaatcaagaaatcgatgggtttaattctgcagccaaaacgcgctgatgctggaggagaaggagcggaaggagagggagcggcgcggcgagatcatcgcggaagccgacgagttcaagcgatccttcgccgagaagcgcaagctcaacggcgacaccaaccgggctcagaacagagaccgggagaaggttggtcggtcaccatcttcttctccgccattgatgagctgcacatcatacaactcgtgaactatcagactgacccgccatcatcgccatggatggtgcagctgttcttggcgaagcaggagaagttccacggggaggcggagaagcagtactggaaggcgatcgcggagatggtgccgcacgagatcccggggctggagaagcggggcaagaggagggagaagcagtcggcggaggccaacgccaaggcgaagcagcccggcgtggtggtcgtccagggcaccaagcccggcaagcccaccgacctctcccggatgcgccaggtcctcatgaagctcaagcagaccccgccgccgcacatggcgcctcctccgccgcagccagcgaaggacaccggcggcgacacggacgccaacaaggacggcgaggcagagaaggcagctggagagattgagaagaaggcggccggaggcgagaaggaggccgcggctggtccgccggtgaccgccgcggcggcggcggatgcgcaggcgaacaaggcggcagccgaggagacggccaagaagtgatcggacaaggctgcattgatcgacagccaaattgctacggaattcgtggactctgataaaattcagaaacagctagtatcatgcatggttctctctctcttctatgttcatgttagaataagagatttaggcgtaagctgttcctttctcttttgcatttttcacaattttgcatcatttatatattgagtcgtagttaggtgtgaattattttctccgttgtaacgcacgggcactcagctagtcactgtatatgtgtgcagcgaataactcggttggttgtcagattatgagctgataatcttcagtgccaaaagcgttcctttggattcgtaactttgaaatttgctttgctagttgcacgtagtatctgcacgttaattttcttctggattctgtatacttgcagcagctggctggaagatacgatctgaagcgaatcagcccgctagtatatgcagtgcaaactctgctcacacatactgttttctctgttcttcagttatttgtagatgttcgacagagttaagagttgttcagttttgcatccacacagcgtgagcatgagtgcgttttaccgacggttatgtttcttttggtggaacctatccatttaggtcgagtcttcgacccagcgcaagtacttcgatttatatggttatactttctccatttcatattataagattttctagcattgctgaatatggcaggggcgaagctacaaccattcatagggataagttgactcgaacgatgttttgcgaacctctcctacccctctttattttaccatctatgaccccagcaaagagaaaaactagaccctagtgatattactgattgttctgtcaaagcccaattagtgactaggaacgatactaacaaacaacaaataaaaaattagctagcacttatgatttatacatcagcccaatatacatataggattgagatttgggtccaaaaataactccacaaattctcttgttgcgccatcatattccttcgagcactttgtcccgcaccagcgctgcacatcttgacatcttatatcattttttttctagcagaacgaaaggcaagaatcagtggttttgataatctttggttcatttggtgtcttttacaaattaataatgtatggtttctaacaaatttgtagtcatttcattttatcataatgtattgtcattattttgtcttgtattttgtatagtcttagatcattaattacaaactagatgacatttccgagttagtgttggattccaatgtagcgatacgatatttttcaccaaattttaataagttttgatatagttttgtcgtgaattctaaaaaacattcaaaatttcactcaaaatatacttttcgtcccacgtcgaaacatcaaattacatgatttttggttggttttggtcaaaaacgtaaaccctggttaatactgaccccggtgaccatttatcctggcttcgcccctggaatatgggcaatgctagaaagtcttataatataaaacggaggaagtactacgtacctaattattttttcaatggtatgccaagtgtcccatggcagcaagatgactatacgtgtacttcatttgaaggatgagggcagctaccgtacgggattccgttgcaacgcagtagtcatgggataattaacaaaaccaccccgacagatttaataccagacttcgtcgtttttccgaccaaggtcaactctgctcgattccccatctagaacccggctgatacgcaactactcagagcaaccccaaccagaaagcagctgcgcgcgatacctcgccagtggcgcagagggccgccgcaactactctgagcggccccagccagaacccagctcagtatcgcgcgcctctgcgcgcgataccttgccggcgacgctccgcgacgccacaactactccgagcaggagtgcttcttcctccgccccgtatcgaggccccgaaccctcgatacctcgccggcaccgccagcaactactccaagtagggactcccccaagccagaaccccgctcggtatcacgcgcggaggtgtgcgatacctcaccggtgacgctccgcgacgccgcaactactccgagcggccccagccagaacccagcacgcctcactccgagcaggagtgctccttcgtcctcccagataggtatcatcttctctagtttttgggcatgagttttttttctctagtttaggtattagcttgtctctagtgtaggtaccagcatgtctctattttttttcaagctataatggtttgtgttctgcctgtgtggggccaaaaaaattactgaaaaaaatgtgtgaattattcatgcagttgcagtttcagttaaaaaatggactcctcggttggatccgctggaagaatgatagaaaagatagcaaatgaagggagtgatttccttggtgaaagaagtatcaaagaacaacagagtggcaaggaagatgtctctgttgaaagagcgatggaacaagtatcaagtcatgatgatgatgcctgatactgaattgaaagcttctgaacaattgtatgtatggtcagagaatgtcaattttgttgcacttgagacttaattttatctgatacttgtactgtgaggtgatcttggtaccttgttgtgagatgtacggagctggtcatgactgatacatgtagtgagctggtcatgactgtgtggtaccagtcatgatacctatagtgaccatgtgctgtaaagtatcaggtctggtgcctgggttaagacctggtaccttggtttttttgtgaggtaccagacctgatacctgggttgtttctaggcaccagaccctggtacctgtattgtgtgaggctggtacccctatcctgtgaggaaccatgtctggttcctaggttaagacttggtacccgggtttttttgtgaggtaccaggtctggtaccttggttgtttctaggcaccagaccctggtacctgtattgtattgtgtgaggctggtacccctatcctgtgaggaaccatgtatggttcctaggtttagacctggtacctgggttttatgtgaggtactaggtctggtaccttggttattgctaggcaccagaccctggtacctatatttgtgaggctggtacccctatcctgtgaggtgtcatgtctggttcctaggtttaaacctgaaacctgggttttctttgaggtaccaggtctggtacctagtttagacaaggtggtggtagcaggtaccatatgttccccagtaaccttaggttcagatgtggtacttggtactaggtaccaaaccccattgtgtgaggtaccaaggtaccacgtcatg

SEQ ID NO: 26378 - DNA, 616 bp, Oryza sativa
gccgcagcgaaaacggtttccagtcggccgcccaggcttcccagctgtccacatggcaacgcatcagctcggtcagcgggaagacggcgaacgattcgtccacaaacccgcacatcagcaggttgtcccattcgtcgtcgctgtactcaaaccgcagctcgtccaggtcaaacaggtcgcacccgccggcggcgcatccagcaccgtcacgatctggcgccagattttgtcttcgccggtgaatccgcccgccaggcgatcgtggctcaggtccagatcgatgcggtcggccttggcccgcttcttgttgatgcgactgccgctccagaaggcataggcctggtgctgcaggctgctgggcgtgctgaagtaggtcttgcgccacttcttgtgcatcgccatgccgctggccaccttgttgagctggtcgaacgactgcgtccagaagaactcgtcgaagtagaaattgccgtggtagccctgcgccgtgcgcgcgttggtccccaaaaagtacagcgtcgccccgttgggcagcacgatggggttgcccttgagctcaatgcccagcacctctttgacaaaggccaggatgtagccgcggaagatgtgcgcctgc

SEQ ID NO: 26379 - DNA, 5239 bp, Oryza sativa
  unsure (1)..(5239): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaatttatcctcaatggaaggactcaaggagtacacagagagtgaaatggatacagcatttgtcaggctgttgtacaagatgacttaagcacaaagttgaagtaatgtagaaaattaatatggaacggattgatgatatatttctttgtgcacaagagaattattagtacgatgtgagagccatgaaagctgctggagatttcgtatgtggaagaaaaagaagggggtttcttcctcatcatcagctgcaatgcatgttcggcagcaagggattttgagagagtttgtttcgttttccacgtacacgctttccgaattactaaacgatgtgttttttttataaaaaatttatatacgaaagttgctttaaaaaatcatattaattcatttttaaagtttaaaatagttcatacttaattaattatgcgctaatagctcacctcgttttacatatcttatcaatcttctcttttccattttacaaatagagccctttacttgtatggatataccattttcaccacggaatccgaaacaaaccgccggccatggccatgggcgccgccgccgcatcgattcgcgacggagaacttccgcccggcgatcgtccacgccggcgagtcgatccacgagaaccttactcctcaaggcatccgaggcgatctcgtttccgtcccctcgcttcgcttggcggttaggtcttctgttcttcagatggtggaaaatcggaaggcaccacatccaccatgttgattccattccgcgatgtgcaattcgtgtgtattctctgatcacttctctgatttattttttaaaaaattgcaccggatattcactcggctaagtgctatcctactctgcagtgatcacgcgatgcctcgaaaataattctgaactttctgaattcgcaggaacatctcctatctgcaattaggcgtacacccaggaggagcagctgagcctgacagggtttacgattccgagatggccttccgtttcaggctctctggcagaatgacagttttcgcgaaatccggtggaaagccagtagattccgaacaaatttcataaaccaaaatttaaatacaaattccttgagtttaccaataagctcgcgaaaatcggccggctttgacgaaattctgagcgaaatcatcgaaatttcaatcagtaactagaaaaagagataaactgaaattgttttcctttttttaattcgttattcttttctttcctacttcaaatttcagtaaatacacggaatacatcaatttttttgaaaatttatatcccaatagattctatgaatatcatactatttataagattttatttgtttttttcctttttttatcaattcaaatttgaatttggatgaaactcatcgaaatcttagacaacttctactttcgagccccgtcgaaacatcaaaatttcacggaattcaaccgattttcgttggaatcgtaaaccctgagcctgagatctccactttttctgattgaatttgcagttgcctcagatcattgagatcaccatggatcgctcgctgcacgaaggcccatgacacggcgagccttccttgggctctgggcagcaaggcctgctcatctggtactgctcctatacatccttgtctctctctcttagctgcttgcatgtttagggcatgtttagatccctattaagttttttctccctatcacatcgaacatttgaacacatacatgaagtattaaatataggctacaaaaataactaattacacagatcacaactaatttgagatacgaaacttttaagtctaattgctccatgatttgataatgtgatgctacagtaaacatttactaatgatggattaattaggcttaataaattcgtctcgcaatttacagacggattctgtaatttattttgttattagaatacgtttaatacttcaaatatgtgtccatatatccgatgtgacacggcaaaaaattttacccctaaatctaaacaccgccttagtatagttcatcaccaagtcaccggaacatggaactatgccacgttccttggtcctaggaacgccgttcccgtttcgagaacgtgggaacaatctcgttcccccaccccacgttaaaacataaaaaatgtagcgtcccgcgttcctcgatctcgttccttgtcccatcgatacgggaacttttgtgacgtaggtacattgtcatttcaaatattttctacaccattgcaattgcattccacttgcagaaggtaatcgaactgatagtcttttataaccttatttttacaagaaaagtctcattaccaacttttttttggggggtaagattttgtgtatgagagcaatgagaagttgattgtcctacatgggtcagcagatctacttttgtaccgaacggtcggttttgttatagatcctcttctttttacccatccacatcgaatgcatccattttttttgatcggtttctgcggtccatggctctagaatagttgaattgattgatcgaaatttggcatctgttaatagaataccgatgcaataagaatcattaacctaggaaaataccagtgcagattgctgccttttttgtctttcaaaaaggtttgaatttcgtgtgatccacaacttccaatgattttgtgtgctgctattaatttatcagcattgacgcgaaaaaaagtcgctcgataaattatgccatattttattcagtaggtcttcagtttcgattgagccatagtataatgcaatacaccaaatgcaaattcaacagatattttgcccccaaaatccctcttggcgcctctctgattaatttaagaggttcaatgatttatatgctttcccaagtccacaagcaaactgcacacggccccatacaaaactaacggtacccggagaatgaatgagctgcagaagaagaatgcatcaaagaatcactggaacatgtcaggctaattgccgggttaatgctggcttttgttttgggttctttcctgttctctcacgctaaccccagctggtaacagtcccggattgctgcgtcctaatcatgcaggtcacgtccttgattttggtttattttacgaggacgtgacaccatggcggtgcctgccaaaaaagcctccacttcgctgcactgctgctgttgactagcactagaaaaacaattttgctgtctgaaaactgcagaggagttgagcatgcgcatgttctgtacagtcatcatgtcgtaagagcttctagtaatctcatcgctctctttctaggagttcttggagtattgttttcttaggaggttttttttgttcttattatgctaaccatttctgcaagttagtctttcgctctttcagagatactatgcatttgcattatgcctctgcttctaacagtcgccatcaggttgatagctgaatttttgcttatgctactggggcctcccacctgaaatggtacgtttcaggcaatgagatttgatatgtacattagtatgagctaactctgattaaaatattaaactaacactgtttgaagaatcaaggcactttgaaacgagatgaagcattggattcggatggtagagggttcaagcatggtaggaagtagtataggatgtactaagattaaagagtgggtgttgtgttaggtctggggtctatacatggccacataggtagcgtgccctccttttccatgtttgttcaacatgagcatatttgcaattactagtagacagctgacaaatggacctgaaaaaactgagaaacttagctggttattctctcacttgtgtgactaaatggcttttatattgatcaattatactatgatatggacaacctgttgtactaattgaaatatatatttctaccaaagtgttggttatatagtcaaatttaacaacccttcctgatgtcagagctttgtcaagactggtcataacattggttcaaatgtatttggttttcccaatatgtttcttttgcattggtgatttgtgaagccttaagataggtgcattgtctggaacctaatcccagttcgtacaaaaaagtgattagccatttctagattaatagtgcgcttttgacatcaccgaccgaaaacgaggttagttaatagatgacagatttctgcaacagtagattgcttggtcctacagcagttgctgttcccttgttaattaacttatcaggactgttaactgtgtactaactgcatgcttcaggcgccatttgccatctccttgtgtgttgacaactccaaatctgacagctcctgaggttgatgtaagctgatcttttatcaacgcaattcaggagcatggatttcaatagcttggttcttacgagttgttcatgtgagcatatcactgtgtcagtgcttagtccccttccaggcacgtacaaatgtcaggggagaaaagttgcataatcatttatccgcagtaggaataactctcctctgcatttctgaaaaatgttatcagtactcgctgacatgtctgttatcatgagttgttcctccctttctttttattctttcaggagaaaagcctgagctgaagcagttctcatcatagttttcagcttggagtactcatcttcctttttgacctccgaggagaatgaaattatgcacaataactcaattttcagcttatccatctccatttaaacatgtctctctctttgccttgccagaagcattaaaatcatattactgttctttaacatttcagggcattgttcatgaacaatcatatggtcgtgcatacagtattggctacagttttacagctcagtttctcgacaatgtcagg

SEQ ID NO: 26380 - DNA, 3471 bp, Oryza sativa
tattccttctgccaagcatcttcttgttcgtgcttctccataaatctagacaacctaagcctgaactttttcttggataatgaaataaacctaagcatgatcatgcatctccgttctttatcagacaaaaactttttcttgagtttcttgtcgtaattcctctccttaatccagctcattttgatccagcaccattttgtggctgacagtgtgcatctcttgtgttgcagctgaaacacgcaattaagatcaactcaactgcagcaactgctattaacaaaggggctcttactcgtctaatcatggtcgtcacgtcttcccctgatgcatccatccgcttcattattttacaggggacgtgacagcattggcggtgccggtgttcgctgctctgcggcgtcgcctcaccgtcagatgtgcatgcatccacatcaggtgacatgcagaacacagttaaccccggtgatgcagagaaaagtgagtttagcttctttcttccatgaagtaggtgttgctgatggcgtttctcctcaaccgatttaatgggcactagtacatgcatcgcatgctaattaagcttcagtcatttgtcctaatgcgatgttaagaagttaaagattgttatcttttcggtctagccatgatataagcctatactgctatgagtacatatacatgcatcagagtagctggtgatggtgtatctgttgctgtcagaatttatttgtccaaaatttttggagtaggtttggtttatatatctgcgtcgtacgtatgcgacttgttcgaattttctgttagacaagagacgtacatgtccttgaatgtttctaatcatactacaaattgtagtggtacattcagcgtgactgctgctttcatatttttggaatttggagctatgttttaactgtttaacatgacttgtgctcttacctggaactaatttttacagaagttgaaaattggaacttggacgactagtttacatgaatgactttaaggagctgaggtggtgtcagcacatcgtaagtattagtcagaagttatgatcttacctccaggtgatttatacttctaaattgtaggtttagttgcttgtgtctgtaagctagtccttatcatgattaggttttaatatatatcaagtgcctgaacattatattatagtttgcatccatctctttttgagtcgttgatcatatttgtactggaacggcaactttgtactacccttcgtcagtgagttatgatcctgacagcaacagcgattgtgtcttctcagttgtgttaacccatatttcttgcatttttgtagcatatcattgttgtactctgatttgctggcattatcttgacaagtcatttggcatggtccaagtacaaaaaggcatcctcgtccatcatcttgtccatgtactccgtatattataagctgcagtaactgttagaactgacctgttatactgaatactaattagtataagcttgagaccattctgaatgcagtggttagtaatcggtaatagttaatactaacagaagtacatgccactgcaggaagataagtataagcatggtggagcagatgcagaggcatttctgttggcctttcccacagtttctgaaccagtaatgagaattaggtaagccataagcaaagcaatagcattactagtagttaattctgttcttctcctatctttagattctttcttgaagcaccagctgcatctgcaatagactaactattcattttgtatctgctatagagtactattcatttgtatctacatgtgacatgtgaatgaatcagcatgcatggagcaaaactgcaaaagtgccagatcgatctgattaatctatgcacacttgcacagttgatccagctaactcgtgcaaccactaaactactactcgttgcttaatgccagaacaaaatagatccttcaaattcctctcccccattaaaagatgccttttggagcctttgaaacctttcaaattacaattagtttagtaatcacaacctgttgctaactgatcaacaagatgcattataatctagggttgcggcttcaagaggattacagctgctgcactagggacaataacacatccagtgatcgtattgacgatgcatctcttatgaagtataccttaattagactaattaagctcaaagacatcctcttgtcgcccaataattaaacttcctcctctccctttcctaccatatggacgtcacgtctaatctgattagatgtcctgcctgatcaccatggcaattgatttataaagcacagtgacactatgccggcgcctccaaattgctcactaccatgagctctcactctcaaagccattgtaacatgaaccccacattaaccatctttgcaagtatcctacataacttggtctacattttttttcttttcttctacatctgaatatctgaaggtatctttctgaatttaacagcagaaatggcttgtctcctaagtttttgggagggattggggtctctacttgatttgtaataattttgcatgaaacctgcaactagtggtatattgtatgttaggttggttcttccctatcagacacttgttttaggtatgcatcttcctaacctcggctagctataatgaccggccaaaacctaatttggatcgtaattaggtttagtttgaagattttggcatttgtagattgtgttaggttgctcctatatatgcaacctcttgctttttcgtttgtggccccctctaacaaacccaaggttggcacggtttttaggctttttcggcaggacatgaaaggaacatttttcagcatgtccactgtctccactactgcaagttatctcagaaaggttttattctgaaaaacgcaattttattcgtatatggttgtaatatcactctaatcatatctactcaatctactccgtaataatcataaattttccatcatttcccttttatttgacaaatgaagtgattttttaattaggcctattgtggacaatatgatttgaactgttgaacctggtgtctcctctccaccaccccaccccacctagaggtatttcccctatataactcaattttttgaagatatgtatgtcaccatttgtctactgcaagttgatttgcaatactacatttttggaggtctctaaacaatttaacaaaatggacctgagaaggcatgattttaatgtcataagcactcggatccacgaactcgtgagctcttctaatttatttgactaatggattggcaaccaaaccccatttttttatgaaaagaatagtaatttttattaacaactgaagctgttcttatttgccataggaagttggaaaaaagaaacagaacatcttgactggaataaattcattctcttggtgacgggttcaattcgtctgctaactgcatttttgaactttacagctcaaatttcag

SEQ ID NO: 26381 - DNA, 350 bp, Oryza sativa
gtggatcccccaattttttagccatgatcaaccaacacttgatgtccataatccctcccattgtgatctgtccacccatatgtgctaagctcatcagaatcttggcaaacatgacgaagaaagtattgcccattctttgcaccaatccacattatcccagcaattagagacaacggggttctgaaatagaaatactattagcaagaagttgagagtgccaccatatcatcatcatacagcaatagaattccaactatgaggtggtaaggtggcaacattctaaaccagaaacaaaaacaatacgcattcaaggaatcaagcaggaaatataacaacatctttgttctcga

SEQ ID NO: 26382 - DNA, 11316 bp, Oryza sativa
aacggccgtgcgttttgtagtagatggtagcagttgtttggacggcaattctttttatgtttggagagatgacactgccgtcatcatgtctggctacacttgaacagttttgcttgcactcatagtcctctaattaaatactactacatacatggaaaaagaaaagaagtcttcttaattaaatgacattagtttgttagtttgagatgtgccattcgcatgtttgatcttatttgattagtggtaatggggcacacccaatgaaaatgaagtttcttcatctgttgggtgatgcagctctgaacaccactcattttgcaaggtagcttaaccagagaagattggataacctgagggtttatgtgggccaattagttcctgataacgtagtatcatctgcagatttgtggctggaattaaaatttgcagtagtactgaaggcagcaagcatgtgtgtgtgttaaattactttctttattttgctctccacaaaaacaaagattttatttgatggtaccactgttctgaagctgtactgtgaaatttacttttggtgtttggcaggagcagagaggatttggagtactaagtcggtgcaaccaattaatcaggatcatgcaccgacctagcttgttttgttcatctggcaccatatcatgagcaattaaatttgcaactcttttcacttttctttgcaagcaagctagtagaacatttcacactctggcacataagtttgctttttgtactacatgaacagtaaacatcactaggtagttttaaaactctaggatcctttttccttttttgactctggcaagttctttaattttcttgaccctgggaaacgtgttgttaagctttttaaacggtcttctcattttcaaatacattatcactacatttggtcgggtagcaatcagtggatgggcaatgcttttgtttcaccctatctcattgagattaactgcatattcaaaccttgaggtagaatcttctttccccaaaaaacaaaacacacacaaaaaaaatcagagaagtgaatcagtcctgagatcttatcttctcctgcctgaaggctgaagcagagtgtagttttctttgatgtaagcatggtataagaatcacacttttcttgttgtaacatttgaaatagttgatgacactttacaatttcttcccctcaaagaaacactgccctgcatcttgcatgtcagtgttgcaatgtaccgttgcattttaatgtatgatgttattgactatcgaacttatgtttgataatttgtcttattaaaagattacgtaattattatttattttgttgtgatttattttttttattgtatgtactttaagcatgagttatatttttatatatttgtacaacatctttaaataaagcaaacaatcaaaacgtatctttaaagttaacaatatcatacattaaaaaccgaagagggagagagaggatatactactgttgtgcaggattggttacaagtcagcagctagaaaagcttccctcctctcagtgggcaacaggtcacacaaatgctccatccactagggcaaagaagatcgaaccgatgcaaaagaggcctaacatgcacacaactgcctagtgcttagcacttagcagcagtaagtaggtcgcgacccagtgcagtgcagtgcaaaccatcacggcatcgatcacaattcacaaacctcctccctatggccgatcgatcgattcttcgctagtggcgtacgacgtcgatcgcgcgcgttgcgagcttgcaacaccagcaatttttgagcacttttctttgttgcagaaaagagaccgtcttgtggttcttggatggatagggctggattctagcttgattggtgcaagggatggaggagaatggaggaggaggagaccccagctgatgaacagcggactgactgatgcctgcccgcgtgccaaccggccaaaatgatgaataaaaacatacatatcgtcgtcgtttttcgtaccccagatctgtgacagatcaatcgatgcttatgcagttagagcaagtacaatagcaggctatacgctagctataaatatattttaaaaagataaaagaagagagagaagagcagcgggctacataactgtagctagttgtagcacggactcacaagacgtaatgtgtgtatgatatgtgggaccagatattaatattataataagcagctattgtatgaattgcctataaatgatttgaagttagtagtgggctacactattaaacttgctcttatactgtatgtgattttacgtgaaaaggtacaattcagatatagatggacgtgtaacgtataccggtttgacaccggtaacataatttcatcgtctgcttattagcttattattggcgacaactaaaacttaaaattcaaaacttaatttagttcgagcattaattttaaaggtttttttatcgcagtctatttttcactatcagcttttaaagtttattacaaacgacacgtggattttcgcaggatggacatgtgggaaaagggttgacaagtggtgctgcgtgtgtgccctacacacgggcccccggctcggccaggcaaagcgagaggagtcgagtcgtcggtcgttggaggagatgagagacgagaggccgagatggcgcgcccccgcggcggagtcgattggcgggcgagatctcgttgcagattgggtttttttttttcgcccacgcgacgcgatgaggcgcgcggccgcggcttatcgacaattttctccgtaatccgtcgcgcgatccacacacgagcacgatggacgggttgggctccacgttttggccgccacggccgctcctttttttttctttcccacggtggtcactcgcttctccgttccacatcggccgcgtacgtgcgtttttttgcgtatgcgtgtgcgtacgtgcggatggtgcgaggggaacaggaacagcaatggttttttgttttgttccttggcctgcaattgggcatgtgatagcaactcgcagttattgctgtagttttgtgcagtttttttttccgcagacattttttcgatagacagagaaagaaaaacagctttggaaaatactactccatccatctacaaaagttacacatattacttgtgtcaccaagatcaaggagaaattaaatcatcttctgttacaaaaatcaagaagtgaatacaaacatgcaaccaataaaatatttagatgactccttgagttgtaatcaaacatttaatttatctcttcatgtaagtcttgaatgcataaagactataaataagaacaacttatttggaacaactcaaatgtgaaatatatctaacttttgtggatagagggagtacgagtgcagtagtagtacgtacatggtccatgcttgattagtcgtctacagacagagaaaagagtaacgagagagagagagaggaggtcatctggtcagccggggcatagtaacagtaactcggcctcgtcgtgcagtgcagtgcagcgcatcggaatcaattcgatctcctttcgccgggacactactgctccatagcatggcagtgcaggccgtggcgcccatccagtagtagtaataaatcgaatgaatgcgagctgcgaaaaataaatatggggcgagccggcgagtcagtcgggcggacggaataaagaaggcgcggtcagaatccccgcacgcaaacggggtgagaagaacccgaggcgcgacacatggaaatcagtcgtatcgatcaatcgttctcccccacccgcgcacgccgcgagccgcgagaggcgcgacgtacgcgagagaccgcgaccgcgaaccccaaacccaaccacaaaccaggcggcaaccactctcccaacgccaacaccaacgccaccgccaacgccaacgccgccccgcatcatctatcaaccgccggccgaggtggaggtgagttcacccaatgcgccgcgctatgcgtcgtaggcgcgtcgtggtggatgcggcagcggctgacctgcctcgccgctaagtttttctttcgcttgtcgtcgtcgccgccgctgggttgggttggtggtgcatgtggggtacgtacgggtgggagtcgagcgccgaatctacgacttgcgcgcttactatcacgtgccgcgcgtcaccagaaactggagacttgttcacgttcaaggcgatttcttcatctcaaagactatatatcatcgttcgatcgggtatggtttcagagggagtgactaatgtagctaattaagatcgatcggccccaaggtaggtagacaaacacatgcccacacatcatgggtgcatcgtttgtttgtttgttgatcaggttggacgatgaacttgagtcaaaccacttcaagtatttttcttggattcattgactactccaaggtcgtaacaaattcaacttgcaccaaattttgccaaattcacaaatacggtctatttgtctttatgttgcttagagaaataaccagccagcctcgtagttccctgctctaattaaccacctagttcctcatatcttcatatttgtaaattgtaatcagacttattgcttctttgattacctgatgtaagctctgtcgaggggagcttttgtcaattacaacttctctagctttctaaacagtccagattattatcggattctaagaatacgttattaagaatttaaaaaataaattagaagccaaaagctaataatcccatcttttttcatattttcaccatctagctactcactagccgctttatcaaaatcttagggcctgtttggggagcttctagctgctgcaacttcttccagaattagaagctccccactgaaataagaattgtgtcccataaaactccaataccccctttagccctttttattagatatcttttgtcagaatttttaacagttcacttaaatctgtcttaaacgctttttttcgcgaacatgcaaaaagatcacacgtcaatatattagaaaaaaaaaggtttagttacacaaagcaacatgacagaaccgaccactgctgggttacaaggaaaatgaatgcgggggtgaagaaaaaaaaatgtaaaattgaagctgaagctactgctcctatataaaggtagagaggtggtgaaggaaccccctatatatccggagatttttttttgttggaatacacaataaaacatcactggtatgtttgtgttaactataaattgtgatacagttgctctcaaatagatatgttgctaggtacaatcaaactattctagtgttaattatcaatttttttaacatatgcctggacaagaatatttcttcatgtaacattatgccattctgttatatatacaataaatctgtactcccaacacgcaaaagattcgagtgtcaaccattttcatccaaaattatgtcacgtgaggcctggtgccaattttttatatgacctggatatttatgcaaatatatttctggtcctaccaatattgagactacccagtagctggaagtgttaattatacttggaaataaacgcattgcataaaaacagctagtattaccactaacctttccatctccaaaatcagtttaacatcgcctaatccacgtcggtttaccgccatatccgtttaacagttccctccgaccttttagtacagtttagaacaatcaataacgatgcgatatgtaccaagtactaccatccatccacaatatcgttactgaacaacgtaaaagccgtactacacgatcaatacgaaagtgaacctgtccttatattttctagtagtatttttttttcttccaaaaaaaagctgcctttcaaaagcccagcacccggtgtttccccctcaaaactaggttattactcttactccctctatttcaggttatacgatgttttaactttggttaaaatcaaagttttttttaaattttttttaatccgagataaatttattgtaaaaatatatttaattattaatttaataaattgattttgtgatgtaaatattactatatttgactataaacttaattaaagttaaagcagtttgactttgatcaaatttaaaaacatcttataaactgaaacgaatggaatatttactatttgcattattcggcaggagaccaggagaaagacaataacaaaaccgactagataaaaacacgatataaaaaaaagaacagtattccattctgggtcactgacatcgtgggcccacactctgactctctccgcatcggttatactacgcgcccaacctcctatataaaagagtctccgcttagctatctctttaacacaaagccattacccaaacccgcgctccgctcgctctccaccgctcgccgcgcacgcctcaccggagaccagcccgacggcggcggcggcggcgtcggcggcagcagcgggagcttggactgagatgaggacgaggagtggatctctctaccgcagcggcggcggcggcggggagacggccatggttgggcagaagaggaagaggtcgtcgttgccgccgcagtacgccaccgccggtgactgctgcggcggaggaggccgccggaagaggctggccggtggtggcccggattacctcgacgagctccccgacgacctcgtcctcgccgtgctctccaagctcgccgcctccgcctcctccccttccgacctcctctccgttcacctcacgtacgctcgccgcctccttgtctcgatcgattttgcctttgcccggaaaacaccttcgtcttccttcgaattacaaacgagtccttccgctcctctcaatgctgtggaaagagggaccgatttgcaatttgtgggaagttgtggggggtgaatgggggataaggcgaatgaatgaatgaatgatgatggccactaaccgaggcgtctcgtctccctatctttttgacgacggcttgcaggtgcaagaggctgaatgggctggggcgccatgacatggtcttcgcaaaggcctcgccggcgtcgctcgccgtcaaggcggcgtcgtggtcggagcccgtgcagcgattcctcaagctctgcgccgacgccggcaacctcgaggcctgctacattctcggcatggtacggcgccgagaaccctagattagacgtgtggttgagctgtgccgatgagatgttcgatcgaggtgctgatgggtgttttgtggctgtggttgcagattcggttctactgtcttggcaaccggagcggcggcgcggcgctgctggcgagggcggcggtcggcgggcacgcggcggcgctctactcgctggcggttatccagttcaacgggagcggcggcgccaagtcggaccgcgacctccgcgccggggcggcgctgtgcgcgcgcgccgccgcgctggggcacgtcgacgcgctccgcgagctcgggcactgcctccaggacggctacggcgtgcgccgcgaccccgccgagggccgccgcttcctcgtcgccgccaacgcgcgggagctcacgctcgcgctcgccgccgcggcgtcgcaccgccccttcgccgccctccccctcgccggcggcgccgccgccggcgccatcggctgcccgctcctctccgacttcgggtggagcctcccggaggcggagccccacccggccaacctcttcatggccgactggtgggcgtcccgcggcgtgcaggcgacggccaagaaacccggcctcgaggctcccgctgccgccaccggcgacagcgacggcggcggcgagctccgcctctgctcccacgtgcggtgcggccggagggagacccgccgccacgagttccggcggtgctccgtctgcggcgcggccaactactgctcccgcgcgtgccaggcgctggactggaagcgcgcgcacaaggcgcagtgcgtgcccatggaccggtggctcctcgccgccggcgaggcccagtgactcgccgccgccgccaactactcccttagaccaatcggtccaccggtttaacgctggaccgggtgtagccaaggcaagtggcagagagaaaaaattgaggaagctttttttttctttttttttcttttttaccgtttccatcgatgtcgtcttgtcagatgtacgtattccactagggaagaagagggtagagatgctacggatgctttttactcgcattattccttttttttttctcattccgagtaaactaaactctaaattaaattaaattataattataattataattccaacccctttaaaagacacagggggtttaaaactaaatcaaagaacttaatttttttgtcgtcttgtggtttggatttatgctgctgtgtggagggtacggacaaaggcagttcgggctgatgctgttcattaactcttaatgagggtgattaaccaatcttgattagatttttagattagcggcagccatggatgggaagccgtgcaggctgatgctgctgcagccgtttttaattttaatttaaaatttaaaattttctttctcgagggttgagacaggttggagttttctccatggctggttgtgtagttggacttggagagaggatcggaaggtggtggtagccaggtggtagccatctaggctaccgctaaagtgacatcaagcttttgtttttatttctaatttaattttgtttcctaggtcatggaaagaatacaagatggaggtgtcctcttttttatcgacataattaccacgtatatttgtatattacgtagtatatactaaggacagatatatacgttgtaactacttcctacctggtcgttcgttcgaacgatcaaaatagatggttatacaaaatacaactataaataataagtagatggtttacttctacggtgccttgaagatgagccttcttgtgcagagttggagtcaaagctgaagagagtagtatgtgattatccatggattaattaatttaactaataatatgaggataattgtagtagatggtgtttggttgtagtcaaggccggcctgatccgacggctggggtccaacactagatccgatctaagctaccacgcggagtggctcggagtagagtactcgtcgccgactcgccagcagctcaactgaatttaaacatggcaaatcttgcatcgcctcatgatcaatgcttgcttctcctgtgtgcttttatacactttgaatgctgatatcgtcaatttctacgtatttttctgtcctctgtgttctaaatcgtacgtttttcatattcatgctcgaagactcgctaaagcagggatggataccgtatttttcctatttctatattttttcgagccgcttagccgtgctactattatttttaagataataaaataacattttgccctttactcaacgagctacagtgattattacaaagtctatatataaagaaattcagcacacactgacatgatataaagaaaacacaaactaaacgagataacccaagatgaaagaatcttgaattactggattctatcattgatggagctttttggatggagtttgttttcgtgggggcatcgtgcgacgatggtggcgccgtttttattaagttgtagcgtgttccaattagcaagacaaggtgtgtgcatgaatcatatgggggctcttggctaatcggatgtgttcatgtgtagtacaactacatgtacatggtcccatgctgaattcagaggttagtttgcccggctgaatttattagtggatattgtgcaggagaagcaagctgaactctattattttgatcacaaattgatcgcaatcccagctgcattattcacaggaaaaaaacaaaagaaaagttggtgatgtccctgcatggggcaaacccttgaaatttccaactggggcagaagctgagactgaccggtagtacattgtgtctatagttgacacttgacactgcctctgctcaatttttcttccttttctcccatgcatgatgcgctcatcactgctagcttcgagtcaagagcccccaaagggacagattaattaacatctttgatactatcagcatccgataattactattttgtttgcactaatggtcaatggctaccaagggacagcatctcttgagaagtgtgtgtgccggttgccgtctgtctagttcttgcagctgcaaattaacctctccccaaaacaaatctgatgaaatgcgaccggaagcaaccaaacatgtagtttagattttgcaggagctgcacattaattgtgcctaccaaactgaagattttgtatctacatggacagggtttctacgagggaatcttcagagaaatggagcgcatctgcgtatgtgtatttgcaatggttgggccgtacagcagctacggttggtacctgcacaaaatgcttactgaatttcctcccccaacagtgtctcattagtcctaattaaccaacttggagtagtacttatcagaaattcagaaaattcagaatgggacacatggaacaggaaacccactgttttcttgcagtattagcttccaaaatgtcaatggtttggagaaaaacaggagaatcatatattcatatcacatgaggtggtgtggttgatagtatcgtatcatttttgtgagagatgatgagcaagaagtggatgcaaattggagcatgttgaggggtttgaccaacaccactcatgtagggtcaccttctccatgaccatgatccatacatatatactccatggcttatcattgctcagctgcagctttggcttctctcttccctcaccggcctctgtactttttgatgacacacttgcatgttattagtagcagttagttccctcatcacccatcaaggatcaagaatacttccattaatttcatgttagagttataccctaatggcttaattacaagctgtaaaatcttcaacctagtgagttgagaaaaatactttgagatccgtagggtaaattaatgcgatatgatcatcattagttcgtgcgatgaagctgggaaaagagaaaagagagatggggatgcaaagaaagaacaagaagcagctgcatacactggaataaagctgaaaagaaagaggctatatgctcatgctcctactactgctactcctctcgcctttctttctctccttttcaagctctgatttctacctctctctctctctctctctctctctctctctctctctctctctctctctctctctctctcttctttttcttcccccctgattcctgtgcatttgcaggtttgttgcaggcaaaagctcgcgtccgcagcgtgtgcgtggctgactgtttttgtgc

SEQ ID NO: 26383 - DNA, 45941 bp, Oryza sativa
  unsure (1)..(45941): unsure at all n locations
agtggatcccccttttttattttatgagcgggacggggttagtagctcagtataggagtagctagatacagtcatttgaatttgtgatagatgcttagggttgaaaacggttcacggaaatttcggatggaccgagcatcgtttcggtaggtaaaagtcgaaccgttctcaatttttttcatatatagaatttgtatttttaatttctttcagtgtcgtacctgtacaatcgctataaaattgttaaattggtaaaaattgatcaattcgttccggaacattttcacccccgtcagccaacttgccatgccctggccggccgacatgtaacattattgccgagtttatttgctgtacgaacagatggatcgccatggcagaagtgcagaagacggttgatgaagtagacgttggagtgcaggcagcaagaggagttcgttcaactaccccagtggtagtatttatgacagcgatcgatgcacagttactatacctgatcacgggttcatatcctctacggtaacaacactcacgcaaaataatactaagataatataatccacgtattagtgactgtaacaatagtgataatatgatagaggattctcaacccccgatcaccactgacagcatcaggcatgacactgttattacttctagctaggtgactactatatattttatggaatctattgaagtttataataataataacatgtttttctcgtggtttagatgtgttaataatccatgacgatggaaaaaggtttgaaacagtgggcatactgagattcaagaagggtggtggtgtcgtgtgtcgtgtggcagaggcatttaactttggaaatgacgggtttttcgaaagggccagaaaccgtagattttgcagaatctaacctctagtcagatcagaacagcggcgacgactacgacgacaaccaagcgtgacacagacgcgcgggcaatgcacaaaatcaacggccacttttaatactccatctgctacataatctctcaaagaaaacctcacgaaaagagcacgattacgcacgaaaagacgagggaaaaaacacaggaggcttcttgcacatgctctctgaataattttctctgaatattgtttccgtcagagctcgcacgaagctgcacgagaggcgtgatacgctttaatttgggcactgattaaataaatatactatactctatagattagtgtggccttttcactgtttcaggtagtaattaattagctcagctatgaccatgagggtaatgagcgtgagtgctagctagcttagcttagcttttgatatcttttggcaacaagtgcactcgatttcttctcttgatgaataaaacgaagaaattaatggaattacctttgcgtcgcggttaagtcgagcactgagatttgcaaaaaaaaaaaaaaaaaaagggcccggtcaaaaagggacaaggcgaaaatgagcaccaatctgacagtaacaacaacgaacaacaggagtcagttatcatctagtgcaccctttgacaaaaatgactcctgttgcagtgtacatactcatggttgaatctctgggcaatgatgaatctgcacaagattgcagtggctgacaggtcttgcaaaatcatctactgtcaagccattgcatatcaaagaaaaaagtagtgctagtttttttctttttttaaaaaaagaagaagaaaaagaatcagaaatactagtgggaggagtacaaggaatccaaggctgaaaagaggccaagaaaagcatcataaaatgctagctatatttcagctcacactatcttctgcacacttcccctttgaaaccaagcaggaaaaaaagcttgtcagaaaggaaacgggtagaaagaaattaaagaagtttgagagagtgatgaaaggatcaatttggtaaaaataaaaagagaaagacatttcagattcgattccaacatgacacaatgggtagagcaaaaggccaaaagaaaaggcaggagtagtagtagaaagacagcaaaaaaaaaaattcttggattcagcaaagagataaggcaatgggggtgagaaagaaagaaagaaaaggagaagaaaaggccattgcaccacatatctccccttcttttttcttcttctctttatctggatttccatcccactagttctcagagagcatcatctgctcaaattagtggagtcacattagtggagttgtgacgattgcaatggtggtgttactggtaacattacttgctcctcttgtcattgcacgtgcaagagtgtgtggcttaagcctaagctgctttcacaatccacaagctattgatctcatctaaggagaaagtttctttaatttgttatgtaataaaactatatcaattcaccacttaagtttggttttggaagtatctttttttctatttcagatagaagatctttatgtcattgaataagagaagaaaataaggtagtcagaattgcaaatggaactgaacatgctgaattttcacagttgcaaaagcatgatcagctactgcctcttaaccaaccaaccaaccaactagatatatactagtacaacatgtggtgatgttgatttatccaagtaaaatggattgtaatttgtcaccaaagaaagaacaagaaaaggaacatgctgaattatacacataatggcttgtagcttagcttgtcttggttgcaattgctgctgcagatgatgagatctgttgcaatggaaagagatgacaccaccctctgatgtaccaacaagcgtgttgtgaaagccacaatgctctaaaaaggtttgtaagtgggcgtttactcaggtttggatgatggagaggcagcacagcagcaatgcaatgcaagctgattagtaggaccacttaccactgacctgctagacctaacagtgaaaaggagattaattaagccatccacaagaagcatttgaaactttggagcgagctaatttaaggaggcgtcgccatcagcagccttcggttgattgctgcaacgagcttgagattttggagtaccagcaggagagtaacatgacgtgattaatgctctaatctctctttctctctctctgccttcaattagggagctagctagctacccggccagccaaagtaatgctgctcttgttaatggcaacatactatatgggttcagagattcagagtaggatgctaataggtttgtaattgtgtagtacctcagcacttgaatgctactgccctagatttttatgtttgcatgtacagaatgctggtacatccgattttttttcttttgaatgacctaatctcttaccatttattaccaccaaagaaagagctgctagtatgaaatggtcctggcaggttacttaatctgttgctgaatagtatagcaagagactgggggaaaatggtcctgacagcagcttgcttaatctgctgctgagttagtactgcagcaagagactggaaatggtcccagcagcttgcttaatctgctgataagcactgtagcaggagagtgagaccggccagtgattaaccagcagatgtcgagactgatcatatgcagaaatgaaagatttctgcagagtagctgtgctcatgttcttcagaggagcacatggaatgcagggctagttttcttcagaggtgaatgaaccaaccaaacaagctgaccactgttccacagaaattaatcatgcatggatcggatacaattggcaactaatgctaacaacaatcaccaaattctcatgtgcattttgcaggctatgcttgtgatgggattaaacaatgggagagagtactactactagtaaaaagtagcagtactgaaacagcgagaaagaaaaccctagtgctctgcctgcttgctagctatcaatggcgtgtgtgtgcttgtgtaccaaaaggctgcaaactccttttaaccacaccacaccaacacacaccagcttctgctgcatctgcataatatgcactagttgatgagttagcaaatcatcaagcaaccacacatctatcaacacatgcaaatgcaatctcaatccatggatccatctgcttgttttgttagcattgcacagcttcagggttcatgctgctgctgctgctgtttctctgaacttgtatctgaatctgactgaccacatgaggttggggccactgcaatgtatgcgtcgcatgaaaaactccaaagctagggttggattagaacgcacgaaaccggccatttcgccatcacgagcgagctggctggcaggcctgttttaagggtactactgtttggtgttaaattggacgacgttttagcgagcgattgagctgattgatgatgatggtcctgatcgatctctgcaaataagttttttgttttctcgggcctcacctgtttagcctaattaatgccacttaaggagcaaaaacatacatgctcaaatagtgatcaaattaaaccaaaaggttaaatgttcttttattgattctctgtctcgctaattaaggacagattggtaacaaccaagccgaatttgacttcatcatctcaagtagcgatcaaattaatccaaaagctaatcgaaaacttcagaaagatgtacgtaggtaaccaaattaaaatgccctgcctgcatgcatgtgaggcagcagacatgcatcaagtccaaaagtggtgagaagaggggggttggttgagcttttgtaccaccttaataattttgagaaattttttttttcagtcctatgatggatgagggcccaagcaaactgatcaagtcaagaacatgttgtacctgtttgctgtgagtccaattaatcagcttccttgctatctcagccaaagtgcatgcattaattcatgaaatgcaaatgcaatgggtgtgtgtgtgcgcgcgcgcgcgcgcaaagaaagggagcagggcaacccatgctggccaggccaccaacatgccataactgcttacttacaagtgcaaaaatgcacacagattgtactaattaaaggacatgcatgcagctaagctaaccagctcccaaatgattacccacaaaagttcatcagtctcacacccaagctagctagctactaaaaagacagatgatcgatagtgatacatatacatcatccgtcctaaaatatataagatatataggttaattattcggtgataggatcaaaacagtagttgtgtgttccaatttcaactcttggctgacagaatggctggtgagtcatctgatattcagggatgggctaaatgcaatataaaatactactatgcatgcatgatgcatgccatgcattgggttgctgtcttgctgatctgatgatcacaagctgagattgctgttcatctggatttatttgattggtactgcaggacatctcacatctgctgccactaaacaacaatgcaccagttcagtttgatgcatgaacacagatcatcacaacacactggggtcactggctgactgacacatagacacatgctagctcatgtatgcaagtatgagaagtatggctacagaggttgttggttgtgggtgcagtgcactatggcttagctgtggctggctgccactatcattgtttgaattagggttcatgcaggtacagagagagaggcggcgttgctgtcgatccatccatcgacctgcacgtcttgtagctaattaaggtctctactactctctactgatagagtgagtcctgtgtgttattccaaatgtccatgctggctgtttggttgttgactgttgggtcaacacatggtgcgttgcaccaagcaaattgaaaatcgatcggatcaaatgtaatcggtgcaagtgcaatgcatgcgaacacacggagttgtttgtatcattttcatgagtacacattaagctccgttttaatccagaacagtatttttttatagttttatgggaattaatatttttaaaatcttacaggaattaattgaattgattcccgtgttactttagacgagtgattgaggtttttctgtgaagtttcacgagaattgaactgattcttatgttacatacttacactagatgatcaagtgagtttttttctcctaaatttcacgggaattgaacagattgccatgttacattacacaccctccatcttagaaaaaaaaaacatctagccatatatctgaacatggactatgtataaatacatattgagaaattggtttttgtgtgggagggaggaagtacgagtgagaaggcttccaggttactcaagaatgagggcgacacggacatgggacggcgattcggggtgatgactgatgaagtgatgagtgatacaagaggcatccatccacgagtctagtagcaagcagcatgcatgtcgcggcgggtccggccggccggccgggggcggcggctactgtagcttagctgctcatcactctcacacgcatgcatgcagaggcgtgaggaggaaggaaggaaggcgttcgtctccgtgttccccacaccggcgtcagctgctacacctcccccactttaaggctgttttgtcctcaacaccccagcagctaatctaagctcgccgtttcgttgcgtttgcgtgcaatgggatcgagtgaatcatggatggaggagaccggccggtaccggcagttactacggctttgtttggaggagctttacgaagagtttaaggttggttctaactttttctttttcgattggaggagctttacgaagagtttaaggttggttctaactttttttttttcgattacatggcagacacacacactattacacacgtaacaccgtacttatccatccacgaatacattcgtaatacacgttaaaataacagaaaccaacggtacattcacgatctcaccaagctcatattaaaattttacatacacgtgagaaatattcgtgggcactaggatttaaattagatttggtggttaaagtcatacaccaataatcctattaccacatcactgcaaattctagaaaaatgaattatgggtttgtgtggatgagtttctgacagagtttagattgattataagaatatgtagttacataatttagggagtttttgaggaaggaaaataagaatattgagaagatacgtaaattagttgagtattaattatattaaacttaaaatatattaatatgacttttcaaagcaatgttctatagaattttttttaaaatatatcatttaacaatttaggatgcatggaaggaaaataaggaactaatcctctctattaacgaacacactcttataaaacaaactagtgctggtatgtagaaatcggatattttttgtttctctatattctaatcggctgtttctcataatatctactacctccgaaatatgattggttgagagtagatgatacgtcgagaaagtgtgtatagaaagttatatttggttgaggaaaaaaaagatcgaataagttgttatattttataacaaatttggatgttaaatgttttttttgacaggaaaaagagaatttggatgttaaatgttatatacatactttaggactactacccctcactacctcactagttctgacataggtacggccgggccatcacaaacacgggcccggaggctgagacggggatccatgatggatggatcggatggatggggccgaaacggatggactgttgttagcttttcttcatctcgcaggaaacgccgcccgcacacgcgcacacaagacacatcgtaccgctgctattactgctgcctgccttctacaacgtggtcgtggtcgtggtggtggtggtggtggacgggttttcagatgcaagcaaccgttgccaatcacttgcacaacaaaggagacctccaacagtaactgctgccgatgtttccccacacttttttcgcgaacgcgcaaaaaaattgcacgtcaatgtattagaaaaatagagttttttacatgacgcacttagccagaccagtttacgctaaggaaggaagaaaaacagacaaaaaaaacaagaaaaggaaaaaaaactcgatacgacggcagctctactccaaacagcgggaggaggcagagccactctacactcccaacaattccctaaagaaagcgacggccgctaacgaccacagccggccctccgaaaagatggactctaggaccactgagaccgaagagagcaaagagtcaaagaccctgaagttacgtctaccccacaccccactggcacactgatgtgttcctcttcctccctgcaaaattcatgctggattatcgtactccatctgtccagaaatacaatactacgagaagatggattaagttcatctgtccttgaatataagccgtttttgacaggtatccaaatgcagtactaccgaaacatattacgaatgattattccatatatatcctatttatagcttaattaccagtcaagaagcagcttaattcaagtaatcaaaataaggctccgttagtccgatcggaattttgcttgtaagctaaggctgatgattttacatgttccatcaagactgggagaattgttataagcagggcccaagttaaaccagtgcgctcatggagcggcatagggtgcagctgtgaggcacgccaggtctaccagagtagatcctggcaattcttttggagtgcaggtaagatggcagccctacatcgtgcctgccaacaggattccgacaaactccgaaaagagatgacatgataatagatcgcacatatttttggcgtaaaacaatcaggggtaatgattcaaggaaaacgatgttcccaacaaaaccacaaccagacagtgtgctgattacacaggttcaattctgggattcagacaacagctgagcattatgtgcttaataaaagaaaggatgccgttcaccatacaatagcacccagtgtggcagtatatataatgcagatagcattgataaaacgatcaaaacatagtaataatagtttttgcctcaaaacaataccgggataaacaagtatcaataagtgttgatttatgactcatctaaacctcatcaaagctggaaaaggatatcaggcattgaaaatctgaccaaactgtaacatggaaacaccagttcctctccatgattaactagccactagcaagatttgaagtctgaggcacctaacataggcacgctgccttctgcaggtagtgttggaagacgacccacctcacctaggagcttggggcggggcattagatttggcaagacccacccagacaaccatgccaaccccaagaaccacccacccgaagacatcataccagaagtcgctatccttcttcttcttccttgattgctgcaaaccaccacgttatcagtttggataagggaaagataaggggatcaggcaacagttatacatgctacagaataacgttaaaaatcaaagtcagctagcagttttcatcagaaaatatactcatatacccaaaggatttcagaatcacgagcctgacttgggtatgggttctttgcagggatggaaaatgtaggatcattgtctacatatattttaaaatctaccatgtgaaaattatgccaaatcttctgggatcagatcaatacaatcaaatcaatgtaagtaagataatattacttgggagtatattgaaccaaactactatatcaacttatggctaaaactgaaaacgcttagagtcaaagctttatgctccgagtacacaattgattatgcaggttgtcagaatagagcccagggactaattttcaactttctagcaaatgactacaatgagatgtgtataggccaacaactcaacaaggtagtaagtaccaacacagatatatccaacacaaagagttactgagatccttgcagatagattggctcaattgctcagaacagtaatgacgcgccaaatcaatttgtactgcctccctactactgttaccttattctactagttaataataaccatagtatatccagttcacaattgtatgtggggtgggctgctctattttccacaatacagattatcatctttgttatttgagaaatagtaacaaagccaatatatgctcaggaagaaaatctccaacttacattcatctctaaagagcacataccaatgtaagtgtagccaacccaaaacaggtacattaggaagtaaaaataataatttactaatttgcctactgaaaaatgcttaataagaagatgcatgcaagattcgaaaataggcagcaaacataacaaaaattgatagccatataaattttggaagaaaaaagagtagctgtgcaattcttatttctgacaggtaagagagtaaagtcctgcaatgttaagacagaatacccttgtattcgaggttgaggatgcagcttgtgaagcctgagatgccatttgcctatgaatctccatgtgcagttctggcgcctgagatttgaaacaaatagtgtaagtacagtatgatacaagcacttcttaacataacatctgcatgtattatagggcgtcaatctgtcatgactggagggagtacaaggttaagatgtgaagcagttaggattatgaaatcctttgaaaggtgtagtcagaacttgctgtaatcagagttgttaactagagacctcaaatgttctatttgcagcgtataaaccaatggtagcattattgtaacaaagatcgcacaaatagtgctaaacataaagtgttgtcagcaccttggatgacaaatccaatgacttcctgtaaagatcattcgcaggttcctacaagaaacaggactgtacattagtttccagataaaaaaaggcacttattttacagcaaaagaacatcaggaggctcctgtgacggttttaggccacacaacttcaggactgcaggtcagcctccaccatggaacaaggaaatgtgtttgcggaagcatactagcaaactacacataccacatcaacagccttctggaaacactgggttgccttttcaaagaattcattggccttgacagtgtctgaagtgaagaatccatgagaggtctgtgcatttcccaagcaccaaagcgcatccgccttcatgggatcaattttcagtgcttcctccagcttggattccgcatctataaataaaattaactggatcagtatacttcaatttgaacaaattgagtaacttctactgacatcaaaatacacaaattaatgtgcaacaaaactcataacacatgtgcatgttaagccaccaacaaagtactgttacttcaattgaacagcccagacggcacaagaacaatcaattgctttccattccaatacttgattatgcacccaccatattatcctacttcctagctaaaatgtgatcatactcttaactttaacaaagaatcaacaaaatacatcaagcaaacgaacagctcccagcatttacatataacttgataaaattatgtcagtaggcccaggaaaaactattcagtctgaacaattgggtgaagaatagcattcttctcattaatcatctgatgtgtagtgcactgctggattattgaatgattttgatgaatcccgtcatcatcttctttttttcatcccaaataataccttaaaaaggaaaacatcaaacatgcaaagttgtctaaactcatgaatggatagacaagcaccatcagaaaacagtagcggttcctaaactgcatataatgaaattgaatgcaccacctacgagtgccctaaatgtttgaggtactgaaatgaaaaaccacataaccgtgggtagaacagttatccagtcactaaactaggcagaacaagttgtgattaccttcccatgtcataccagcaggattttatccttttcttattgttaataaaacagcatgacaaattttcctttaagaacattgtaccttttactttaagcaaacaatatattaggtttgagcttttcaattatcatgagaacaaaagtcaatctaattgctaaggattagcttgacttgtagaacacgatttgcaaagatttggcccttccagaccaaccgaatccattaatgctgaataacacacacagaaatctcaatcccattggttacaatagcccctaggaagcatcaactccaacatctctacaagtaaacagtccaaatcaccgaataatccgcacaaccaagtttcgagatctcacggtataccttctaggcacttgaggctctcggggccgttccgcatctgcgagagctcgagcagcgcgcctccccaccgcgtgagattctgcgacgaagaacaacaaagacaaacccaccatcagatcggatcgcgtcgcgtcgcatccaatcagaagcaacccaaaccatcaggaaaagcaagcaagcaatcaagcagagtctcaaaaaggctcgaggcgaggaaggggcttacgtcggcgtcgtgcgggttctgttcgtaggtgaccttggcgttctggcatgccaggtcgaagaagaacatcctctcaggatcgctcatcgctcccatgtccatggcgtcgcgggcgtcgtcgtcggcggcggcggcggcggcggcttccgacgagattcgattcgggggttagggttttagacctctctctctctctctctcgatgttcgatttggggagagagaggaggacggaggaggaggaggaggtgggcgtggagattggtagttgtgggggggggggggatcgcaccgctctaccggagacgctgacacgtgggcccgggtcgatccggccccacctgtcagtgaagtgtaaacccgacgcgtgttacttgcgaaagggtccaggaggaaaatatctcccggcccagcccaccggtggaattgagcccatctggaaagcaatcgtcgtctccggcgagtgcgagagcgagagtcccggcgcgcgaaacacttgtcgcgcgcgaagccattggagaggaaggacatagctgagatcgcggtggcgcctcggaagaagaaggaagcattgcgcgtgtgtggaggaggaggaggtatcagggatgcaggcgaggagggaggtgaggacgaaggaggagcaatggcggggggaggagagggtggtggagagcccgctggggagcgcacggtggagcccggaggcggagatcgggatgagggtggaggacatctgggacagcctggaccagccgcagctgagcgaccgggaccggctcaacagctgcttcgacgccatcccggtggcgtcgttcccgcacacgttcgacggcgcgcaggtggtcgagatcccctccgacgccacgctcgccgaggccgtcgacatcctgtcgcgccaccggatcatcaccgcccccgtccgcaacgtcgacgcccccgacgacgccagctggatcgaccgctacatcggcgtcgtcgagttcgccggcatcgccgtctggctgctccaccagtccgaggccgccgccgccagggccgacgacctcggcgccgacgagctggcggccaagctcggcaccgtcgcgcttgagggcgccgccgccgcgagggcgcccgaccagcagcagtcggcggagggggcggtcgcggaggcgttcggcgcgctgccgtcgtcggacctgttcaacaagacgaaggtgaaggacatctccgggtcgttccggtgggcgccattcctggcgctgcagagctcggacacgttcctgacgatgctgctgctgctgtccaagtaccggatgaagagcctccccgtggtggacatcggcgagggcaccatcagcaacgtcatcacgcaggccgccgtggtgcacatgctcgccgagtgcgcggggctccactggttcgaggactggggcgccaagtcgctcaccgagctcggcctccccatgatacgccccagccgcctcgtcaaggtccgccacgacgagccggcgctcaaggcattccgcctcatgcgcaagcgcggcgtcggcggcatccccgtcgtcgaccacgccggcaagcccaccggcagcatcatgatcaaggacgtcaagcatctcctcgcctcctctgacgccaacagggactacaggtcaaaaaccaaaccccccctcaaaaacatctgcatctcctcgttttcggagtctcgtctttatggtgttgtcgtaggctcggcggcgaccggtcacgcatagcagaagccgttttggtgctagacttcactctcagtgatttttgcttgtgtggttaacgcatggttcttggatgtgctttttgtcgtgttttttttttttacttttatctatcttatacatttggatggtctccttcggtcttcttggggaaaaaaatgttgacagaatcaatcgaattgcaaatttgcaggacgctgacggcgcaagagttcatcgcgaatgcgaggcagagttcaggcgagaagcagatgaacatcgtgacctgcaagaaggaggagagcataaaggagatcatcttcaagctggatgcagagaagaggcagaggatctacgtcgtggacgagcaaggcaacctggatgggctcatcactctcagagacataatcgccaagctggtgtacgagccgcctggctactttggggacttcttcaatggcgttttccctctacctcagaacagcagggtctgaaaaccaaaacattttcattagtccaaattaaatcaggtttcttttttatcacttcattctttcgatccggtccttttgtgtagtatgtgatgtttctttctttgcaatttcctccttttaccctctagaaagatcaccttagtttgtttgtgttacaatgtgactaatgcatagctagcttatcataatgcttccacatgtggaacaccaaggttctattcatgttttaaaaagacgcacctggaaatctggaatgagactctgacaatgccagcaaaattcctgctcatttgtatcatgaaggcaacagaagacaagataccaataataattgatgaaaactgcacccgattacatcagttcatgaattgatggattaggagtcgtagcagaaggtataatgaaattgcaacaccacttcatgatcagagattgacaagtacatgatgataggagcaatgtagtaatttactatggtctccttttttatcagcaacaaactatactgcacataacaaatggctgtattgatataactactggtatgaattgtacataaaaaatgccaagcaccaaccattctttcgatgtcaaacaagtcacgagatgttacaatcaacaaaagatgagaaaaaaaaatgtaagaattacacagctcatggtagtgtccagtgtcctaaatttcatgtcgaaccttgatatagtcagcaccttgatagatcaaaagctaggtatccaattccgattgcttcgcaataccaaaaaattctgtttgcttgcagttcacactgcttcttctacaggcaaaactgatttttctttccatcttcggattatcaaaggtctttgcagatcaagctaccaatatagcgccaccaatgaaattcatgagggagttgtaactaaaatcattgatataaacatccctaaacagaaaagtgatcaggttggtgagcatatttttcaaggaaaaaaaaacatgcctataaaagtttctcctacaaattggcaagcaaaaactaacaaaattggaatattttttttctgctactattaacatgtcaacaatttgcctataaaggacaacatagcatgttaaagccaacccacggtgttagatatcttaaactctggttttcagttaaaatcatattctccaaaaaaactgtatatggaatctatacttctggttcaaaaaaggttgttgtttaagagccattttaaatatgtttatgatgatatacagttatataaatcaaggttgcagattaagaagcataaccaaccatggttcacatgagacattaaaaagcccatcattcagattggtagttcaagagttcctcagatcaatagatcattgcttgattaaattaactaaaaagataacacatatgcctgcagtaattcaatcgttaacaatatgaggacaagatctcatcgaacatttcaagttgtagcagcatacatcccaaaggctaatttgatgtgcagtgcatcactatgttcttgcaaaactaactcccagattaactttaacaacatacaagcaaaaagatcttgactgcaacaccttatagtaatctataaaactctatggaagtgcaatcaggggtttagtactcaccttaaccatcaaacatgactaatcgatcaagcatttggtcttctgccttcaaaaaaatctgagacctgattctccaaatcttcagggttgtactttatataccttgcggaattccttccaccctctagctgacctcggaaccttccaacaaaagaacgatatgctggaaggactttctctgagattgaaatcttcaactcctctcttaattgagggtccacaaccttccatgttgtctgtgtcttgtataactcctcgaatgccaagttaaagttcttgaacctttccttgagtgaagccttgagtgcacttgatgaacccattgtctgtggcaatccatcatctctcagacaagctaataccctcgtccatgaggacctaaggtaccctgtagagtaccgtcttatctgaccacgacgctggcggatccaattatcgccaagcaaggtcttcagctctgaatccttcaccttctgtacaatgtacagcagattgttcatcaaaaatatgttctgaagtgcctcatcctcatacagctttgatttctcctcgatcttggcctgtagatgtgtgatcagtatgagcacacactgccccagtggagtcatattcacgttgtcacctccattttctagctcagtatcccagtccttgagaagttggttcagtgagcggctatagtctgcaagcagtcggacatagttcatgacataccgcgtgagtgggtgaatctccccaccgggcaacgctctccgagatgtctccccctgtattgcatttgcaaactctgcaacggtgccacgcaccgcatccccaagcctcatgagtatccccacagcctcttccttgatgaaatcccttgcatcacctgagaacaagccctcgagctccggcaacacctcatccagcgcctcatacatgccaagaatgcggaacagcttctcggacgatctcttcccgattgcaattgcgtcaccaaagttgagcagctgcaggacacaccccttggctgcctcagtgaagcaatcctcctcggcttcggcatcggcggcaaagatctggttgcagatgcggcgctcctcagcaacaagccccctgacgacgaccttgagcgcctggatccacttcttcatcttgccgtcgaggacgccccattccacgcgctgcacctcctccaggctcatcttgtcgacgccaagcacggcgaggcactccatgagcgtgtcgcggcgcatctcgccgtagacctggcacagctccggcccgtagcctgcgcgcagcatgacgtccgcgatgcccctgagggcgccgacggtgtccggggagatgaggtacggggagatctcttcgtcggagacggaggccctgccgcccgcgccgccggactcgtccccgtcgccggtgtggctggcgaaggaggggcaatcgaggtcagaggcggaggaggcgaaggacggcaccgtgagcgagaggcggcggaggagggaggcgtgcaggtcctccccggcgagcggcgacatcccgcgggccagcaggtggcggaactcgtcctccagccgcgccatcgccgcctgcagcgccgcctccgcgcgcgcgccgcgcgcccccacgaggacggcggccgcgcccaggtaatcccccgcgtccttcgccgaatcgaacaccagcctatccccctcctccggagaatcccaccgctccaccaactccgccgcctcctccacctcgtcctcccgcgcgtcatcggggccggcctcctcctcctccacgacggagggctccctcacggcggcggcggcgggagggggaggcgggaagaggtcggacatgaaggtgaggcggtcgtcgaacccggagagtatccggatcatgtcgtcggcggcgttcttggagttggcgagcgacttgacgatgtgctgcgccgccgcgatcaccttctcctgccctcccggcggcgccgccgccatcctcctctccggttgggatcgagcccgagcgcgacgtcgaggaggttgctgctaccgctgcgaagaagaggaagcgaaggggaaggagaaggggaaggggagaggaggaggcgaaatggacttagtgttagagtcgctaatccgctgagctggagggggtggttttgaatgagtcgctgggtggttttgatgatgccttaatgctcccactaatcctcgctttatcgtacggtccggatttgctcggccggcactccatctccactctctaaggtttatttcccaaacaaaaaaattttcatcttttacatcgaatatttggacacatgagtattaaatatagaaaaaaaaactaattacacagattgtgtgtaaattgcgagacgaatcttttaagtctaattgcaccatgatttgataatatggtgctacagtaaatatttgctaataacggattaattagacttaataaattcgtctcgcaatttacatgtggaatatataatttgttttattatcataatacgtttaatacttcaaatatgtgtccatatattcgatgtgacacataacaacttttcacccctgaactaagcagggccttgagtacaaaggagatggatgatcatgatctcctgtatggattctcttgtcaatgtgttacaaaattttgtcaatatctgtgataacaaatcagttacggatgaaaaaaggtggaatttgagtaaattatgtgagaaaaattgaatagttttaaagaacttagactcatctgtcaagcggtttctcgattcatagaggctcaagaagtctgataactgcgataactgaagcggttaaggttgtatttgttgaccttggtctcctctcctattgtcttgttggtgcttacattttgttctggtcagggtgtgttctttcatgtcaaagaattgaaattaaactaaaacaggtcaggtggacacttggtttgaaattatgttgatgtcattatgttcattgcactaaaaccagccaaagtttggaaggcgagcacatggcctcgtgatcgtattgttcgtttgtcctttggatggactaatcacttacattattccctaaaaacggatcaagactcaagagccaaccaccggtcgcttgaaagaaattgacagaaaaggagtactttgctgtgctgtcttgttctgcatggattccagtagtgaactggtgattgtatgcatcagctctaatccggccatccaggcaatgtcacgctcatgtcaggtttgtgcctttgtgttgatcttgcattattatagttgtaaatgcttggatttgcatgagctggtgtactgcttgctgctcatcagcatagctggagaagtggaaagttggactctgccagtgccagggttagacattctttttttttttttgagatattttgttcatctctgtgatgtggcaaatggtatctgatgttcttcttgatggtcaaccaagaaatgcacatagacagagcagcaaaagtcagtggtttgttgggattatcttttaggtcacgacctcccatgcatttccatatcatagttctttctttgctcaaaaccgcaagaaactgggacaaaaaagaccagtattataataaaagattttggtataatcagcagaacgattatcgatatcttggtctctactggtactaaaaatgatctaagatcttcccctttaagttttgcgcatgcttagtacatagatcaattttgcagtagattaatggaattacagtgcaagctaaaaatatatattaggtatgttccagcaagtcgatccatgtgataagcagataaacaactaaacaaggatggtctgactcggaggaacgttcctttcaccccattttttcaacaacctttacccaccttctaaagtaaactaaaccagaacatcagattagatttgatacttaagtttgtttaaacacaagtgtacctgtgtatgaccccgacaacctgacaaaagtttcatcagaactttccgcaggagttctcatcagaagtcgaaaaccagcaaaatgattaagctatgagacgaaatatttacacataacgaaacttcctagaactaaaaggtacacaaaagtatcaatcacagagaggagtggtatctaatgggaatacattgcaacatccgatagaccgatatgtaacataggtgctttgtgtctttgtattgtcagatgaaaatctgctctacaacattaatacaacttatttgcttccactatatcgtaaaaatcagaggaaaaaaatagttaggatgtcatagaaggaacaaaaaaggggacaaaaatgttagtgcgtcagtaaacctgcgtggaatgagactcggacccattttgattttgatggtgcacaaggaatgaccagcatgacttcatcatatacatcccaaaaaatgtcacttcagccgtcgccccatcgatatgataatatatacacaattcaccaaggttcatccccaccagtctggaatttttaatctcctattcctgtgaatcgcaagattaactgcagggactttgtgcttcacctgcctccatatcatgttcacagcatcacccttcctgggtggattctggaattcatagtgatgagagacattttttagctttgaccagatctcaacccacttcgttttctggatctgtctgagctggttgagcaaataatcaggtcttagagcttcttccactgagaagaaaagggagaactcactgtaatcaatctcatcttcgaaagggagctcaatccgactgctgacaatcacaggaacacaatgactgacaattgcatcaaacagtcggcacgaggaaggagtatccccagcaggatggagacaaaactttgatgatcgcatgccttccgtagactgttaggagtaaaccatttttaaatgtcatgccctcttatgaaaacctcaacaggaaagactttagatcaccttagcacgttcaaaccatagcagaaggcactatacgtttagatgacattagaaaagtaaggtgcaaatgacaaaggccttactgttttaatgccttcacctgttgcaaggctatcctcaaagcgcacaccatccttcccttttagaatcttggcaagtttagcacggatcttcccttcctgaaaaaaaaaaggagccccaaaaaaggtcatgttcttgaaacacaaaagttaggtatttatttatgtcgagagcagttccaacaaaaatagcactgagctaaataggcagattatgatagatcacagagaagggaataattaagttgcatacatctttcctgactgtacgccctcgaaagaaaagcagtgtaggacgatcatcaaatggatcaggtggatcatcgttaaggaaggaatctacaacatgcacatatggagctacaacatctttcctcaaggaagccaattcttttgtgtatcttccaaagtctgcaactataagaatagatgcattcaccatatcacgcaaaaacctaaaagcatttgggtgatgcatgggaatcacatgatcacggcctgcagatcgttgccaatatttagatttccataaaatctccataagctcaacctacaagaaaataaactaaaacaaatcagtgtaattataatgccatgaagttagtttatattatgtagaactagggcacattgacactattatatggcagcatactgcacaccagcaacatgaaaaagtctaaggaggtgatcaaagcataccaattcgtcataaatgatcatcatatataaaacaaccaaattcctgatactcaccataactcagggtagctaattgtcaaacatcatagaaataaatcgatatattgtcatgacagaaaaggaaatgccgcaccacacaacagattactgagcaaagaagagtagacggcatttttctatggtttatcagaatttggagaaaccattattgctaatagcgaggttgatggtgatgtaacaccaactaaatgagagcatttttccaaagctatacagtttatcgcatccacatgtcatctttggtgtgctcgtcttctttgtttaatgattacttgatttttttcccccagtacaattcgcctgttctattgaatgatgtagcatagttttatgagaagcagataaatttggctgctttcagcagtctctcaatccacagtgcataccaaaatgactccaaaaaattaagacatgacagaacaacacaaaatttcgtaggcatgactctgcatttccacaagaacataggccatgccattgcaaacaggattaccagctgaattgaaaggaaaaagtgtgagatttactgcacctggaggaggcggtcggcctcggtctctggatcggtcatgttgcggccgtggacgttgaagctgagcgacgagaagaagggcacgaagaaggcctccgccgcgtcgggatccgtcacccgcaccgcctccctcccctcctccgacgacgacccgttccccccacctcccccgccctgcagcgacgccatcatccagtactccacgctgtgctgccgcctgatcccgcccgccgacggcggccacgcggggaaccccgaggcggaggcgtccatcatgccgacgtggaaccgccgtggcaggtcgtacatgaagaccctgagcggcggggcggcggcggcggcgggcgcgcaccgggcgccgaacggcttgaggttgaggaggaggctcggggaggaggcggcgggggcggaggtgaggtagaggaaggtggttgggacggcgaagacgaggagcaggaggagcgcgccgccgacggccaccgcgcggctgctcggcgacgccatgacgatgccccccaccgccggcgccgccgtaggcggatttggtgaccaaggcggcggcggcggcggcggtggccgcagctattattagtggagatgggaatttggtagcgtcgcaacagcagcttgtgctccggtggttgcgacgccgtccgccatgtgtggtgcgatggtgacgggtctccgcctccctctctctccttgttttttctctttaaaaataaaatcgatcgtcccaaaatataagaacttagtacagaatgtctagatttgaatctagagtatgtttagttcacgctaaaattggaagtttggttgaaattgaaacgatgtgacggaaaagttggaagtttatgtgtgtaggaaaattttgatgtgatggaaaagttggaagtttgaaaaaaaaagttaggaactaaaccaggccctagacaaatgcaaatgccccatccggtcccaagatataagaattgttgtgtttagtttctaaaattagggagatgtttgggggaaagttggtagtttggaaaaaaaaagtagggagtttatgtgagtaggaaagttttgtatgtgatgtgatgtgatggaaagttaggagtttggagaaagtttgctgtaaactaaacaggaccttataatctgagatattttttagtattacgaatttgaacatactataccaaaaatataagaacctaggatcgagtgagacattttctaatactacgaatatgtacagactatgcagattcaaatctggacaaatgtctcatctgttcttaggtcatctgttcttactcgagtccatctagcataatgaatctagacaactatattgttcaggtagactccacctagtttagtttttatcgggacagatggtagggattgagtttgtcgtattagcagtatccgttttcatgacagaagatcgtgctgttactgctgcagtacgatcacgataatcttccggtactttgcttgcattagagagtgagatcatatgcttgcagaagtagcaagcaaagttcactcgaaggctcaggcaaatattgatccacgagaaccatgacagatttgggtagtcatctcttcttcatggcagaaacggtaagaactgtattagtgccgagctattactccattagccgtagatggaccttacaggttacagctccctgaatccccgtgatcaagtttcttttcttaacataaaaattgtttaacacaaggccaacgctacagactgcagcaagaagccaacaacgcgtagacatgggcagattacgttagaatttcattacctctcgattctagtgcatactttgctcctccaaagggatctcaaagccccaaaaaaaatgtttatcgagacactagttacagaatctaggataaatgttatcattagctacgtaactactgtctcaagaaggcacaaaccatatatgcagcacggagtaatcaccggttattgttcaaaacccccacgatcaaagtttttccgagggtttttctttggggtcaaaatcgagctaaatcatgttcaggtcttccattccaaatttccaattgggatttgttgtgttgtttctctgttggaatattcgcttacctatgtagggtcgggtaggactcgcccatgataagaacaacaagcgaagtccatccagtaaaggacctcgcacccttaccctttcctttgttcttctggtcatagttttcccagaagaacccagtttcatggtaattcttcacgatgttcctgtaagaagcacaaaagtagcaacagcaatctattaaagaggctgcaatttaactattttattcagcttagggaagagagagggatatacctgatcaggtttgatcttagctcatcatacagttcctttgccctgtccttgtatggaccatcctcttcagagcagaacaatgttattagatcatcgtgcaaacagtaaaatttacagaagggtaaaagctgaatagttgtttagcagcatctgttatagagtttaccatgtgcatagtggtgtagtcctgaaagaatcatgtagttcatgtttatccaaatggcacctctccaatatgggggatcatgctcagtgttgcgcttcatatatattgaactggaccatggacaacagataattcagatcagagtaaccaaaagaccaaacaataatgctatgtatacattgttatgttgattttaattcattaacaagctcaaacgataaacatttaggtgttgggggcaatgcagacttatacccacttcatcccccgggacaagtcttaccaattgagtattggatcctctaaagaaattacacttttcaaataaataaatgaaatgaaatatctcatttattccagaagtatcagcttcataactaatcgtcttgatgcaagtttaggttgctggagatcaagtaggaaattttgcccatgattcaggttaaatgagttattatctttatatataccttgttcgagaaagtgaccgaagtccgtaatttgtccacaggatagagctatttgatataagatcaagctgcttctcaagaacccatgattcctgaacagagttgaatggtagttaatactttaggggatgagcatcactggattggtaaaagtgagaacaagtatatgtaggtaaagagcatacaggtggaatggcccccatcatgaaagggaacatgctgacataaccgacatgaggtactaattgcagctgagggggttgtaatgtttcacgcaaaagctctcgtctcataacatcattctctctaacttcataccatctcaatcgaacctgtaagaataatattgtcatcagagtttgaaagttatgaatcatgtccgaaaggcaagatggcaagatagaggaactgcaagagagaccttttctgtgtggttaccatagtcgaaataggcaccggttttatcatccaagtgcatctgtaaaaatgccaatactttcaaattactataggataaatgtgaccatcaaaacccttcctgtgacacaaaatgattggcggcaattgataaaaaccattttagttgctatatgatctttgaacgtttgatcaaaagtaagacttcctgacacagcaggcgtttatgcaaagtttattatctttatggcatatataagtatgtaaccataatattgcaatgatcacgaacagaaaaccaagcacaaaacaaaaactattagcttcgtctagtatgtaaaatgttaatataagaaaccattattgttataggcgcaagtgttagtgttggagtatcaagccattaattatatccaaaatgtagcagccattggtggattgatatgcagattaagtatctatctgacctaaaaaggacaaaagctcagaacaagaagaaacagtcagaactctcagagcaataccttgttaagtatcccaaaatctgaaagttgatttgacatcttgtagtaatcctgtagaagttcaagacagatttttttcaagagaaccaaaggctgagacaaagcataaggcacagtccattcactctgcagtaccttctcaagagagctgtctgttttaagaaactctgcaattgagcacatacaattcgtagctaaaagcatccaacaccggaggtcaacatggcgctcttcatcattaggatgagatgcccgtggatagtcatccaaaccagatgtcaaagtctgtagagtagtcagcaacatcaggagtgaacggttagtagaaatgacatagaaagacaaggcaagaaactgtagcgtaggcatgacaaaagctcaaaaacataaactgtaatgtaggcatgacaaaagctcaaaaacaaatttcttttgctattatttgggaccaattagtctgtggaagaaagcaactatgaagtgttccaaaaccttcggattcaactccctggtggccatgctgtctcttccatgccaataaaaggtgccttcgtatttccctaaaaaaaacaagtttgaaagtcaaagaagctatataggatagataagtcgaaggtgaaaaaagttggcatgacaaacaaaaatattggttattccacacatggaaagtacagccaatgttcattgacataacaatcaacaatgtccgccaaaaaggaaaaaaacaatcaacaaggtgatggaaaaggtaaagataacagtaattgcataatttctagctatgtggaatggtggctatagtttgcaatgacactaagctaaattttgcttagcacaggagcagaaggttattcccttcgctaagtaagtttgaacatctcaattgcatggttcctcttgggtggcagtgaattaaagttactttctaaagagtcaggaatttgggttcataactctctcgtccaggaacagtaaatgagtgaaacaacgactactgaataagttgacgatcaaaattattatttcatatagcatgcactgccttgagtgtatgtaaaatatagagtgccagggatatctgaagactaacatcatccaaaactgatgcaaaaactagtagcttctgcaagacaaaacggccagaaaattttgctggtcacaatcctattcacaaatcacaaatatgatagtacacttaaaaaatgataaaactataatttatgatagtactcttttatccaatcaaaccattcataaaatgtgaacatgtcatatttgtatatccaatcaaaatatttataaagctataaatagatacactgactgcatgcatccccaaaatatcacccttttttttactgaaaagtaagatattaatggctcatcatgttcatgtgttcaggcatgtattttctgaacattaattaacataataataggcctaaattaaagtgaagatccaatccatacaaattccatacttgccagaaagagggcaggttattctgtctgcagttattcacaagcaatcaagcatcattggttaccaagttcctaataaatagtatggaccataaaatgtcataacttaactcacctgtttgtgtgctattgaaccactgaaaccaagagttcagccttacataagcccttttaaggaaagtggatatcttttcagattcctcatctgaaaactggtttgcatgtattccacttgccaaatctgtaccaaaaagtggcaagttaaactcaataggatgttcgatcacagtttatgcacttccatacagtagcaaccttgttgtgctaaaccaaaatcgcagacagcgtgaaaattctcaatattataaatttgagacaaacgcactgaaaacagtgcaaaataatgtttttgtggtaacttgattttctgagatatactcaagtcagataatttagatactttgattctcaacagtactgctatactgcatttaatgtgtcatgacagtgaagagcaaggaagaaagcattgtctcaccacgcagtgcaagaaataaggttgggggatttccattggaagggtactgcagaacaaattcctcaggaactttactgcagaaatgtaaaaacagattatataagaactgacactctaaactcatagctagatatgacaatggttcattgctcgccaggggaaccaccttaaagcttcagctcctaatatttgctcccgaggaatccatccatccgcatttattagatctaaccagtgaccaattatatccatcgatatatgcacatcccagcgcctatacatcaccatcaaggatgtgttaaacaagcagcaataataccagcacagattcaaaaaaaaagcgagtgatgatatagtggcagaagccctgcgctacacatcaagatcgatgaaatgcttaccaaatgactaactgatggaagccctcatcccatagaaatccccttgggaagaatgagcgactaggcacagctgtatatagtgcagctggccaatatgggatatatttatccccatttttttgctgcaaggaaactcttgaagcattagattttgtttgagtgtgatgtgtaatcgcctaggatttatatcagatctacaaaagatagcacagtaataagaagggggggggggactaaatcagatagcataaagttcagctgcaatagctattaggaaaaggatctaattatcaggtaacactctaaaacttactgtaaaaccttttggaagtgcaatttttgactgcccatagaaatagccaattccaccaagaagatttgataaagcagcaacaccaacagataattctttgggattaatctgcatcagtgaaacaataatatcaactgctccatcacaaactttcttctgattatgcagccagtcacactacttatcttccaggggaaaaatagcttttaaaggttctttcaactatgaaaagtgtacagacttgaacaaaatggcaaggacactatcatttatacgcaatagcaattttatataatcataggaacaggagcataatgagaagaaaacaactgtatagactgctaaaagaagattgtcaaaactacaaagctcatccaagagatcacaccttattatttgcattgaaaatttggtcatatctcttttcaaaatccttctgttttgattcaagacgagtgctcagaacaggacctggcaacattagtgatataaaatcaacaagcaagatgaaatattgctttcaacatctctgaatttcaggttcaacagaaggaaaagatgcaggcaaggaaaaaaaaggaatggataccaaatgcaaggcagcaaaagaaaaggtcaagagcctatgcataccaaattatggaggacatggtatctatggcatgattgccatcccaaaatgaatagaacaaaaggaaaatcacatatcctatctccatgcagtatgagctatgcagtagagtcacctgttagcctgttaatgcgctcttcaatcattgggttttctgaggcggcccctgacaagaagactatgtcgacttcggcagaacgtttcatggaaacctgtgaagatgagagagagcatagatcacaatgccggaagagaacactatttaaatctgggtgtacgttgactcattggattctcatattgacagaataactttctttttcatctttgacgcacctgatatactattacatttgaagaatcttctgccatgtctggaaggttaaggttcccactttgcattgcctagaaaggtacacaggagcagctaaatggcaacttgagttcataaaaaaaaactgagacttgtttttgaccccccccccaaaaaaaaaggtaaatgtaaggagctaagacatacattagtcgcaagggcttgctgtactaggtcacttagattgtgcatactaattgatttgaatccagctctgtgaatttccaaattttcctgcgagaaaaacacagttctgtacatgtcaatattaacatcagtttatatggaattgtaatgctatataccagtagcgagtaaaatagaaaaataaaaaaatagtagcaacaatgtgacgagcatactgaaatatgctacctcagatctcaaatagactttccaatcaccaatctcctcacgggatccagatgccaaaagaacatgacctcttgacgaaggtatatgcgaatccatagtgattgagttccctgcttcatccgcgatgtagaaaaacaggtgtgtggtgctttcttggtcttcacttaaacttggcctaaattaagtataactacatggaataaatttcttttggttcctttggtaactttatataggtagcaaataaatgattgttaatatcatcctggtttgtgaatagggaatgaaaaagtcaatccagtaaaatttattggtcttttcaccttgtacttaaaactggaaaattgtttacatctcttcagtaaaaaaaacttttcagttttgtaactgacaaatatacacttacccatcagtcttcgcattcaatcgaactgcccaatctccaccataaccgctaccctctcctttctctttcaggaaactcgtggtcaacaacaagccatgatcaaccaacacttgatgtccataatccctcccattgtgatctgtccacccatatgtgctaagctcatcagaatcttggcaaacatgacgaagaaagtattgcccattctttgcaccaatccacattatcccagcaattagagacaacggggttctgaaatagaaatactattagcaagaagttgagagtgccaccatatcatcatcatacagcaatagaattccaactatgaggtggtaaggtggcaacattctaaaccagaaacaaaaacaatacgcattcaaggaatcaagcaggaaatataacaacatctttgttctcgacacatatggactaagcaaatgggaacaaaactccatagaagtgtttaaagcataaaaaacatatgatgctagcaatatgaacttccctgcatatttctagcatgccatggtggactaagagaactgaattgcttaaattagcacgctataagaatcaaggggaagatcaaagttaagcaccttgcacgaattccaagatatacattcggcctgtaggtaccccaatacaagctttccttgtgatctccttggaactgtaaacagtcaactatgagccatcagaaagctaaccataattaccatccaaactcaacagtatggaataacatgatgttacgtataaatcaatcagaactagcttacaggaggatatttaacagaaactggtacattttaggtcgtctgtcctagctcagatgacatttgcggctatgcacaattcatattcattttacctatgacaaaccagtcgtatccactatgtggttcaaacataaagcagcccttgtaaaatccaaacaagcagtggtcgattccgttattctcctagcatttttacacaattcaattaagttcttaactactactgttgcagcagattaagcagaagcgcactaatagactacaaccgcgcgagattgtaatctaaagctatttcacagagcattggaggcttgaagaaacaatgcgacgaacttaatggtcatcacctgaggcagatccatcatcctgggcgcgtcaagcggcgtgacggagcgcacggccctgcgcagaggcgtctcgacctccccatccgccttaccctgccacacgccggtatacaccacgaaggcgacggcgaggagggcgacggaagcagtccctacaaggaggaggttccgtgggctcacctccatgagccgcagggggccatggtcgccgcggccacggcgccgcgctgctgctgcggcggcggcggcggcggcggcggccgcccggcgcgcgtccggctctggacctgagcggctcctggcggcggctacgggtcgccggacactgctgctgccgccgccgccgctcatcggagaaaaatcccggcgatctccgcgtctctggttggtttggtccgaggactcgccgccacttggggagactgagacgaggggtttgggttgtttctacactagtcccgtctttccgttcgataggcgtaactatcaaaatacgccttccggtgatggatacgagtagttccagcttgaaatgtaatttgggattacgccttccacgcatcgggtgagggaaaattgaccatgttcagccgttcgggcctcgttttaatgggcctcagtatctcggcccatccacatgtggcctcaatccttcttggggcaccacgtggataggccttaatggtcttatctaagcgaggccttcactgctgagtactactagtttcttttttttttttgcggggtgctgactgctgagtactagtttctgttcactatattcgatgattttttttagaaaaaatgaatcgctgttaaaatgaagattctcaatgcttgttatcaatgtgcatccatcatgtttcatcctacttcttccgtttcacaatgtaagtaattctagcattttccacatttatattgatgttaataaatctagatagatatatatatctacatccattaacatctactaggaagaaagcccgcgcagttgcgcgggcaatttatttattgtttaaaaaaaacctaaaaaagcattatctcaccatattcactataagaaataaaccataaattttgacatactaaattataataatgtccatcatatccaaacaaaaatctttttgccctcatctatcaccactacttattatcgttgtcttgaaatatagatattttttaatagttagaactgcatctctatccacaaataaacccaatacataattaataccatataaaattcatatgtacttcatacgcaagtactcataccttacaggtatccgaatctatatgtaaatatttaaaaataccacatctaataattaattaatatgataaaatcattaacttatatatgaatatccctttaataaccagtgaagccgactatagccgctaagccttttttctccaatgccttgattcatgtgtcccttattgatatagttgtgctcctcaagacaagcttggagcactattttataaaggattgcatcggtaagtaggctagttgagctctattatcaatggtgacctcttactcggaccacttctgctcaataatgcgtactcttgccgtagttactataatgtagccagttgaggtccatgcttggcgccctttagggtatgagtaagagaaaatacaggtgatgaaaatattttttaaatgttttgaatcaatttattttatagagtatacataatttatttatggtgttaatcgatactactaaattttaaattttagtggtacatatataattttctcttttaaagattagcagagttgatcattggactctactttgaaaaatccaatagtttcagtggtgatgaccactaaaaaaatatttggtcaaattgtgatcttttgctaacatacaagttaatataggttttgattttttttcttctattatacatctaatttacctatgcatattcatgggactaacattcaatgaaatttgttaaaattatttgtgctaattgttaacactatttgtagagaaagacataaaaagagatataatgtagttacatctatgtttttttttctagagaacagtagtctctcgtgtggatgtttatttttccttttttttttctttttggatgattatttgtcaatcataggaatatgatgtacatttttctattcatagtgtgcatctgcatggatttatatgagctcatgtgatcgccttttacattgttagtaaataatactttaaaaagtttgacaggaagagggtggagcaacgggtggcatgaggtggtgtcatggtgtggcttattttaccaccttgctagaagtggtcacaacatctatgctcaatttagaaaataaaccttatagtcagaacgaatgagaaaactaccatatgggacagccatatacgcactcttctttttttattatttttatatatatctagcgtatgtatgtacatagaagttgtgtatgtacgtaaggagagattagacggtttttagatagagagattattgtcatagatctaatttaatggttgaaaataatggaatcgctaattttgaggtgtaaatagatgaatagttgtttttcttttattttatagttttcctagatactctctaattagagcgtcacataacatcttagaagcgtttgaaggagtatagaaattctattacccatagtcacaatctacttgtagtcaactattgtttatggtggattatgcaacctctacttgcctatcatttgttgatcgttgcacacttagtattgtcctttatcttcggtgcttgacgacatacatgctcattagatatcagttaactgttaggtgcattgtatacgaatatcttgtaagtgatatgacttagtgattagtaaagagtgacctatatataaaacttacatatatggggataagtgatgacatgcgattgatattttaggctaggatattgaccaattatattgcgtactacatattaagtttttaatacctaagtaataaatttaaggcagtgttgtaaagtgcttataggattaactactccctatttatagcgagtacgtttgtcaaactactatacggtgtattacacagtacgtgttttacaaactttttatataaaagttttttaataaatcaaatagattcatttgtattttttaatatttaatacccaattaatcctatgctaatgacatgtatcatcttgcacgtcctggataagcacacctaatgagctaaatcgatttaaaccacctaatgagctaaatcgatttaaacctaagtaggagataaaagacatcgacacgatttgaaaagaatatatttgatccttaatttctaatgatatataaaaaaagataactcacaatacgtgaaaatatattaatgataaatttagtaatattattttgatatatcaattatttttatagtagggagtgagtaattttgggaaagagtaattttgggaaatgttactcacaactgaagttgttttatttttaaaaatgtaagtctaatttcactatacaacatacaattatataatgcatattattcatttatttagatttttatggatgttttgatgacgtgcgtattgtagaatttaactcaaaatagcatatatttttacaactattagttgaaattattaatttggtttttatctcatgagagagaaaaaaaagaaaataaaaaaataagggaagggggtgggcacgtatgaggtatgtacgtacgtgcacgtacaggttcgggagggattgttatggacgtgcagctttttaaagataaatctatttggtattttagatctaaccgttaaaaatatggacccaccgaattaaatgaaaatcaatggctagatgttttttcaaaactttataatttattaaagtgccacttggtggcttaggagcgtttgtagagacgtcatgtggcggtttaggagtgtttgtaggaagtttaatggacttttaagtatataatagatatgaatgtgggaaatgttagaatgacttacactgtgaaacggaggaagtacatgttctgcaatgcaatatttcgtttgctaacttggttaaaagttcaggtaatcgagcacccatgacaaaagcaaacacaaaatgagattatcctaatccacacaacgccaaagctaattaaaacataggaaataaatcatcagactaataatgtgtatgcgtagtataatgattttttttcaaaacacgaaataaaagtaaacgctcatatacaaacgcgtatactcattctataaatcatttattttataggacagaaggagtatcactgtatcacacactctgtatgaatggctccagtctccagagagtgtcatattgattattggcgaaatcacccccatgtgcaaactatagtacatcaatttaatgtgttcagaactaatactactccctgagatatgaacaaacagagatgaaattgaacgaacaacatggggagaggcttcttccttccatccatcgatcctccaccgtccgtcccacatgccatcccaattctccagggcaatcaaacctcgagcacgattcaagtataaccccgagcaatattaaaatctacgacctctatttcagattataagacttcaaattaaccgagtttataaaaaaaatagtaatattttcgatccaagataaatttattataaaaatatatttaattattaatttaatgaaactaatttgataatgaaatatttctatatttatctatatatttagttaagcctgtagcagtttgactttaacgaaggtttaacccatcttataacctgaaacggagcgattatttagcttagctttgtcagcacgaatcagtgtatgcacttgccgccctcgaacgtccagccgatcttgcccatctgccgctcccaccgcggccgcgccacgtacctcctccagtcccggatcacgttcctcaggtcgtgcagcttgttctccagcccgatgcagcacgtcatgtgcacggtcgcgatgcggttcaggtcccgccccagctggcagaacccgctcaccgccgccgtgtcgatgaacctgatcctcacgccgacgccgccgccctcgcctgcgccggcggcgagctcccgcttgatctcgttgaagacgaactggtcgtgctccccggggaaccggcgccgcgccgcgtgccagtacgccatggcgcgcgcgttgcgcggcgtggccttgaagtagatgaacccggtgttcgggtagttccccaggtcgtccgggtcgccgaagtagaagtcgctcgacgtcgtgatgtccgccgccgccgtgatgtgcaccatcgggttcctgaaccacgccaggtcaacgtcctgccaatgccaacgcgcgtcgtgttcctcgtcgtcaacgcctcgtgtttctcccacaatcatggacgcctactagaattgacgaaaagatttatgtatgggtggagcttgccgtgaagaggaggttgtagccgagctcgaggacgcgctgctgcagcttgagcttgctccagacgaggtcgaggtagtccttggtcatgtagctcttggcgccggagaggtcgaggccggcgacctccgggagcagcaggtagcagtgcgggtggatggcgcggcaccgccggagcgcgccctcgtccatggccaccaccacgatgtgctcgacgaaatgcgagatgttctcccccaccctgaagctctccaggaacgagtccatcagcgaccccggcgccgcccacgcctcgttcaccgacgtcatgatcaccgtcctgtcctccatcgccgcccgccgcaccatcctcgcgaactcgtcgtcgtcgtccccaccgccggtctgcgtgcgaaatcatcacaattcacaaattagttcatcagttcttggactcggctggttaacaatggcgcatatcaagaacagcttacctgattagttcttgctgctctgcgcgtctctgaatctatccctttcgcccgtggagcgcaagccacggcggcagccttcttctcctgccttgtcgccggagttgcctccggcgtcggccacgcgggactcgcggtcgaggtgaagacgaagacgatcagcgcggtggccgacgccgcgccgaggaggaagacgaccaccggagataggccattcttggagctcgccatgcctgcacttcctcgcatgagcaaaaactctgtaatccgggaggtcgcaatctgtatttgtacactgctctgttgcaagagcttgacttttcatggaaactgacagctgccagttcgtggacgccctccaactcccatgtctcctgcaccatcaccgccgtctcctagccgtcgatcaagcgatggaccgttcagatttcgtgagaaaaaacagacgaggattgagatcatgagctgatgtgcgtgatcaaattattctcatcattgaggcctagagatcctcttttaatttgtagctgcagaagcttcagaggatatgccacccgaaaatattcagacatcgacatgcacgcatggttgttgggcatttttgtatgccaagaactcataaagaacagagatcaaagagatgtttatgtcttgatagccgttgcaccatcctactactattgattgttgcaagaggaatgcacataagtatttgtgtggacacaagtgaaaaatgcatagagatcttccggctagctctataagatgatgggctagacgccttgggttcaaagcctcatttttgtaattatttgatataagtttattccctaatattcacgtctttttatttgtgtggacacaagtaacacaaccgacacagcaagggacagatcctctatccccattgaccattgataggcagtgtgaattttgggtgacctcacaactgaacttttctctgtatatgaacagacgacactgctcaaaccacatagagtaacaggctgcagttctgcacatggtgggataaggcaaaagggcaagttggtcactaagaaaaccgaattgacctgtgtaattgaagagcaggcgaatcatggaagaacaaatcatttcagtgcacatattagaaggccaactgaactgtcagatggtccctctgaaagtcactggaattgaagcgtaagaaaatacagctgggttgagaaattgatcgagccatttcttattatttttccagcctcacatcacactcgagattctggagataacgcaaaataatttagtcgagcattttctattcattttgtttcttcacgtcacattcatcagttcagaggaagtaaaatgaggttgagttgggccttttgtattattgtacgtttcttcacgtcacaatcatcgatccggagaagaaagcaacacaagagacagagttgacagaagcttgattaccagcctatttgatttcctggcatccatttaattggcaacaggtccctggaactggaagaatcggaagatgacccattattcaaaactgtaccttttttgcctccataaaatgattaaagtagccagcaccactatcagaattcagaatctgtttcttttggaaaaaagatagtagtacatgccttcacagacttcaatccaaacataaaatacacatgcatcttctctctccaaaaaaaaacttaacctacgcctcttctaatacaatgaattcggataaacctcattcgtagtattaggagggattacattcctcgtaggttgaggttttttttgaaatggagggagtatagttcaatactagcacaagtacatcagaggcatcatagtttcccttcatctgaacaacctctcatttattcagatttattccagaatagctcagttcttacattgtcctagtgttaattcaattgataattaaggttcattgtcgattgacatatagttcatacaacaacagaatgctgcaatttcagtgacatcaaattagcttcaaccattaattctcttgacaatttagggatgaacaggtttacgccatccaatcgaattccggcaccgggtggggtacgtccacttgaaaccccccttcttcctctcctccggcgacatgcccgtgtagttcttccagtcggcggcgatgtcggtgaggtcgtgcaccttggtgtcgaggccgacgcagcagtcggcgtgcatggtgacggcgcgggcgaggtcgtcgtggtactcgcagaagccgccgaagtagagcgtgtcgagcggctcgatcctggcccgcagcttggcgacgagctcgtgcttgatgtggccgaacaccgcctggtcgtgcgcgccggggaaccgcggccgcgccgcctgccagtagcggagcatctccacgctctggctcgtcgccttcacgtagtagagccccgtgttgagcgggttgtccagcggcgcccgcgccgcggagtagtcgtccgacgacgtgctcatgtcggcgtacaccgcgatgtgccggaacgggtcacggaacaacaccatgtcacagtcctaattaacatggtacagaatcaattcagcaaatcgatcgccattgatgatctccagagctcaatgatttgctagatttggaagtggatttttgtccatcgaagaaacatcctctcattttgtacattgcgttcaaaaagttattaaaaaaactgaaaaaaattatcaagatatatcaatatatgatatatctttttgcaaacatacaagttaaaattcgacttatacaattcaaaacaaaaaacaagaagtttgaccgtgttaaaattgcgtgttcttttcatagtcaaatttgttaattttatttttattggtataagttgaatttgaatatgtatgtttgtgaagtggcatatcatatattgatctatcatactattttttttaattttttgatgactttataagtgacatgcaaaaacgagggataccccttagaggatgaatagttttttccattagatttgtacattaccgtgaagaggaagttgtagccgagctcgaggacgcgctgctggagggagagcttggtccagacgagctcgaggtactccctggacatgaagcgggtggcggaggtgaggttgatggacttgacgtggaggaggtagcagtgggggtggacggccttgcagcggcggaagccggcggggtcgacggcgacgacgaggacatggtcgaggaggtgggcgatcccctcgccgttcttgaagctgtcgcggtagaggtcgaggagggaccccggcgccgcccacgcctcgttcaccgacgtgatgatcaccgtcctgtcctccatcgccaccttcggcagcaactccggcaagcccgggaatttctcctgcacagggtgccatggcccatgggctcgttcaatctacatgggctgaacaaaatctgcctctggatgatgggctcaacagctagacaaaaaaagcccactagaaccagcagtttgaggtcgggataaattggcccgttactgcacggtgcaatctgccgacatatcctacgtactacgtacgtgctcaacaacgtcacgttataacaacgtacatatccgaaagactttcatctgaaaaaaattcatatgagaactaacaatttcatacgatatgaaacttgttgtagcaaaagaacaacgtataaactctctccagaattagccaagccataaatcaccaaattaaggggttttgcccgggcacaagggcgaagatagattcgggtgaaaatacacaaaaggaaaaggtgatcgcgcatgcatgtaactaatgaagctggactaatccatcaatttaatttgttagtttcttacctgttgagcaggaggaggagcagcgtcgccaccggcgcctctgagatcatgatccgccgccgccgccgacgatgatccaccactcccccagctcgacacgatcgccagcttctcgctcaccctgtcggacgcgaggaagaagagcagcaacgtcggcagcgcggcgccggcgaggaacgacacgacgtggttccggttgatcatcgccatgccgccgccgcctcccaaccccaaccccatctcgctctccctgctgctctctagagtacttgtgaaaggctaagagaggaattatgaagagcttagcagcagagctgtacttagctagctaagctaactactgtttcattgccacgtactcctactacttaaactacgtacggttctcgattcaacgatggatatatgagaatctattttgtcaaaaggatcgacagtgggattggccaatagctaggacgatcaagagagcccatcggaggaaaaaacaaaacgatatgtttacaaataaaaaataatttgtaaatacaaattttatatacatattcttaactatcaaaaaaatattaaaaaataaactacgataaaaaaaagtcaaaaatcaactttaaatttaaaattcaaagtataaacgaaaagataaggcggtaacactaactaattaactcgatggctttgacgtcaaaatcatcatggctacgatgtctggatttgcgtgtattttctcactttcttcctcctcgtgcccgcccgcggtaattaaacgactcagcgcgctctgccttttgagtgttgattaggtcatgtggaatttgttttcacctctgtcaagagtcaatggtgtaggtgatcaatgtgaagacttctcttaatccgtttaagtcgtacacgacgaagagtatacaccaatgcagcctccggtttggacttgtatttgcgcagatcacctgcgctatatagagattcaactggatgcacgagggcgacgagtacaatcacgcatagatgaacaaaaatgacaaagggaatgtttggagatctttagattctaattaagctgccggtgaaaacccagcttgtgagaatcaagagaaagcataaagattaatttctactccgtagttcattttttgattgttcaatgacaatttctcaaaattttaaaaactgaactatttggatgaatattttttattttatgagaagcagtataatgcattcgtcctaaattagtgtcgctttgattttttttaacgtttgaccattcgttttattgataaattagtacaaatgtaaaaaagataagtcatacttaaagtgcttttgataataaagcaagtcaaaaaaataaataataatttcatgattttttaataagacaaatgatcaaaagttacaaactaaaaacttaaagcgacaagtattttgggacggaggtagtagcaacaagactaaagattgggttggagtgaaaaaacaacaattgacctccggtgaaaattaatcagtctgttaattacaaccattgactcagtagtattatatttaaccaattaaccagtttgttagctaagctagttgccggaattcatgcagaattacagatgcagtaagagtagagatatcacggaagtggatttttgtctctcccggaggcacccgtcgttttgtgtataacatttaaaaattattcaaaaaaaattaaaaatttatcaagattgtcgacgtttgatgtcacaattccggtatttgcatagtatggggatcgttggtactaggatatacgtgagactgagataaaagagatggagacatggatttttatacaatgttcgggcccctgaattgtcaggtaataaccctacatcccgttggccgaagccggtattgctcttattcaccataatcacaccagtacaatatttggggtagcctatctaactgttgtcggcatggcggtctgaaggtctgactcgtggtcgacaacagggtagtcttccttctcgaatccgtgcccggcgagatcagagacatcgctagatccctacggccggcctctgaaggtaccagatagggtcgatctaggcatatctctgatgtcgatatccggcgacttgtcttggcgtatgttggcttgtatgttgtggcttatgttgttccgtgtatgttatggtgggtgttgattgtcccccatctcatcgtatagggccttgtatttatacccataggtgttcccttgtacaagtagaactagagaaacaaatatggatacaatctaagtagtccttatcgtttccatgtagaactctagttgtcttttcttatccggaactcctcctatatccgcaggttgtttccgtataattcctttgattcaaaggggccctaaaaggattcttaacatgaggtagaacctcatgttaaatttcctccaaaacttgcatgggaataggtattccataggaattttatgggattacataggattcattcatttgattcaaagggatatataggaaaaatacctataggaataaaatcctttaaaattcctatgaatttcctttcaatcaaagaggcctaaatatttaaacattaatgtttagaataagattcgattaaaacgttagatcgatttagtcaaagaacaaacaaaaatgataaagtaattgctaatcattgtattagtaaattactaatttacccataataatactggtagaaagcagcggagcatcactcttttcataaataagtaagtttaaatttcacctccacacattgtaaaaaaattactacgaatatacacatgctattagttgaaatttaatttattcgtcttgtcataatttgtagatattgaatgtgagttatatttatgaagtgatatatggtatattaatctattttgttataaaatattataactatttaagtgatatgaaaagagaaggtggtgtcgtctcgagagaaggtgatatgaaaagagaagtttccattctcggagcgattccgagcgaatgagagctaaaatagctggtcgatcattcaacctccattttgccaactaaatctagctagctgatcgttcgtttcttctgtttattttccccaacacaatccatccgtacttataatcgtacgtgcagccatacacaacgtggactatataccaaccttggcaacgcataatgaagagcttgcgagccatcaagtaaaattaaaggcgatcgatatgtccacgcatcatgcacgtgcatatatatgcatccatcagcaagaatacgtttttttttttttgttcttgttgttacctgttgcagttcgtgatcagtaagggcagcaccgtcgttgtaccccccatctggacacgatcgccagctgctcgcccaccctgtcggaggcgaggaagaagagcagcaacgccggcagagcggcgccggcgaggaacgacacgacgtggctccggttgatcgtcatgatgctgcctcccaatctcaaccccatatatatctcgatctctctttgaaactctaaccaaatgtggctggctgatcgatcgtgatgaacagataagagagagagagagagagagagagagagagagagagagagagagagagagagagagagagagagagagagagagagagagagagagagggcgcaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26384 - DNA, 745 bp, Oryza sativa
tccatcaccgcgcccacggtggcgccgaagctgatggggtcgatcccctgctcgttgcacagcaggttcacgtactgcaggcattccaggtcgttcacgccgttggccgcgcccagggcccaggcggcctcgtattccaggccgccgctggcgccccagtactgcggcttgttgaccacggtgaagtgcgtctcgtcgatcttgctgatgcgcccgcaggcgatggtgcagccaaagcacgcctggttggtcaccaggtgcttcttgccgtcgctggcgcgcggcgtggccatggcctcggcggagatgtccttggcgccttcgaactgcacgtcgcggtggttgcgcgtgggcagggcgcccacctcgttgatcacgttcatcagcacctgcgtgccgtaggtgggcaggccctggccggtgacggcgttgtcgtgcaggatcttcttgcgcgcgaaggtctcggccatgaaggccttggggtcgcggatgttgcccacgcccttggtgccgcgcacggcgatggccttgaggttcttgctgcccatgaccgcgcccacgcccgagcggcccgcggcgcggtgcaggtcattgaccacggcggcgaacagtacctggttctcgcctgcgcggccgatgccggagatgcgcgtgagcgggtcctgcagcgtggtcttgaggtgctcctcggtctcccacacgctcttgccccagatgtcggcggcgtcgcgcagctcggccacgt

SEQ ID NO: 26385 - DNA, 820 bp, Oryza sativa
ccggggaaaaggaatcccctgaatttctatagggacggcagggctataatactttgctgtcataacccctccaggggtggtgatgagcagagggtttctaagcctttctacccccactgatttttccccacgaatggcacagatataaacgagtgggaagctccagagtcgaacaaaattgtagcagggatggaatggacgaggaacgtaccaacggtgacgtcgggagttgtcagcacgtcctcggccgtcacatgattcacacggccccgaatgacatccttcccgccgttgttggagcggggaggcgcttggccttgctgacgccttggctttgggcatttatccgcaaagtgtccgggctcgaagcagttgaagcacagccgctgcggacctgaagcgtccctgcggccttgaacgggctgcacagctggcgtaggaggacgggatgcacgagtcccttgctgattctgctgctgcggctgtgggacgcgcaccacgaattgaggtcggggcgctgggcgaggttgctgctgctgttgttgctgttgcgaggaggatccccctggatagggattggtgtagcggaccctctggttagcaccctgctgattgcggaagttcgccaagcggcgcttgtgcgattccagctccttgtgcttggcctccaagcggatgctcttgtccaccagtcgttgaaaatccggatagtccccagagactagacgaacagacagctcggggtccattcctgccaagaacttctcttgcttctcctcatcttcccgcacatcctcaggggcgtaacgggccaagttgt

SEQ ID NO: 26386 - DNA, 667 bp, Oryza sativa
gcaggttctcctgacgcagctccaggatcttcaggttgttctccaccatgccacgacgcaccatctggtggaagtcgatacgagccgcgtcgtacgcctccaccatgcgtgccagatgcacgacggtagcgtcatcctccgagctggcgtctcggaaggtggcgtggtcgcgggctcctccgcgacgagggtggtagcggtagggcgagtgctgcaactcgtccgggtagcgctggtgaagggtgccgatggcgaggagagcggcgttctggcaagcggcggggaaggagtctccgcccgcggtgactgccagcgaagtccgctcgggagagccggagaggatcactgctgtgacctcccacgcagcgtggggctctgcgtcgtctccctcctgatccggaagcggcctggcctggtaatccactccatgtggataccccaagaccacgcacatgcctcgcagctccaagacgaagccagtcatgtccaaaccacgacgggtaacgctgccggccatctacaaacaaaaacaaaagaaaagcaacattttcgaaggtcagattttgacgataaatgaagcagcaagacaaagagagaatagcgggttttcacaaataataaaggatttttatttttaaaaatatagctaaggcttgggatctacggc

SEQ ID NO: 26387 - DNA, 1067 bp, Oryza sativa
attcctgcagcccagacgctcttagcaggaaaggctattgcaatgctacggagggacgacagttgccattggagttatgcaaggaatttgaaagaataaatttgggaatggtcagaagaggtttcgttgcagccttagaagcaaagcccactctaattgatcaagttagagaagcccaaattaatgatcctgatattcaagaaatcaagaagaatatgagaagaggaaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatcttaaggaaagattttggtgggcaagtatgaagcgtgaaatcgcggaacacgtagcagtatgtgatgtttgtcagcgagtcaaggcagaacatcagaaacccgccggtttgctgcagcctttgaagattcccgaatggaagtgggaggaaatcggtatggatttcatcactggtctacccagaacgtcatcaggtcatgactctatttgggtgatagtcgacagacttaccaaagtggctcatttcatcccagtaaagacaacttattctggaagtcggttggcggaattgtatatggcaaggattgtgtgtttgcatggcgtccctaagaaaatagtgtctgatcgaggcagtcagtttacttgaaaattttggaagaagcttcaggaagagatgggttctaagctgaactttagtactgcttatcatccgcagacagacggacaaaccaaaagggtaaatcagattttggaagacatgttgagagcttgtgctttagacttcggtggaagttgggataagaatctaccttatgcagaattttcgtacaacaacagttatcaagctagtcttcagatggctccttacgaagtactgtatggtcggaagtgccgcactccgcttttgtgggatcaaacgggagaacgtcaggttttcgggatggatatcctgagggaagcagaa

SEQ ID NO: 26388 - DNA, 725 bp, Oryza sativa
ttcaaaagtacaaaatttgtgacctcgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaagagttgcgtacgatgtcctttgccataggatttgggactgcccctttttatgcccagattcctcatgatcgtcacgaagagaagtgccgagtcaaagtcaccttgaacagtaatagtgaagatatcccctcagtgatgttcgaagctggaggaagaaactacatccatacatgtcaggaggtggcaaggatcgccataggggagctccgcgatcgctacagtgatcagttggccgacactgagtatcgctaccatcctcgtcaaccactgggaagtgaccgtggcagctaccttgagactaagggaattaagaatgatgctaccacaaggcatttggttaagatgctgtgggtatggatgaaacccgtgcggagactgtgttagcggctcaagatcgtgaagaccggaatcgtggcaagatttgcaagttagaggacaaagtggatcgtttggagaaggaactagctgcattgaagggagaagcaccaccgcagaagg

SEQ ID NO: 26389 - DNA, 1307 bp, Oryza sativa
gctcacggaaacgaacgaccgagatcgatcctatccaaaacggacggctgagatcgaacggtccatgaccggccacggcaaacggccacgatgacgtcagcggtgacgtcacctccggcggcggctcgggcgcgcatgctcgccggcgaacgacggcgcgaggacgcgaacggagggcaccagcacgtagagagcgacgcggcgaactcaccgatgaccaaaacagcggcggaagatgaacggacggcggcggcatcgaggaaaaggcggcaaagtccttcggcttgacgacgacggcgatgctccggcggtcttcagcgacagcgaaggggcggacgaggacggcgacgcgacggcgaccacgatggcgaccttcccgagcgacggcgacgactggaacaacggcgaagcacggctggagcgacggcgacgactgcggcacaaggtctcacgagactaggactctaccggcgacgagagacgaaggcgagggtggcgacgggtagcggcgggcttggggatccttttataggggttggaaggctgcggcgaaggcccacggcgaccggcgacgagaaggaaagttaaggctcagaggaaagagaccaatccgaatcgaactcgaatccacggatttccaaaccgatttagaggatgattccaaaagagaaaaggtagaggagatctcggggaacatttcccctcaattgatttcaccggagaaggaaaggcgcggccgaatttggaagtagacgacggcgcggttcggctagggttcgggcggcggcggccggaggaagacgacgagtccgacaggtgggacccacctgtcaacgacagcgagcgctcgcgcgggcggctgcggctgcggactgggccgacttgggccggggagagagagagaaggttttgggcagactttcgccccaaagccaaaagagacttttaaaaaaaactttttcaattaaattattcatgaaatgcaattccatttattaaaaatacttccttagctcaaataaatcccagaaaaatctaggaattatagaattaagcaaagtatttaatgaaattttatatggccccattttatattggaatttattaattaaaattagatcttctcttctagacttttaaaataaattctaataattccaattagacaacaatttatatatttaggattcttagggtgtgacaaacctaccccccttaaacagaatctcgtcctcgagattcagaagtactggcgaacagatgcggatgagctgacttcaattcatcttctcgttcgggctgcagga

SEQ ID NO: 26390 - DNA, 2891 bp, Oryza sativa
agaaatacaatccccgaaatcaccgacgcttctgtaatctgcgccttcaagtccggtgtcagagatcgctatactacccaggagttggcaacgaggtgtgtcacgactactcggagattattcgaaattgtcgatcgatgtgctcacgcggacgacgcactgagacgcaagaacgacaaaccaaagaccggaggagagaagaaaccagccaaggacgcacctgagtcaagcaagaagaaaaatcgcaagagtgggaaaaggaaagctcaagcggaagttctcgcaacagaatacgcggaccctcccaagcgcccagacccacaaagcagcgacacgaagaaaacatggtgccctatacacaagtcggacagacactctctagaagattgcctcatcttcaaaaagtcgctcgcaaaacacatggcattggaaaaaggcaagcgagtacgtgtggccgagaaggacgctaaggcggctactcaggaatcggactcagcatacccagactctgatctccatgtctcgcacatcttcggaggttccacagcatactcctcaaagcgagaatacaagaaagtggaacgtgaagtctgttcaacatggcagggagctgcgcccaagataaagtggtctgagcagaagatagaattctcagaagaggaccaccccaagactgctgtcatcccagggcgatatccgatcgtggtcgaacccactattcggaatatcaaggtcgcgcgagttctgatcgacggcggcagctcaatcaaccttctcttcgctagcactttggacgcgatggggatcccacgaagcgagttgacacccaccgatcaacctttccatggaatcactcctcagtcatcgtccaaaccattgggcaaaattacgttgcctatgacttttggccaagcaaataacttccgaacggagcagatcacctttgatgtcgctgaattcgatacagcatacaatgctatcattgggagaattgcacttgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacacgcccagcccacccaccacagctgagccacccaagaaagtgagcaaaacaaacaagacggcgaaaccggacggtgcaatcaaaacgttccactctccagtgccaaccctgacaagaccgtcaagatcggggcatcactaggcgagaaataggaactcgcgatcatcaccttcctccgcgacaatgctgatgtgttcgcttggcagccgtccgacatgctgggggtatccagggaggtgattgagcacaaactcatggtgcgaccggacgccaagccagtaaagcaaaaactgcgtgagatttgcaccagatcgaaaacaagccatacgagaagaactcgacaagcttctcaaagctggttttatcagagaggtactccatccagagtggctagccaacccagtcatggtgcggaaggtcaacgggaaatggagaatgtgtgtctattttaccgacctcaacaaggcgtgtcccaagaatcacttccctcttcctcgaatagaccaactggtggactgaacagccggttgtgagttgctgagctttctcgacgcttactccggctaccaccaaatcagcatggcgaaagaggacgaggagaagacggcactcattacgccgttcggggtattctgctacgttaagatgccgttcggactaataaccgcaggaaacactttccagtgcacggtccagggcgcacttagcgaccaactcggaaacaatgtcgaggccaacgtcgatgacattgttgtcaagaccaggacaagtgactcattgattgacgatctgcaggaaacgttcgacaacctcggacgatatcgcctcatgctcaatccagagaagtgcacgttcggagtaccatcgggcaagctgctcggtttcctcgtctctggcagaggaatagaagcaaatcccgagaagatcaaggcaatcgagaacatgaagtcgcctacaagactcaaggaagtacagaaactaaccggatgcatggcggcaccaagcaggttcgtcgctaggatgggagagcgaggacaacctttcttcgctctgctgaagaagcaagacaaatttgtatggacacaggaagccgaagaggcattcattgcactcaagcgctacctatcaaatccccctgtacttgttgccccccaacctaatgaagaattattcctctatattgccgccacgccatattccgttagcactgtcattgttgtcgagagagagaaggtgcaacgatcagtctactacgtcagcgaagccctccacgacgcaaacacaagatatccatagatccaaaaactgctctacgcggtaatcatgacatcaagaaagttacgccactacttccaagcccacagggtcacagttgtatcctccttccctctcggtgaagtcgtgagaaacaaagacgttgttggccgcattgcgaaatgggtagtcgagctaagccagtttgatgtccactttgtgccacgaacagccatcaagtcccaggtactcgctgacttcgtagctgattggactatgcctgataacaggtcagacaaccaaatcgacaacgaaacgtggataatggcgttcgacggcgcgctcaacagccaaggagcaggggcatgattcatcttgacatcaccttcggaagatcaattcaagcatgcaattcacctcaacttcagggcgactaataacacagccgagtacgaaggactactcgccgggataagagctgcagctgcacttggagtcaagcg

SEQ ID NO: 26391 - DNA, 1339 bp, Oryza sativa
attcctgcagcccatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgct

SEQ ID NO: 26392 - DNA, 1902 bp, Oryza sativa
catgacacattttctgttgtatgcagatgttggcaggtcatgggtggaactttgggacaacagaaaactttagatgctcatcctaatcctgtgttgacaatgaagaagtatttgacagtttggattgaggtattgaattgtttatagtgaggctgtttgttttgttggatgtatatatttttttgttagattgcctgattagtttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaaaccaaatatatccgatctagaaaaaatatctgtaaaacaaattaacaacaacaattatatccctactacttaaaaaataagaggtgcttccatcgtccgtcaaaaaaactggaccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctaggaggattggagatctgtttgcaaaaacataacctacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaa

SEQ ID NO: 26393 - DNA, 2239 bp, Oryza sativa
acctcgcaagaaaaaaacaccgtctattaaaaaaacaaatcgctttgaaaatactattagaaaaacgctaaattgatggacgcttgagtcggatagaatccatcaatccagcagcagccgccgccacgctcacccgccaccaccgcgctcgcctgccaccaccgcgctcgcccgccgcccctgcctgcttcgcccgccgcgcgctcgctcgacggggcggcgatggctttatggagacgtgacggcagcaggacggaatgtggggaggcgccgagcgagacggtgttcacagactccgtcgacgggagcagctccagctctggcgccgcatccaccgacgagtggccggtgacgatgtcaccgcccaggcgcccatgaagacggtcagcagcgccgctgcgggttcatcagccactgcgtccttctgcaactggcgtccctagaaacgacgctggcgaggctcgaccgacaagtgatccaagcgagaacatcttgagctgaaggaatggccacccgaaccgtccacgtgggaatggctccggaacggtggggacgtagagcgtgagctcctcggtgaggttggacaggctcgtcatctcgttgacggcgtcgccggatttcctcggatagctcagcagcgaattggcgatgacaatgccgtagttgaaccgcttcgctggaggaactcgccgaccagcttgaccttggtgtagcggacgccaagctcagctgctcaccgccggagacgccgaaccagctccacagctcgatggggtgcaccgtccattggaatgtcagcggcggaaagcggcgctgccgccatcgccgtggggtgatctggcccatcatgatgctgccgtggtgccggggaaggtggtatgtgttaaataaatgaacttctgtcagttgggatttgatcttatactcttatttactttctgttagtttgttagctattttccctcctcccatggttttctgctcgctctgttttgagtcagcgtggccgcgatttgttcggtcaagtggtggagcttgacgagcgggagagtatcgagctgagaaaacgagcagcaccatgaactagcgtcggtgagcaccacctcccttctgctcgagctcggttgagggctgggagcttgacctccgtgcccaccgcccaccgcccaccgccggccgccgtcgcgccgccgtcctcctcctttcccgcctcgccccgtcgatgcccgcgttgttcgcgccttccagctgcccgcgacgcctgcacacgcccgcgcctccctgtcgacgcctgcgcaaggtcgctgcacgcccgcgtcgtggagctccgccgggctaccgtcgggcatccccactgtggccgccgccggcggccgccattgcggcgccgcgctcctcctttcccccctcgctccgccgaccgacctacaggcgcagagagagaggaggaaccaaggaagagaagaaggggaagatagatgactcagcggactcagcctgacatgtaggacccacgtgggtcccatgctaaatcagccgtcacgtaggacaaaactggtgtcaaaaccaccgaaggacctattgtaaccggtttttattagttaagagacgctgaatatctggtttatggttggaggacgattttgtaactccatcacaagttggggaaccttctgtgtactttttcctctttgcaatcaataggtgtcaaagtgtcaactgattttacgtgctgtttcaaaaaggttaggatcactttcattacttcattcatagtacatctctagtacggattattattaattattagattagtagattgaatcgggtgctgccaaataaaatggccgccgcaccattgccactgttcgccaaagctcaagagcatcggttcctctttcctcctggttagttcttctctctaccgcttcttccgtcctgattcttgctcgacatccccgttttgagatggccacgccgcatcagttgaacggcccaacaaaccgcgtggggtgccgctggcattggctgcgagccgtcgataggcaagcttcaacgctcttggagcgcgcgtgcagcgggcgacaatttagtcactggctcaccctctctcttccagtctggctttttagggcccatttgaatagcaggaatggaaaaacgaaggaatatgaccctctctcttctagtctggctttttagggcccatttgaatagcaggaatggaaaaacggaggaa

SEQ ID NO: 26394 - DNA, 1539 bp, Oryza sativa
attttaaaggatagtataggattcaatcctttggttcaaaggcttttataggaattttttccataggattgaaatccttcaaattttctacacttttcctataaatcaaaggggaccttagtctacgtgtccaccttgttgtcggctaattgctctctattgtagctctcagtgctcatgccatggaagctgctaccggcggtcttctgcattatgctgccgctgttagtgatatgccctagaggcaatcatagagatgattgtatcacatactatgtttacatatttttccgattttgttccttgaaatagataaactcattattggttaatgaatatgtgattctttcataagactttttatgttatgtgttgctatttctaaaggatccctgatcaaatatcatatgtggaacaaatatgtttagatgatcaacacatgtattaattgatgatcatgtctcatggatcatggtatagagataccaaattaataatgtggacacatgttagtgaacatgttgttggatagacccaacatgagacactgcaagagccatatgtgttgtgtcatcagttatctcatttagtgttggtgttgaatccttagacctgagattatcatggttcccaacatgtgtagtagcttacttagggactgctaaacgctactccgtaattgggtagttataaaagtagttttcgggtatgttatgaaacatgtagtgggatatgaataatcaagatgggatttgcccatcctatagagagatatctctgggcccctcgatgttgtagattatggaaatgcatgaccatgccaaaggtgattgaggagtcaatcataagttatataatctatcaacaggttcgagtgaatgattgagctattagaggatggcacatatctagccttgagcttaatcgatatcatgaggcaaaagggttcatacaagtatacactagaggttcagccgatctgatctttatgtatgcccggtgggtcaatacgttctgctaggggccgctgttgacgcgtggaccgaaaatgagttttcgggttacagccgagtatatatgaacctacagggttgcacgcttaatgggccggaataagggaattggatagagatccaatatgagcttaatgtggataaggatccgaataggagtcctacgggccttggaggcccgagtgatggatcctatatattcgtgaggggtgtgacaggcggaggcattgcatcacgtgagaaaccctagccgtcacttccctccccgagcaaaaccctagccgcgcgcgggtgctagcacatctgtgcgtggcgttccgtccctgtacgtgtggataccagtaaaggctctgctggtttgcggtgctgatcggcataggagtacagcgaggagaacgcacgaggaggagaaggtcgagccggtgcgatcgactacttcctctacatcgacgcgcgctacttcgcgagagttccttcgacttctcagcgtcttcttccgctgcgcagtgcgtcgagtggtaacgat

SEQ ID NO: 26395 - DNA, 884 bp, Oryza sativa
ttttgagaaatcagaaatggacatgcaaaacacatggagaaatccgagggcgcctagatggaaaaaaactagcaaagttgcgtagttctctctgttttttaagacttaacgagaacaatatgaaaaaactacaactaattcgaaaggccagatacgtgtatttggcatggccatgcaatggtggggtgcaaacaaattgattaaaacaaataatctggttgtcggacaagttggagattccctcaacgttcagcgctatcacttgcaagttgcaagttggatagattgtcgctacttttgtgagggaggggctggaacggaaggatatactggggaataatgagcaaaattatattgaaattttcttttatttctaaaattcattttctttctaggggcgcttttaaaatatagttaaaaatattgaactaagttgaattaatttatttagaatgttggagtgtcataaatgtgggactgcattaataaaagagaaattctatgattttcggttgacaatcgattgattctacgaactaccttctattcctttaattttaccatgagttaacctattttagctctttactttttttataatatccaaaatattctcaagaggtttgcaagaactattgctattttactgtcaatcggaaataatgcaattaaatcaatgcgagttaaaaaagtggaattaaatctccggatgcttagtaaggttacatttgcatatactctcttcatttctttttattgacgttggttatttcatacattatgggatgggatagtattacatcttacgggcaaaatagtctattttttaggggttaacaatgtcagtcaactaacggcagtaaggaaagaaaaaaaaaactatg

SEQ ID NO: 26396 - DNA, 2843 bp, Oryza sativa
  unsure (1)..(2843): unsure at all n locations
ctgcgggaaattcggatttgttttgttttggaaacattccgaaaaatccggtgcgtgaaaacggcgtggagttcagataagtttgcgacttatctggttcggttacgcggagtggagatcgtgcgggcgccctgatcaagcgacctatctctatataaaccgagccgccgccttcacgcaacacacgcgaaatcaatctagggtttgcctcctactctgtgctgctccgtcgctcgtagactacttcgaaacctctgccttcgacgtcctgcaccgggagaaggtagcaataaggtttttgggacctctccctgttcgtcgcgacggcttgccttcctctccgctcgcgtgctgcgtgccttcgtcaacgcccgcaactgcgagtagttcctgccgagcaaccggtctttccgccacctcggtacgtgttcgacatattgcgaatatttgatatgttcatgttttactgcttagtttacatgtgtagatctaatgatgcgttcatgctagtttacatttacaatgtcatgatttatttatggaataaattaaatcattatgtgcttataacttcaacaattcaaaaaccttactataggcgctgtgattttactatggctggttttgccgatgtactgaggccggataaattcaccggtgtgcactttaagagatggcagatcagggtcactctgtggctggcagcgatgaaatgcttctgggtgagtactggcaaacctgaaggaattcttactgctgatcagcagaagcaattcgagacagccactactctctttgtgggatacattcttagcattcttggcgatcgtctggtcaaggtgtatacatgaccgacgctaaggagttatgggatgcactgaatactaaattcggtgctactgatgctagcaatgatctgtacatcatggagcagtttcatgactacaggatggctgacaaccgttctgtagtcgaacaagctcatgagatacaaaccatggctaaggaactcgaactccttaagtgtgtcgtacccgacaaatttgtggccgggtgcattattgcaaaactacctccatcttggagaagtttcggtactgcactcaaacacaagagacaggaatactctgttgaggggttgatagcgtctcttgatgttgagaagaaagctcgggaaaaagatgctgcgtctaagggcgatggtgggcaatccagtgccaatgttgtgcacaaggcccataacaagagcaaagggaaatacaaagctcaacagaccaccaacttcaagaagcagaagaagaagaagaacaatcctaatcaggatgagaggacttgctttgtgtgtggccaacctggtcatctggccaggaagtgtccacaacgcaacgggatgaaggcacctgcagggcagacttctaagtctgctaatgtgaccattggcaacactagagatggaagcgggtatggtaatttacctaatgtttttttagttaatcagtctactaattggtgggttgatactggggccaatgtacatgtttgtgctgacatctcattgtttnttttttatcaagtcgcacggggttccaccgtcctaatggggaatgggtcacatgcttctgttcatggtgttggcacggtagatctgaagtttacttcgggaaagatcgtgcagctgaagaacgtgcagcatgtccctactatagacatgaatcttgttagtggctcccgtctgactagagacggatttaagttggtttttgagtctaataaagtagtcgtgtcaaaacatggatattttattggtaaaggttatgagtgcggaggcctgttctgtttttccctttctgatttctgcaataagtctgtgaaccatatttgtggcagtgtggataggggtgggaaaaataagaccgaaccgaagaaccgaaccgaaaagaccgagaccgagaccgaaaagaccgagatcgagaccgaaaagaccgagaccgagaaattcgggtagtaattcggtctcagcatgtcaaagaccgaaatttgttcgggtaattcggttattgggctcggttaaccgaattaaccgagaaaaccgaattgtggcccaataggtccaggaggcccaataagctcaatacaccactaaaccctagagggccaccctcatccatccaggctgcatccccatcccatccctctcgcgccgccctcccttccatcgcgccgcactaccgccgctgcctccatcgcgccgcactaccgccgcctccacatcgccggcgccgtctctgccctccgcctccactccacctcgccggatccatcgcgccgggctgccggccgccggatccatcacgccacaacaccacctccgccctccgccctccacatcgccagtgccgtctccgcctccatgccgcctcgccggtcgcgcgggccgccggccgccgggtccatcgtgccgcaccgccacctccgccctccgcctctacgccgcctcgccggtcgcgtgggccgccggccgccggatccatcgggccgcacctccacctccgcccttcgcctccacatcgccggcgtcgtctccgccctccgcctccacgccgcctcgccggtcgcgcgggccaccggccgccggatccatcgcgccgcgccgccgcctccaccctccgcctccacatctcgccggcatcatctccgcactacgcctcggctcctccaaattcggtctaaccgagaccgagaccgaaaaaaccgagactgaattcctcggtcctgatttttttgggatgaaactcggtcctgacttttcaaaaaccgaaatgaccgaaaaacgggctgcagga

SEQ ID NO: 26397 - DNA, 738 bp, Oryza sativa
gaaggagtaagagacaaaggacggctaagtcctttggcgatgatttcactgtgtacctcgtggatgatactcctaagtcaatttcagaagcatatgcatctcctgatgcagactactggaaggaggctgtccgtagtgaaatggattccattatcgctaacgggacttgggaggtgacagagtgaccctatgggtgtaaacctgtggggtgcaagtgggtgttcaaaaagaagcttaggcctaacggtactattgaaaagtacaaggctcggcttgttgctaagggctacactcagaaagaaggcgaagatttctttgacacttactcacctgttgctagattgaccacaatttgtgtgctactttccttagcagcctcacatggtcttctcgttcatcaaatggacattaagacaacttttcttaatggagagctggatgagatctatatggatcaacctgatgggtttgtagttgaaggtcaagaaggcaaagtgtgcaagttgatgaagtctttgtatggtctgaaacaagctcctaagcaatagcatgagaaatttgacaaaacattgacatctgcaggctttgcagtcaatgaggtagataaatgtgtgtactatcgccatggtgggggtgagggagttattctgtgcttgtatgttgatgacatactaatatttgggacaaaccttgaggtgataaataaggttaaatcattcttgtctcaaaattttgata

SEQ ID NO: 26398 - DNA, 758 bp, Oryza sativa
ccggatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagagcaccagcgaccggccggacttctccaacctctccaagtgccggaatggaaatgggatgaaattgggatggatttcatcaccggccttccaaaaacccaaggtggatatgattctatatgggtaattgtggaccgattaaccaaggtagctcgattcattcctgtgaagaccacctatggagggaataaactagcggagctctacttcgctaggatcgtgagtctccatggcattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtctagatttcgggaagacttgggataagagtctcccctatgccgagttctcctacaataacagctaccaagccagcatacaaatggcaccctatgaagcgttgtacgggcgcaaatgccggacaccgctactctgggaccaagtcggagaaagtcaagtgttcgggactgatag

SEQ ID NO: 26399 - DNA, 2260 bp, Oryza sativa
atgggttctccggaaagcggcggtgaagcgagcccaagttatcggttgcccctctggctgcgtagcctggaagtggtcccaccatagagatgcgggtccctgcagctggtgggcggcgaagacgactttctcttcgtcgctgcactgcaccgtgtctagcttcttccccacggcatgcaaccaatccaacgcatctacgggattgttggagctagagaaggtgggtgggcggatgcggaggaattcggcgagtttggagtgttggggaggtggtggtggagcattctgttgtggcgggttttggaggtggtggaggaaagcattcatcatgttggcttgttgggcgaggatttgggtgagaatggcgttggtgtctggcggtggtggtggaggtggattgccttgggggttggggttgctgctcttgggttggctgccttcaccggtgttaacatttctcctggtcgtcaccatctgaaaactccacacagaaccagcaagcagagaaggagagctgacgattaaaactaaccacccacgactactattattcttaaatttatcactgctattaaattggttcattaaggttcaagttgcttaggcaaacaaataaagacaggctccgacatagttacaccacacaccggcgtaaccatgccccacacaactcaagaagataaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggccgggaggtgctcttgcgggcggtgatcttctggctgcggcagacgcggcgacgcttgggacggctgatctctccctgggcgaccttgagctggtgcagctgcgcctccagcgcgtcgaggtccttcttgagctgcaggttctcctgacgcagctccaggatcttcatgttgttctccaccatgccacgacgcaccatttggtggaagtcgatacgagccgcgtcgtacgcctccaccatgcgtgccagatgcacgacggtagcgtcatcctccgagctagcgtctcggaaggtggcgtagtcgcgggctcctccgcgacgagggtggtagcggtagggcgagtgctgcaactcgtccgggtagcgctggtgcagggtgccgatggcgaggagagcggcgttctggcaagcggctgggaaggagtccccacccgctgtgactgccagcgaagtccgctcgggagagccggagaggatcaccgcagtgacctcccaaccagcgtgaggctctgcatcctcaccctcctgatccgggagcggcctggcctggtaatccactccgtgtggataccccaagaccacgcacatgcctcgcagctccaagacgaagccagtcatgtgcaaaccacgacgggtaacgctgccggccatctacaagcaaaaacaaaaagaaaagcaacattttcaaaggatcagattttgacgataaatgaagcagcaagacagagagagaatagcggttttcacaaataacaaaggatttttatttttgaaaatattgctaaggcttgggatctacggctcgtcctagggtcaagggaggctctgataccaacttgtcacgaccggaaatcacccaacgggcgttcctgacgtgcgtgtattattccttgtcccaggaggcaaggtacaccaaaagttgatacattacagagtttaacaagcggaagcgtatataaaattattacatgggcgacgaaggcccagcacactcaaagacaacgaaaaacagcggaagactagggcgacgaccacaggcacttgacggcaggcacgagctagacaccgaagccttcatcttcaaggaactcctcatctgggcttgggaaaattaagcaagactgagtacaaccaccgtactcaacaagacacacccacaaatgcagaataaatgcaagggagtacaagggaattataatataaagggttaggtttgcagtacacatttaaagacatttagttgctcaagggtattttggtaacccggttttaagaattacccaatattattaatcaaggccgtgaaccggcacgaacctgccttaacccaaggcctacgatgattcggaccgaactggcaacccgagggctgcaggaat

SEQ ID NO: 26400 - DNA, 2280 bp, Oryza sativa
caaaggtggcttcaaaaagtatgtaccgctgctggatgatgtcgtggtcatgaagggtgtcggccacttcatcagtgaagaaaagccaaaggaagttagtgagcatgtaatcagcttcataagaaagttatcggctgaaatgtgattattcatcatgaaattcagagtgagataaaaataattgcaatgtattcttgcgtgcgaaccgtaaagtatgttagcttgcatttggaggatgtggggcgcgtaatgctcatgaattggtgcaattagtaaagtgttcgatttgtacacatcatgaagtctataattgtcatatgcaatattaattggttatgttaattgttcgaatgaatggtaatggtactatgattttttttttaaaaaaaactaacttgtggatacatggtcagaagggtttttttttaaaaaaaacggagggaatagtgatatagcgatatatttttatatgtttctaataaagtaggatcccgttgcctgctcttcaagcttcacttattaaagaagacataccttaccacaaagctcttttaggggtgaggtcctcactagcatatgacgtgagatgaatttaagacttttgtgcccaatcagatataaaccatcatttttcaaaaaaaaaaatataaaccatcatgattcggtccccacaagctaatatcacctcgaacaaatgggttttcacacataagggcagccacaaagtgaacataaaggtgggtcttaagcctctaaagtgaaccttatacattgtaagagtagtttttatagatgacatttgtttgagctagccatatgtataaagaccacccacaaggaataaaaaaatatattgctctttcctctctcatggtagtgatactctctctccctctctcaatgactaatcttgggtttgtggggtccaccttaatatccactcttacggtcttaccatatatattgtgcacatgataatatattttagtgggatccaccataatatcaatgtagtccatatacattgagcatgccctaataagttttaggtcatgttttaaatataagttttgtgaagattgttgttttaatcaccacaaaactcgttggattgtgcaaggctattctttgttccctggcatcttgtcaaccacacctcaaatatcatttagtatctttctagtatgtactcctccgggcacaaataagtggcattttaggtaacccattttaggtcaacgatgcatttgtttgattacttctattactaattactaatagagtaaattttataaagctacgggtattttaactaaactatcagaaaactacaaatttaagatggtatattatacaactatagatttaaagctaaacatgggtgaatagctaatacggtccctgaagtttcacttcgggctcagtttagttatcgatgtttcaaattgtccaaacaagttctccaaattaatcatttgggcaaatatagtcctttgacccataaaaaatgccacttgagtatgccaaatcattcttgcacgcagcggtatgaataaaatgacaattctacccttatatgccatatagaaaagaaagaaaagacaaacaaaaaaataacaagcccatcattattgcggatgggtggccgacaaaggaatttacacgatcacgattagtgcttggctacaacaatcgtaagttacaattctaaaacgatactacacgtgtgaaacatttatctttttttctttctttgctatatggtatataaggtggaatggtcatttcattcaaactgctgcatgcgaggatgacttggcatgctcacatggcattttttgggtccaagaactatattaacccaaatgattaatttgaaggacttgtttggacgatttgaaatctcaaggactaaactgagcctgaagcgaaactttggggaccatattagctattcacccgctaaacatcacaaaactagagatttagtactgaaggtagcacaaaactacatattatagagtttaaatccctaccactactagtattattttggagctataataaacattatagttttgcaattgaattggtgctaaacttgtattttgggataattttgttactaaatctgtagttttgccatacttggctctaaatttatagttttgtgataactttattgttaaatctattattttgtgatacaataccttacatatatagttttacaatagtttgatcaaagaatatatttgttttgtgaaatttactcttact

SEQ ID NO: 26401 - DNA, 12930 bp, Oryza sativa
ctaaaggagttgctgtggaccccgagacagtgaccgccgtcaccgattggaagcaacccaagacagtcactcagattcgcagtttcttgggtttggcaggatactgtcgcgtcccaaatcgactctaaaatctatcctcgaaattgtccaaagaataattaaaaatcaatgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagttaaaaaggtttataaaaagaaaatcctaaaagaagtctgttttcccccccccttccctcttgggccggctcggcccattccctccctctctctctcttcccccgcggcccatcggctccccgcgcgcgcgtgccgctgacaggcgggcccgcccgccactctcgctgacgtgggacccacctgtcatccccctcctctcgccgcgcccgccgccaacgcccgtgccctagcgccgccgccgccgcgaatcccgccgctcccgtccgccccgcgtgcattcaagaggggggaattattccccgtaatcccctcccccgtttccccctcttttccctctctctctccctcggattcgttcgaatcaagcccgtaatcgtcgccggcgaaatcaatggagtccgaatcctccgcgcgcgattcctctctctccggccgctctttccttcccccggcgctatttaaaccctccccgagctccgctctttcgtttccgccgctcgccgctcactctcgccgtcgaaatcgtgctcgcgccgtgctccttctccccgccgtcgccgccgtgcttcggttagccgccgccgtcgctccgctcttcctcccgactcggcgacccctccgtcggcttcgccgcatcgtcgccgaccccgtccgccgctccgcttcgcccgtcgaccgccggagcaccgtcgtcatcgtcatcccgaaccgcgccgccgccttcttcctctccgtccgccgttctcgtcgtcgccgttgtctcggggtgagccgaagaccgtcccgttcgtttccccctttcctcctctctctcgggtgccactccgccgcgccgttggtcgccggcggcgaccatcggggcgcgggtgcgcgcttttcccgtcggccgcgccggcgaggccgccctcgggcgcgccctcgcggctgccaagtgggcccggccgtcagccgcccgcgcccgcgggtgaggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtatgattttaggtagatgcttcgcaatctaattaggtaaccctaggtggttttacaactttagacttgggaaattctcatatcacctggatactttggaattgttggtttattgtggaattggcttcacaccgccccctctattcaaaatcccctaaaatggttttaggctgggctcggggtgcatggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcggggtcggtggacattctccaggacaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttagaaactatgtcacgtcttccgtccgtataccgtggtggtatgtggcacgtggcaacacgtgaggaagatgtgtcttgtgggtaaagatgtacacctctgatcagagtataatctattcgaatagccgagccctcggatatgggcaagccgagcaatgtacccaagttagtgttttaattcttaaaacctgcttaacaactaaaatatggaatggttggcctgggttggcttgggacgagctgggacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaagttggtatcagagccttccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgcttttcttttgtttttgtttgtagatggccggcagcattacccgtcgtggtttggacatgactggcttcgtcttggagctgcgaggcatgtgcgtggtcttggggtatccacatggagtggattaccaggccaggccgcttccggatcaggagggagacgacgcagagccccacgctgcgtgggaggtcacagcagtgatcctctccggctctcccgagcggacttcgctggcagtcaccgcgggcggagactccttccccgccgcttgccagaacgccgctctcctcgccatcggcacccttcaccagcgctacccggacgagttgcagcactcgccctaccgctaccaccctcgtcgcggaggagcccgcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcaccagctcaagatcgcccagggagaggacagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaacattaatgaaccaatttaatagcagtgataaatttaagaataatagtagtcgtgggtggttagttttaatcgtcagctccttctctgtttgctggttctgtgtggggttttcagatggtgacgaccaggagaaatgttaacaccggtgaaggcaaccaacccgagggcagcaaccccaacccccaaggcaacccacctccaccaccaccaccagacaccaacgccattctcacccaaatcctcgctcagcaagccaacatgatgactgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgatcacttgggctcgcttcaccgccgctttccggagaacccatgtgcccgccggagtcgtggctctcaagaagagggaattccgggagttgaagcaaggcaaccgctccgtgatggagtatttgcatgagttcaacaatctagcccgttatgccccggaggatgtgcgggaagatgaggagaagcaggagaagttcttggcaggaatggaccccgagctgtccgttcgtctagtctctggagactacccggacttccaacgtctggtggacaagagcatccgcttggaagccaagcacaaggagctggaatcgcacaagcgccgcttggcgaacttccgcaatcagcagggtgctaaccagagggtccgctacaccaatccctacccagggggatcctcctcgcagcagcagcagcagcaacctcgctccgcgcctcgacctcaattcgtggtgcgcgtcccacagccgcagcagcagcagaatcaacaagggactcgtgcgccccgtcctcctacgccagctgtgcagcccgttcaaggccgcagggacgcttcaggtccgcagcgtctgtgtttcaactgcttcgagcccgggcactttgcggataaatgcccgaagccaaggcgtcagcaaggccaagcgcctccccgctccaacaacggtggcaaggacgtcatccgtggtcgtgtgaatcacgtgacggccgaggacgtgctgacaactcccgacgtcatcgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagtactatagcccagccgtccctatagaaattcaggggattccttttccctcggatctgattctgctagacaccaagaacttggatgtgatccttgggatgaattggttggcccaattccaaggagtagtggattgcgcgagacgcactgtcactctgtaccgaggaccagaacaaccggttgttttctttgcacccccaacctctgtcagaagttcagaactgcatcagataggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaactcaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttaatgaacaaagcgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactatcggagattcatcgagaacttctccaaaatcgctcgacccatgacgcagttgttgaagaaagaagagaagtttgtgtggagcccgcaatgcgagaaggcgttccaaactctcaaagaaaagctggtttcctcgccagtgttaatcttgccggatactcgcaaggacttcatggtgtattgtgatgcttcgcgccaaggattggggtgcgtgctcatgcaggacggtcatgtggtagcctatgcttcacgccagctacgtcctcatgaaggcaactaccctacgcatgacttggagttagcagcagtggttcatgctctaaaaatctggcggcactatctcattgggaaccgctgtgaaatatataccgatcataagagtttgaaatacatcttcacacagtcagatctgaatcttcggcaaaggagatggttagaactcatcaaggactatgatgtgggaatacactatcatcctggtaaggccaacgtggttgccgacgctctaagtcgaaagagccattgcaacactttcaacgtccgtagcattccgcccgagcttagtcaacagatggaagccctgaacctaaacatagttggtcgcggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccttatggaacggaaaacgagtatgcgtaccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctcttcaagtaccagaatggaagtgggatgaaattgggatggatttcatcaccggacttccaaaaacccaaggcggatatgattctatatgggtaattgtggatcgactaacaaaggtagctcgatttattcctgtgaagaccacttatggagggaacaaactagcggagctctacttcgctaggatcgtgagtctccatggtattcccaagaaaatcgtatctgataggggaagccaattcacctctcacttttggaagaagctccaagaagagctgggtactcgattgaacttcagcaccgcgtatcacccgcagacagatggacagaccgagcgtctaaatcagatcttagaagatatgcttcgcgcatgtgtcctagatttcgggaagacctgggataagagtctcccctatgccgagttctcctacaataacagctaccaagccagcatacaaatggcaccatatgaagcattgtatgggcgcaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgtcgtgacctggaattcgcagtggatgactttgtgtatcttcgggtcacgccattgcgaggtgtgcacaggtttcagacaaaagggaagctcgcacctcggtatgtgggtcccttccgtatcatcgctcgacgtggagaagttgcttaccagctggagttgcccgcctccttgggcaacgtgcatgatgtgttccatgtgtcgcaactcaagaaatgtctccgagtgccatccgagcaggccaactcagagcaaattgaagttcgcgaagacctgacctacgtggagaggccagtgaaaatcctggacaccatggagcgcaggaccaggaaccgagtaatccgtttttgcaaggtccagtggagcaaccacgccgaagaagaagctacttgggagcgcgaaaacgagctgaaggcagcccatcccgatctcttcgccaattcttccgaatctcggggtcgagattccgtttaaggggggtaggtttgtcgcgtcccaaatcgactctaaaattcatcctcgaaattgtgcaaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaacaaacaaagttaaaaaggttttataaaaagaaaaccctaaaagaagtcctctttcccccccccccttccttcttgggccggctcggcccagtccctccctctctctctctcttcccccgcggcccatcggcctccccgcgcgcgcgcgccgctgacaggcgggcccgcccgccgctctcgctgacgggtgggacccacctgtcatcgccttcctcccgccgcgtcctccgccgcgcccgtgccctagcgccgccgccgccgcggattgcgccgcatcccgccgtccccgcgcgcattaaagagaggggaatcattccccgcgatcccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggcatcgtgctcgcgccgtgctcctctctctccgccgtcgctgccgagctccgttccgccgccgccgccgctccggtcttcctccttactcggcgacacctccatccgcttcgccgagtggttgccgaccccgtccgccgctccgcttcgcccgccgaccgccggagcaccgtcgtcatcgtcatcccgagccacgccgccgctttcctccactccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtggacccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagacccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctagtcaaacaaaacctcaactagtggacactctactcatggtatccctagtataattttaggtagatgcttcgcaatctaattaggtaaccttaggtggttttacaactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagccgagcaatgtacccaagttagcgttttaattcttaaaacctgcttaacaactaaaatgcggaatggttggcctgggttggcttaggacgagctgggacccagggtcgggttgccagttcggtctgaatcatcataggccttgggttaaggcaggttcgtgtgggttcacggccttgattaataactttgtagcgttctaggatcgcgtttacaaagtagctttgagcaactaaatgtctttaaatgctgtttactgcaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataagttaactatttacgcttccgcttgttaaactctgatttgtatcaacttttggtgtaccttgcctcctgggacaaggattaatgcacgcacgtcaggaaagcccgttgggttatttccggtcgtgacactatatcacttccaaaatgtgaatcaaaatatttgaagacgttgatgaccaaagtttaagcacgttgattgcatgtatttccaaacatcactattttttactggacgggtagttaatcttcttcaatgcgataagtagcctaatgccacatgcgacagctaatacgcgcgcgcgcgttgccggcgcgcgttttagcccatgaggcccatgcaagcgcgcgcttctctcttttttctttttttggacgctgctgtttttttcttcttcttctatctgttgttcctgccgtacggataggataattagtttaaattagtttccaatttttactaatgattagtttactagtaatttttaaatcttaactttaaaattttcatatttggatatgaaaattttcaaatctcgagttgaaaattttcaaatcttaagttgaaagttttcaatattttcaaatctggacttgaaagttttcgaatcgagtcgaaagtttttaaatctcgagttgaaaatgttcaaatctcaagttgaaagttttcaaaattttcaaatcttgacttgaaagtttttaaatacgagttgaaagttttccaatctcaagttgaaagttttcaaaattttcaaatctggacttaaagtttttgactctgagttgaaagttttcaaatctcgagttgaaagttttcaaatctgagttgaatgttttcaaaatttgacttcaaaatttaaatattaaatcgaaagtttctaaatctaacttaaaatttttttcaa

SEQ ID NO: 26402 - DNA, 10079 bp, Oryza sativa
aagcgctctgggccgttcacttggacggaggaagctgaacatgcccttactcagttaaaggcatatctcagctctcccccggttctagtcgccccggagccaaatgagcccctgctactttacttagcggcgaccccccaagtagttagtgcagcgttggttgtggagcgcgatgaagacaatcctcattccgcgcacccccaccctgtgccgacttggcccgggagcaagcagggaggaaaggtccccgagtcgaacggtggcctaaggcccctgacgaccggagtcggccctctgcccgcttgtcaaacggtgctgggtgcccccgaccctcaggaaggccccgaggccactgagggaaggccgcacttatcgccctttggccccgaggctaaccctgtgctgactcgacccgggagagagcagggagaagaggcccccgagccgaaaggaggcctgaggcccctgacgaccggagctggccctttgcccgcttgtccgatgacgccaggagcccccgacccccaggacggccccgaggccactgtgggaaggccgctcctgtcgtcctccgaccccgaggtcatcggcacagaagacgagtgcgccccgaggggccacctggacgaagaacgccccgggggtacggcccctagcgaagaggatcggccccgccgaaaggtacagcggcctgtctactttgttagtgaggccctccgggacgccaagacccgatacccacaggcccagaagatgctttacgctattctgatggcctcgaagatactgcgccattatttccaggcgcatcgggtcactgtggttacgtcttaccccctcggtcaaatcttgcataatcgagagggtacaggacgagtggtaaaatggcaatcgagctttctgagttcgatctgcactttgaaccacgccacgctatcaagagccaggccctcgccgattttgtggcagagtggaccccggctccagagaccgtctcaatacccgaggccagcacgaacccctctcagctgcctcacaccgcccactgggtgatgcagttcgacggttctctgtctctccagggcgccggtgcgggggtcatgttgacctctccaaacggagacgtcctcagatacttggtccgtctcgactttcgagcgactaataatatggcagagtacgagggactccttgccggactcagggtggcagctggactggggatccgccgcctcttggtgttaggcgactcccagctggtcgttaaccaggtctgtaaggaataccggtgctctgacccacagatgaacgcttatgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccaatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggagttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaggcaaatccatcagccggcccaggccctgcagatcataccactatcatggccatttgctgtctgggggcttgatatcctgggaccgttcaaacgggccccgggcgggtttgagtatctgtatgttgcgatcgacaagttcactaagtggcccgaggcttatccggttatcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgtgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaggggggggtcgggtgtcaggttttggctcaggccaaccccgcacccccctcgggtgtgcagggttggccgggggctaccacacatgcattacattcttatttctcttttttcaacatttcaatagaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgcgtatgtatagcaaaataaaactaacacaaaaattttttcatcatttctgattgcagattaagttaatttgtacaaaaaagaggcatgaaggccttagaagaaagaaaaagaaaaaagttaagattggcgggggcctgggggctcattctgacgcgcccagttcgccggcctcgttgccaccgtcgcttgcactgctggcgttccccccctcgtcggagtcgggggcgaacgcgagccgaggggccgagccctcgaagccgttgacaatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggaggagtctagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcacaggcggcctcgtgcgccgccagcgtcgcctcccggagagtagcggcggcctcgcggcccgtcaagcctttctccacggcgccggcgtgttcttccagcgccatagcacgggcctcaagggactcctcgcgccgccgggacgccgcctcagtctctgttacccgccgctctcaagcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgggctttacggcccacctccaccatggcgtccaccgagcgccgcccctcctcaacgcgtgcccatgcggcctcgagctccgctcgttccgcgcgcagggcctccacttgggcgctaaacccatccagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgctgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctgacttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcctagcatcactatctcccgaccggtggcggactccggcatgaagcggcgcggcagtccggcgtgcctctcgctcacgatgcgggaaggcggtagtacactgccatcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacaccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcaccggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaagggactttttccctagaacaagggaggggaaaggaagtgaatcctttgtaacttgtccatacacaaatccacaaaaacacaggagtagggtattacgcttcgcagcggcctgaacctgtatacatcgccgtgtctcgtgtgtcttgcgggcgggtgatctttccacatacagagagagagagagcttgggattgcaccctaagcccctggtcgaaccggcaaaggggggcttgcgcagtctcccggtgaggggccacgagctccgtcaaacataaatatggtattttttacgtttagttgttcttattgagacgagcatcttcgccccatctttattttaattctgcatccgccactgcaccgtggcacaacacaaggagcagaggcgcgcaagaaaattgctgagaaaagtcacatgacatcatgaattttggcgagacctagaccatccaaagtgaataaaacttattggtacttttagaagcctgaaaactagatacaattaaaattaatatagttgtgtaccactgtatcccgatggatttgaactagttcggcatcaacctagagatccagacttgcggtaagttctatttgttaaacaaattttcaaaaatgtctaaaatgtaaaaaaaaaatcttgccacgctgcatatgtgctgaatattggcttgctaaacacgacgcttccatggacgcgggtgacgcggcttcctcgccaactgtaccggatgcgttcggtcgcggcacgttggctttgcgtgttgtcgagttcccacatgctatcgcccaataaaacccacctcgtcctcgtgtccattcgtcctcatcccacaaacccctgagcgagcgacccaccacaccagtaaccataattaacctcttcctcactgactgcacctgctctgtcacaccattcatgcccgtgatatcctggctccacgagctctgctcccccacctgctgcctcggcgcgccgtcgtcccctcctcatccccccgccgactccgacgccaagaaagacgacgcgatggccgccgccgccgataacgaggtggccgtcatcacccaccgcaccgtcgacgccaacggcctgcggatgcacgtcgcggaggccggcccgcccggcgcgcccccggtgctgctcctccacgggttcccgcaggtgtggtacgcctggcgccaccagatgcgcgcgctcgccgacgcagggtaccgcgccgtggcgcccgacctgcgcgggtacggcgactccgacgcgcccgccgccgagctgcagtacacggcgatgcacgtcgtgggcgacctggtggcgctcctcgacgccgtggtcggcgcggggaagccggtgttcgtggtggcgcacgactggggcgcgctcacggcgtggaacctgtgcctgttccgccccgacagggtgagggcgctcgtctccctcagtgtcgcgttcaccccacggagccccgcgaggaggcccgtcgacggcctgagggcgctctacggcgacgactactacatctgccggatccaggtacacaatacaacaaacaccttgcgatctttccataaatcgcagatagcttgaccgatcgattgatttcaggagcctggagcgatcgaagctgagttcgcacggctcggcacggagctggtgctgaggaagttcttggcttaccggatctcttggcccgctgatgatgccaaaaagcgggtgggggtcgccggacgaagaggtgcctttcccaagttggataacaaggagggccttcaggttatcgcgagccagttcgacaagactaatttctaccggagggtttactactaccgcgccctcaacaagtaagccatatcccctactacttgttggaaatatattatcaggctttgttcaaaagatgttcgatttggctgtgtcgtagggcagaggctagggatataaacgctttgatttggagtcaatttttccccaagtaaaattttagtc

SEQ ID NO: 26403 - DNA, 710 bp, Oryza sativa
attcctgcagccctgattctcaactggtgatatcctgatcgaagatctatcttggagaaaacggtggcacctttaagctgatcaaacaaatcatcaattctgggcaacggatacttattcttgatagtcacatcatttagtgcacgatagtccacacacatcctctgggtatggtctttcttttccacaaaaataactggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcgggatactcccggactacaggaatctcttccaaagttatttggttcagtcttgaccttaaagactcagaagacaatgcatgaacagttacaactcgaccatcattgctggtgagagttacttttctgttggcacagtctatcacacctttatatctggctaaccagtctatccctaagatgacatcaatgtctttggattctaacaggataagattggccagaaatggtactccctgaatttctattctgacagaggggctacgttgcaaagagagtgcctgattacttggggtactaaccatcaaaggatg

SEQ ID NO: 26404 - DNA, 732 bp, Oryza sativa
attcctgcagccctgatgttcccgcaactttcccaacaccagacggagatggtgctgatggtcttcctctgtttgtgagtatatcagaatgtcgtcgatgaaaaccacaacgaacttatccaagtattccatgaacactttgttcattaagttcatgaagaaggcaggagcattggttaaaccgaacgacatcaccgtgaattcatacagtccgtatcgcgtggtgaatgcggtcttcgggatatcttcttcacgaatacgtaattggtgatatccggaacgaagatcaatcttggagaatacagtggcatctttaagctggtcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttgggggtgcaaagaaaccaaccgg

SEQ ID NO: 26405 - DNA, 1375 bp, Oryza sativa
gaatcagatccgagggaaaaggaatcccctggatttctataggaacggcagggctataatactttgctgtcataaccccgccaggggtggtgatgagcagagggtttctaagcctttctacccccaactgatttctccccacgaatggcacagatataaacgagtgggaagctccagagtcgaacaaaattgtagcagggatggaatggacgaggaacgtaccaacgatgacgtcgggagttgtcagcacgtcctcggccgtcacgtgattcacacgaccacggatgacgtccttgccaccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggtgcacgagtcccttgttgattctgctgctgctgcggctgtgggacgcgcaccacaaattgaggtcggggcgctgggcgaggttgctgctgctgttgctgctgctgcgaggaggatccccctggatagggattggtgtagcggaccctctggttagcaccctgttgattgcggaaattcgccaagcggcgcttgtgcgattccagctccttgtgcttggcttccaagcggatgctcttgtccaccagacgttggaagtccgggtagtctccagagactagacgaacagacagctcggggtccattcctgccaagaacttctcttgcttctcctcatcctcccgcacatcctccggagcgtaacgggccaggttgttgaactcatgcaagtactccatcacggagcggttgccttgcttcaactcccgaaattcccttttcttaagagccacgactccggcgggcacatgggttttccggaaagcggcggtgaagcgagtccaagtaataggttgcccttctggctgcgtggcctggaaatggtcccaccatagagatgcgggcccctgcagctggtgggcggcgaagatgactttctcctcatcactgcactgcaccgtgtctaacttcttccccacggcatgcaaccaatccaacgcatccacggggttgttggagctagagaaggtaggtggacggatgcggaggaattcggcgagtttggagtgttggggaggtggtggtggagcattctgttgtggcggattttggaggtggtggaggaaagcattcatcatgttggcttgctgggcgaggatttgggtgagaatggcgttggtgtctggtggtggtggtggaggtgggtttcccttgggggttggggttgctgccctcgggttggttgccttcaccggtgc

SEQ ID NO: 26406 - DNA, 5566 bp, Oryza sativa
gaaaagaaaaaggctttaacactaaataactccacataacagcagaaacaaagcacaaaaatgggttctttacatcttgaggaaaaattagagacttgaacggtccaattccgagttcaaatggccaagatatggccatttgaagtttatatgctctttaaatggatatttgcgaatttcttcatttaattttcaattaaaaattcggattattgcgtcagccgagggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcacccgcgccccgatggtcgccgccggcgaccaacggcgcggcggagtggcacccgagagagaggaggaaagggggaaacgaacgggacggtcttcggctcaccccgagacggcgaaggcggtggaaacggcggacggagcggaggaagacggcggcgcggctcgggatgacgagggcgacggtgctccggcggtcggcgggcgaagcggagcggcggacggggtcggcgacaacacggcgaagcggacggaggggtcgccgagtaaggaggaagtccggagcggcggcggcggcgaaccgaaggtcgacggcgacggcggagagagaggagcacggcgctagcacgattccgacggcgagagcgagcggtgagcggcggaaacggaagagcggagctcgggcaacgaatatatagcaacgggagggggagagcgcggccggggaggaaggaaaccggccgcgaagatctcggccgccattgattgcgccggcgactaatgcggtcacaattcgaacaactccgaaggagagagagaggggaaatcgggggaaacgggagagggaatgacggggaatgattcccccttctttaatgcgcgcggcgacagcggaatgcggctcattccgcggctgcggcggcgttaggtcacgggcccagcggcgggcgctgcaggatgaggagaatgacaggtgggccccacccttcagcgagagtggcgggcgggcccgcctgtcaacggcacgcgcgcgctcggtgagccgatgggccgcgggggaagagagagatagggagggaatgggccgagccggccccaagaaggaaaaagggggggggaaacagcagttcttttagggttttctttttataaaccttttcaactttgttcatttcttttcaattattatttgggctctgaaaattccactaaaatttgtttaagcattttaggcttttaggaaatatacaaaaatcctccaagcctcatttgacttttatctttgcacattttaattgttggaggctttcacatgaattttaattattcttttgcacaatttcgaggatgaattttagagtcgatttgggacgcgacacgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcaggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccgagcctctcgtcaccaccctcgggcttggtcgcagcagcgaggtggtccgcgcgctgctccatgcaagcgagcgcgactttaaggtcgccacggacagagatggggccactggggcccggcatcttcatctggaggtaggcgtagtggaccgccgccataaacttcaccaacgcgggccttcccagaaccgcgttgtagggcagactaaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaacctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccatcatcgatgccaacggcgggggccttctgtctggcctcacttcgccgtttaccggagggaactgccgcagacttgccctcacggcgttcctgcctcctgtcctcctcccacttcctcgttcgctcagccaaatttttgactgcgcgacagtccgcgagatcgtggagggaggtgttgtggacggagcaccacttgctggccgggcgctccctgctgggagtaccagcctctttctttttgtcgctcgcaggcctcccctttcgggtggcccgcggagcgccctcgacggcgaggacgtgaccctcgtcgccggaatgggccgaccttttcttcctcctcctgtcacgccgccctgtctgagcggcggatccgggggcggccgaagctgccacaccggaaccggaggggttccaggtccaggcctcctccttgcgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcacctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtcccttcagggccatgggaaagaaattagccatgaccctgtcgtctcccccagcggcctcgatcccggtcgtatagatctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggcagccgaatgccgtgcagccgccgccgctcgccgcgccctccgccttgatgacacggaaccggtggtggcggcgccggaggtcttggtagtggcggaccgtccaccagcacccaggcgctgctgggccatcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttcccctgcatcacccgcaatcggtgatgctgcggatttatcaactctctcgagcgcctccccctgcttaggactttggagtggaggtgggggagtacgagctcgacggcgtgggttcggctccccgtcgtcgccgctcacactcggagagaggtcgtgcacctttgcttgctcggccattaggctgaacaaaggaaacttggcacacacggaagagtatgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctctgtatgtggaaagatcacccgcccgcaagacacacgagacacggcgatgtatacaggttcaggccgctgcgaagcgtaataccctactcctgtgtttttgtggatttgtgtatggacaagttacaaaggattcacttcctttcccctcccttgttctagggaaaaagtcccttctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccggtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctacgagatagg

SEQ ID NO: 26407 - DNA, 2916 bp, Oryza sativa
  unsure (1)..(2916): unsure at all n locations
cagcgtgacacgcttgaccagactgcaataaatgctggtaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaatgttgtaatcatataaatatatagtataatcaataaattaaggcaaacaaaaaaaataatattaaaataaagtaataatttttgcaccatacataattcatcatacataaaaagatactagtaaacatatcaatttcaatttgcaaatatgagtcaattcataaagcatggttgatatatatcttttaaaaaataaatatatgagaagatatcgcatacccaaaataagatgattattattttgcttagaagggagagagaaaaaattaggcacctaactatagtaggagacgggggtgagcagtgtcgaggaattgactcaggaaagcatcacatacgcaggattaaaattgaacacttggactgcttatttatgggtcaattgtgaattggatatggtggtaggtggcccaaaaaggatatggagggttggggcggcncggnccgtanctgggccagccgcccaaccccgcctaatgggtggtatcgcccctgccaccgtgctactcctatcctacgcggtacttccctacttgtcgctaatgtcaacagaacttaccatagcagctttcactctaccccaaccccatttccccggccactccttgtggtgagtggtgacaaggtgtcctgaaacgccaccgtcctctacctcctaaccactcgtgatcatacacctcccatcactgacccctcctactgccttcctccaacctacggctttggtggcattgccatcgcctcactgttcacctgtatctgtcatccaccacggtccatcatcttgcgaccatcccttcgaacccagagaaaccacctcttcctcctttccttcgttcctcctaccccccccaaccctaatccaactcactactaccattggtgaccatacttgcctgtgtcagagaaaaggaagagccccccccccccccccccaaccacatatcctgagcttgaagacaatgtcattgaattgaaatttcttccattttcagacacttgaaacctagtgatcacattaattttaatagcaaattgaactttgtacatggtaaaatgtaacatatttcgctttgcaccagatttagcatatgttttcactttacaccaggttaaattgaaataagttttatttaacacctggatatatcatcaaacctattaaatttcatgagtttttataaaatctaaatgaaactttgtgaacacagtagagtcaagaagtttaataagttatactcatattttaacaaaatctcctttcatttatatgataatacctccaataaaaaatataagcatttctggcggtttttacgggaattaaggaagtagattggatgaaatagtgaaaggttatgattggttgagaagacaaggtaagtgaaaaaattaaatgcaagagggttgtgattggttgagatggggtggtaggtaaagaaatagctatattttgagagaaatttgaactctagacaacttcattttaaaacgaagggaatacaatttagtgcaaagtgaaacttattggatatagacatgtataaattaagtgaaagtaaactggatgttgaaggcaagaatgtacactctacccgatgccaatttactctaattttaattgcaaaaatatgacaaacaaattacaaaagcatgttttgaagataaatttttatatgatttttatgcatcaaatctaaatatttagaaagtgttagtacccacagctttgaatatctaatttcatacttgtacaaaatctcattgtggacaaaacgagtatgctgttattttttttctgtagtgcattgatgcttttcctcgatagaacaagcatgatgatgagtattagtatggccaagcagatcagctgcaactttaaccatcatgttgcgcatatcggcatatgtttatgtttgctacatatgcgttgcctattcatgtgaacttggaataagtcatcgcttcgtggatgcgctatgcacgtggataacttaacttttatggctttgtggcaagaaggttcacatgtgcaacaaattctctctccgtttttttaatgtatgacgtcgttgactttttaaccaacgtttgaccattcgtcttattcaaattttttatgcaaatacaaaaatacttatgtcatgtttaaagaacatttgatgataaatcaagtcacaataaaataaatgataattacataaattttttaaataagacgaaaggtcaaatatttattaaaaagtcaacggcgtcatacattaaaatacatacggggggagtatatacttcaggccactgggtctgtgttgtattatcactagttcactacatcccaaaactcaactcttgccttcttggtggagtgtgagtcagtgcattgggccattggccggccggtttctccaagttatgcataatatacatttgtatatggagattccagaatttatttagtttataacacaaaaatatttgcaacaaggtgtgtcccacaaattattttcattttaggttcaatttgaattagttagacggctgtagctgttggtggctcggaaaacgggacgaatcatttgcacatgattaatcaagtatcaattattataaacttaaaaatagattattttatttttt

SEQ ID NO: 26408 - DNA, 2691 bp, Oryza sativa
tgtactgtttatgtaccagcggtccgatggagaccgattaaggttgaacatacatctagaactccaagtgtaacaccccagaaaaccacataagcctgggatgccactaaacaaccatacaaaagtgccaaaataagcaaatttcagcaacaactaccttagataagaaaacatcaatacaacaagacaagcaacatgctaaacaagcattaaagaaatatgggaatcataaccatttgcaatacaaaataatagttggatgcaagttgcaaacccataaccatcctatatgtgcatgtgtgtcaagttaatcttcattttcataaaagttgtaggtattgttctgtagatttccaaagtgtatttatttgcagtcatatcctttttatattttgagatataaatgtttgaatcagcagtgttgtttatagtccaagcggcgttccttgtatttgcgtgttaacgggctagggccataggggcatattatttattgttttatatgcatgtttgagtgtatatgctgaggttgtcttgtgaataggtggtagtgcttcggattatgcttggtatcgtctcttcgttgttagaggcaagtaaacgtagcggtggtttgctatagctttaacctgttattttattctaccttcactttgaaaatatatatcatcaaccgagatattattattcgttacatagaggatttacctatctgaatcacatattgatttttacactgtatatggttatacttatgctcttggttataatacccttatactgatctccatcgaaggaatgtggttccgatattctactctggaattcatactgcatttgcatcacttgcattgcatttgaagttatgtcgtgaacctatggttgcgaccgtaccggtacagcatcgtatattgccgtaatacgatgcagcttcataccttattggatgtgaaggcaggagtacatatcattgcattgcatatgcacttattcaccttgttgggtgtgaaggcaggagtacatatcattgcattgcatatgcacatattgcaggatgttatgagaattatcgatcgaagatatctttgagaagtgttttcttctctgggatttgtgagtatatggatttgattggtgacgctatggtgttttagtccttggatattgaacttgtctttatgtgaatcataacttggtatataattagttatataataaacatgtggtttaaatagcttgttaaagccgtttcttgctaagatttattctcacccccttatagtcttttcaggtacttgctgtgacatgttggcatgtagggatgggattagctacacagtcgcacaacatgatctcacttagtcatgagttttgtaatatactgataagattacttgtgtttagacataatgagctaattaattactagagttgttgaccattggttaactacttttttcaagcctatccctatatgtcagtcagttgttgtatcataaacttaatctatatgttgatgcttccgtgatgttttcttgtctaaggtagttgttgccgaaatttgcttattttggcacttttatatggttgtttagtggcatcccaggcttatgtggttttctggggtgttacaccaagctacacttactcacaacttgaacaatggactacgccttgaattgcaagtcttgtgcaagcaagtttcactcagcgtcttatctggtactagaccgtctgtagactacccctcgggtggagcgtataagtcatactcctaggtctttagtaagcttcctagaagattcacccaaaatctctacagactgcgaccaacagtcaagctcacaaaggtgagttctttcaagaatgctctgcaggacagcatctgcgctaattaaagccaacagaactcattaaggcatagccaacctgccttgcagctcacgagagtacatgcatcttcacttagagagggtatagattggtactctcctctagtttattaatggtttgttcttcccaggttctaattcacgggatcttcgatcacatagattgggttaccaccatagtataactcacatgggtctcaaacccatctccttcgatgcattgtctatcacatttcgtgatagtcccttcgtgaagggatatgccaggtttctagctatttggatgtaatccaacgttataactccggagtttctcaaattcctgacagacttcaattgtcttttcacatgtctagacgatttcatattatccttagaactattcactttgacaattaccgttttattgtcacagttcataaggatagccggcaccggtttttcaacaataggcagatccattaatagatcacgcagccattctgcctaaacagtagcagtatctagtgccgtcaactctgcttccatggttgacctcgtcaaaatggtatgtttgcaagacctattccgccgctgttttggtcatcggtgagttcgccgcgtcgctctctacgtgctggtgccctccgttcgcgtcctcgcgccgtcgttcgccggcgagcatgcgcgcccgagccgccgccagaggtgacgtcaccgctgacgtcatcgtggccgtctgccgtggccggtcatggaccgttcgatctcagccgtccgttttggataggatcgatctcggtcgttcgtttccgtgagc

SEQ ID NO: 26409 - DNA, 1671 bp, Oryza sativa
ctattcaactattgcatttatttttcgaatgtcattgggtggaattaacctattgtttgttatagccctttttgttcttgattactttattccttgataccttgggttattacaacttgactagttgggctatatatgtattggttcagctagatattagatatgattgcttagccatgcttagaaacattagcacacttttgggttaacttatgattcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttctgttgtgaaacattaaccgtgccaaccacaagccagcgtgggcaacggctttaccttttgtatagcatggttcattgcggagcaccaatctgagaagtggcggagataagcccacgggagtcgctggggagtccatgccttgtttataagagggtgattatgatccaggaaaggtgccctgtggtggattgtgttgtgcgaggggtattgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctatacaacagggtatgttgtatagcgttggattaatattgtttaattattacttaactattttattaaattctgaaatgtttattaaatgctgtttatgcaaatgaaaccctactatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagccgtctgcgccgtttatttttttttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccggccgtgacaatctagtgccgtcaactctgcttccatggttgacctcgtcaaaatggtatgtttgcaagacctccacgaaacagcaccaccacctagttagaatcactataaccatctagtaccgcaggatacctagtatagtgaagcctcaattccatagtacctttcagatagtgcattactcgctcaagcgcacgcaatgatcatctcccggattagaggtaaaccgggtcaacttgctcacagcaaaggagatatcaagcctatttgcactaaccaagtacattagcgagccaatgatttgggagt

SEQ ID NO: 26410 - DNA, 765 bp, Oryza sativa
tcctgcagcccgccgtatgtagataatttctttgacatatgacaaattaaaatcatatggataaaagacttgatagtggttcaaggtatcacaaatgtcaaattattcggttcaaattaagtgaaaattagtttaaaggtgatgcaaagcgaacattgataataaagagtagcctaagtgaaattcactcttacaaattatacttgattttaatttcaacaacttatttttcgttatttttgttaatacattttttttattttcaagcaatatataggacataatagacacaggtaaactacatgcctcaatttttgatgaaacctattacattttgtatttggatgaagaccatcctagcaaaatccattgtatttgaaaaggctaaaaatcataatattccttgtttttctctctctttttacttctttaactttcatctcctcttctcttttgtatatacatttttaatctttacaaatttttttaagcttctttcatctgtaaaatgtaagtaacttatctatatcttatcacttctatattttagagtttgtctacattattttttccacccctcgtaaggtgggcagggaccaagcccgagggaagcttcacgcctgtgcttgccccgtttcggccgagcaacgtgccgtcgtgccctcgtgaaagcgccgtactcttatcctagcaaataaaaggcacactgttttttttacaaaaatttgtgtgtacataactatcttttgataaaatggacatatg

SEQ ID NO: 26411 - DNA, 700 bp, Oryza sativa
acttgcctagtatggtgtcatctgatggttgcctgaactgtaagatgcatactgatgatgaaaaactcatcaaagaggtgactgtctttgagataaaaagaagggaatcgggagctgctattgtctgttctgatggtttgtcacaaaagcgtcagccacgagatatgtcagttgattggtttgaggaagaaactaaaagtggagatatcatcaaatcaggtgattcatctccaactgtactgtcaactttttcatctgaatttcatgatttctctgacaacaatgaagtggtagggttggccacggattttcttgatgtaaacaatcaaaataaagcagtattgctagatagttcatctcatcgtggtatcatggacaatcattgcaaatgtggtgaggaattttcttctgataaggaggctccagcttaccatttatttgaaaattatgattttgttgacaagcatgaaacaaaagaggtggtacttggtgatacagtagtcttgacctttgtagatgatttagccaatgatgactctgaatatagggaggatatttcagaacaaaaggatccaaataatttatcaggattgcttgataacgttgcagatattttttaccagcagcaagaaatacataaggtggttgtttctgacgacaacaagccacctgaagttttgttcctcagtggaaagcaaac

SEQ ID NO: 26412 - DNA, 3007 bp, Oryza sativa
atttattagtaacacgtgcacagaaaagtccaatgtcttcttttaaatttgttatatgaaccttataaagttatactatctgctaagaaacaaatatgactattcatcttcatacactttcaaggcaaacaatcatgttaggaaacctcactaaaaaaataagagtaggaagaagcaaaacctggtagagcttgacaacaggctgcagattggctgttctcttccgcagagcatgtgtcagacggtcaatgtccgacattcttttgagttggtacctaagtccctgacgaagctctggatcttctacgaaagcctgaaccatatctaatctgttattgatttcatttacatctagcagaggttgtttcagccatctgttaagcagtctctttcccatacctactgtacaggttctgttcatcaaaccaaacaaactgaagttcttgtttacatcagttttagcttcggcaatattcaatgctcgcacagcagcagaatcaagacgcatgtagcggtccaaactgtatttctcaattgtgtaatttccgtagtttgtatcatctgctagcaactcagcatatgaaactagagctccaagggcacccaatgcatagtcaaactgagatacaagatcacgaactggctcaacaggacctctgattattctaccaagatcctgcacaagatctctggatttaaattcaaccttctttctttcagttaatagaacattgcagttagtgatagcatcctgaagaggcttcaaatctatagatttctcacaatctgctgggagaagacactccttgcaacctaatgcaacaagggctgactctacatttgtgaatcgactatcttcgggaaactcagacaacccaagcttcctgtttgtcaaatcaacaaaactaagacctacatatagttgtgctttctggaacacaggaaacaatgccacagttaccggagaatcttgcatgtcattgtttgcaaacagaatatcttcaaaactgccaatatttccaggtgttccagattttgttaacctccaactagacccacttccctcatagagttccaatgtacggtctgtcctctctaacaaaaggttgcgggcgatggtctcaaacatagtcttgctcacactgacacttgagagtccatcagagttgctacctaattggcgtaaggcagacattgtgtgatagtatatttttgcaatgaatgtggcattctctccatgagcagtgtaataatcctggtcaaatatttcagcattagtttactggtcacacttttaagagcgaaggcagttttacataggatgataggaataaatactattgatcaaaaagaaaaaaaaactgatcttttttgtttgagatgaagaaactgatatcaagctcagcaagaaactttgaccatgatttttgaacagtggataatactgagaactccacaacaattatgaaagcatgttgtgaaatagatcttacaatgcaattttcaacctacaaggcataataatatagaaattgagtttgaacaggtgagtcagagctgtcagtatttgaaaaacaaagagagtatatctcaacagctgtgattcattatgaacaccaactacttctgatgatacaacgcgtatactgtgaagagaagtgtgaaagtgtctgtgcgcgtgatttatgaaacaccaacacacatgtgcctggctcctgaaaggggacacacaggtaaaggggtaaaattactttccaaagctatttttttagaatactgtacattccactaatttgttagataaacatttgtgaacattcggccattttatcaataaactgagaagatactagacgtgacaaatatattcaaataatatatagcccgaatttatcaacaaagcctatgtcttatacattggctaatggtggcctaattttccagtgcatgtaaagtctacatgaaactgaagcgtagcatatcatcggaactatgatggagctctgaaacttttgtcaagataaatcttaagtttccttcaaatgacaacttgagttatccggaagggtaaactgacactgacaacttggattgaaaaaagaaaaaaaaaaactgtcactgaaagcctgaatagagacaaacaatctacagtcgtattaggggaagacagatatgcactacttctcataatattacaattaatggaactaattccccattaggtttgcacagtggctcatcaagaaaacaaaagcatctacatgtatcagaagtcaatgttaactgcttacccgccgatcgaagagacgaatagccctcgaatcctatacatccaaaaaaagaatgaacaggttaggaaaagaagccccgaaaatttgtccaaataagggaagaaaacaaaaaggaaagagggagaaaccaaggggaaacggacgcacctgcggcagtttcttgaagaaagagatgaagccctgcgcttgcctcgcatctattgaaccaaacaacaccaagtgagcgaaccaaagaaagaaggaaacggatccaagaactgaagcgcacggacctagcttgagctcggggagcttgccgccctccggcaagaagtcgtcgccctccatcccgccgcagatcgccgggctggatcgggcgaggtggtggcgatgggggacgcaggcgatgtgttcgacgaaatgcgtaggtacgcgcgggcggggtggggcgggaaaagggttagtgttttagggggcagtggagaggatggcgcgcgcccaggtgggtatttcgcggcaaaaaggagaagattgggggggttttggagggtgagcgactgatggggtggtgatggggtgcgtgcggtgcgggagccgaggcggtcgacagattggccggcagcccggcagcagtgagcctgtgttccacggtccggtccttttggggcgatgggctcatggccgatcaactgcgcaacgctccggtgcagccccgcacgatcagttttttcttctag

SEQ ID NO: 26413 - DNA, 5069 bp, Oryza sativa
  unsure (1)..(5069): unsure at all n locations
attcctgcagcccggatggcacttggaacctttgaccaaagtgaattttggaattaaactcatgttagccaagcgcgtcatacaatcgaaattcacatgacaaagtcgcgaatgccacacattggactcatcattctcgttaatatggttcacaacgttattattattacacatgtcatccaaagaaatcggaacaagcatccgctgtcataacctttcccaataaaagttccatatttagatacgacacatttattggattcaaacacaagtctaaaaccatctctacacagtagagagccgctaactagattcttctttattgaagggacatgttgcacgttcttcagctgcacgatctttcccgaagtaaacttcagatcgaccgtaccaacaccatgaatagccgcaagcgacccgtttcccatcaacaaggaggaacctctcccgacctgataagaagaaaacagggaaatattagcacacacatgaatattagcaccagtatcaacccaccaatcaggtgaatgaaaaacagagagtactgtaggtaaaaatttaccgtaccccgatgttcctccgccctcactaatgactatgttagcagacttcttgtcattgcgctcaggacaatccttggcccaatgtccaggcttgccatacacaaagcaatctccctttgcctttcccttgcctttcttcttaaaattggttgtagccttgggtttgacatcaggcttgactttcttgttgttgtgggatgcgtgagggttcttcttctgcaccatattggcactagaacctccctcgatctttttgccccggttgtcctttgccctcgccttctcctcaacacccaaagagccaatgagatcattaacactgaactcttgtctcttgtgttttagagaagtggcaaagtccgacaaaaaaggtggcaatttggcaataatgccacccgccacaaacttgtccggcaactcacagttgttgttctcaagttccttgccaacatctaaatctcatgagcctgttctactacagaacggtcatcgaccatcttgtagtcatagaactgctccatgacatacagctcgctgccagcgtcggaaactccgaacttggcctcaagtgcatcccacatgtccttccctgaaggcatgtgcatatacacatccactatattgtcagcgagtacactgaacaatgctccacggaacaggcaatccgaagcctcgaacttagcctcctcctcatgagagagaggcggttcacttcgtttgcctcgtgaaacatagaagcattgcatcaatgtcaaccacagtagtgcacgtgctttccatctcttataattagaaccatcaaaagcatgtggtttcagtgttgcagcaaagccaactaccgaaaatgacctatcaggtttttggattgttggaaatatggtcataaatcggcatattttaatccaaaatattaagacaataaacatgacttgcacaatgtgaagtgatctagtgataaaactaaacataaccaggagcatgcttaaggtaaaataagcatcaacattgagacaatgcaataacattgcgactgatagttttaacaaaatgaaaggcaacagaaggatgttataccctgtgaaagtccctccgctggattatgaggcagttttgcattcgttggtgttgttgatcagtgcgccacctcctattccttgcacaccacctcctgccgcaccggatgcgccaccaccagtagacatgatgcagaacgaaccgaacgacgatggagacgaagaagcgagcggagcagtcgtgcggaagcactccctaaaaatctgatcacccgcctagccgtgcagatctctggtgaaggtgtgggttcagaggccctgcttgtcccaatcacttgtgcgcgcaagcgatcaaaaccggggaagaacataacagaggcagcacaggcacacatacgagaaaccagcaacggaaagaattcgtagaatatctgatcgtcggtctctgtctcgtcctaatagcacagccttgcgcgcacaaaaccggggaagaacagaacagaggcagcacaggcacacatacgagaaaccagcaatggaaagaattcatagaatatctgatcgtcggtctctgtctcatcctaatagcgcagcccgttacagaggtaatctcgcggagttgaattctgaaccattgcaaaaggatcgagagagagagccgagccgcagatgctgcgcgtgcgcacacgcctcgcccacggcctcggcccggcccgacgcgcgcgcgcgtgtggctttccgacccccactcaacgggtcaacagggagcctccaataactccctctttaagttgaggtactccacttttaatccccaaggtggcattattatctttaacatttattatgggcccatgagattttaatagaaataaatcaggtctagcctattattctaacaatccccaccaaatttcacggttcataagaaatgttctcaaagttgaacctgtttgatataccagtgtttcggtggagactgttaagttgaacttccacctaggaaaagagctacaccagagcacaactgaacaatagactatgccttgaattgtcagtcttgtgtgatcaggtttcattcaaacccttgactggtactgggctgccgtttgcatcccctctgtttggagcatataagtcaaactccatgccctttcatgagtatctagagatcacccaaatctcatagactgtgactagcagtcgagctcatataggtgtgttccttctgagatgttctgcaggtcaacatctctacttaagaaaagccactcggatcacattaagccataagccatcctaccatgcataatagaagagaagtacaacatggaaatgagccctttaagggtctcttctgtcagccacacaatagtttgtttcgccatccaaattcacgggatctccgatcacaatggacaggtttccactattgtgcaaccttagatgggtatcaagcctatttccctcaatgcactgtctatcacattacgtggtagccccttagtaaactgatctgccagctttttagccgtctggacatagtccaatgctatcactccggagtttttctgctttctgacagatttcagtcttctctttacatgcctagatgacttcatgttgtccttcgaactgttcactttaataatcactgtttgattatcacagttcatcaggatagctggcactggtttttcaaccaccggcaaatccaccaggagttcacgaagccattcggcctcaactgtcgcagtatctagtgctgtgagttctgcttccattgttgacctcgttaagatggtctgcttgcaagacttctaggaaacaacgccacctccaagtgtgaacacatatccacttgtgcttttatctcatcagcatcagatatccagtttgagtcactatacccttccagtacttttggataccggtataagtgatttctatagctcatagtgcccttagatagggcatnactctctcttttcagatttgaaccaaactggctcagcttgttcccagcaaatgagatgtcaggcttcgttgcctagccaagtacatcaatgaaccaatgatttgggagtatttcaattgatcccttgctattcttcggctttccttaatagcacactggggtcataatgagtaggagctgccttgcagtcactatagccaaagcgactcaaaacctggtccacataatgggattgcacaagtgtaatcccaccctcatctcctcttagtagcttaatgttaaaaataacatcagccactcctaaatccttcatttcaagtcttttggacagaaagtcccaaagatcaatatgtcatcgacatataaacacaagatcactcattctcccccaccatagcgatagtacacacatttgtcagcttcgttcacaacaaagccagcagatgtaagtgtggtgtcaaacttctcatgccattgcttaggtgcttgcttaaggccatacaaggatttcaactgtttacacaccattccctcctgaccttctagtgcatacccgtctggttgatccatatagatctcctcctccagctctccgtttaggaatgctgtcttaacgtccatctaatggacgagaaaaccatgagaggctgccagagcaagtagtactcgaatcgtggtcaagcgagcaactggtgagtatgtgtcgaaaaaatcctcgccttctttttgggtataacccttggccacaagtcttgtcttatacttttcaattgtaccatcaggcctaaactttttgttgaaaacccatttgcaggcctaagctttttcttgaaaacccatttgcatcctacaggcttgcacccatatggacgctcaacgacttcacaagtaccattaaacataattgagtctatctcactgcgtaccgcttcctttcagtagttagcgtcaggagatgaatatgccttttctatggttcttggagtgtcatctacgaggtatacaatgtagtcatctccaaaggattgcaaccctttgtctcttactctttcgagtatctataatgttatcctcctcaggattttcctcaggtgtttgatcattgtgttctatcggtgcaaagtgttcatgggataaaacaggttcttgactagaagtgctaggtgtatttttcatgggaaattcattctcaaagaatgtggaatctctggactcagtgattgtaccaactcacatgtcgggtactccaaagtttattattaagaatctataacccacgctatgaatagcataaccaaggaacacacaatctacagtctttggtccaagtttacgctttttggctataggtacatttaccttggccaaacagccccatgtacgtaggtatgagagatttaatttcttcctttcccattgctcgaatggtgttatttccttatgcttcattggaattttattcaagacatgacaggcagtcaaaattgcctcaccccaccattccttgggaagtcc

SEQ ID NO: 26414 - DNA, 595 bp, Oryza sativa
cccccaccatgccttaggtagtcccgcggggtccaacatggcattcaccaagtcagtcagtgtgcggttcttcctttcagcaatcccattagactcgggagaatagggaggcgtcctctcatgtatgatgccatgttcctcacaaaataagtcaaacttgtttgagaaaagctctccaccatgatcagacctaagtcattttatctttctgtaaagttgattttcaacttctgttttataaattttaaaatagtctagagcctcgtctttcgttttcaacaagtacacatagcaaaatctagtagcatcatcaatcaacgtcatgaaatatcgttttccacctttcgtcaacaacccattcatttcacaaagatctgaatgtaggagttctagtggtgccaagtttctctcctcggcagccttgtgaggcttgcgatgttgcttcgattgcacacaactatggcacttagaacctttgacaatggaaaacttaggaattaaacacatgctggaaagccgagacatcaagccaaaattaatatgacataaacgtgagtgccaaacattagcctcatcatccacacttaggggtagg

SEQ ID NO: 26415 - DNA, 2312 bp, Oryza sativa
ccggcccaagagggaagggggggggggaaacagacttcttttagggttttctttttataaacctttttaactttgtcatttcttttctattattatttgtgctctgaaaattccactaaaatttatttaagcattttaggcttttaggaaatatacaaaaatcctccaagcctcatttgacttttatctttgcacattttaattgttggaggctttcacattgatttttaattattctttggaaaatttcgaggatagattttagagtcgatttgggacgcgacaaacctacccccttaaacggaatctcgaccccgagattcggaagaactggcgaagagaccgggatgggctgccttcagctcgtcttcgcgctcccaagtagcttcttcttcggcgtggttgctccactgaaccttgcaaaaacgggttactcggttcctggtcctgcgctccatggtgtccaggattttcactggcctctccacataggtcaagtcttcgcgaacttcaatttgctctgaatcggcctgctcggatggcattcgaagacatttcttgagttgcgacacatggaacacatcatgcacgttacccaaggaggcgggcaactccagttggtaagcaacttctccacgtcgagcgatgatacggaagggacccacataccgaggtgcgagcttcccttttgtctgaaacctgtgcacacctcgcaatggcgtgacccgaagatacacaaagtcatccactgggaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgttcggcatttgcgcccatacaacgcttcataaggtgccatttgtatgctggcttgatagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgatcctagcgaagtagagctcggctagcttgtgtcctccataggtggtcttcacaggaatgaatcgagctaccttggttaatcgatccactattacccatatagaatcatatccaccttgggtttttggaagtccggtgatgaaatccatcccaatttcatcccatttccattctggtacttggagaggttggagaagtccagccggtcgctagtgctctgccttgacacgctggcacacatcacatagggccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccacgaccaactatgtttaggttcagggcttccatctgttgattaagctcgggtggaatgcctcgaacgttgagagtattgcaatggctcttccgacttagagcgtcggcaaccacgttagccttaccagggtgatagtgtattcccacgtcataatccttgatgagttctaaccatctcctttgccgaagattcagatccgactgggtgaatatgtatttcaagctcttgtgatcagtatatatttcacagcggttcccaatgagatagtgccgccagatttttagagcatgaaccaccgctgctaactccaagtcatgcgtagggtagttgccctcatgaggtcgtagctgacgtgaagcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggct

SEQ ID NO: 26416 - DNA, 613 bp, Oryza sativa
atgaacctcctggactcagtcggcgtctcgctgatttgatagttttggcaagttcagccgaggggccctcgtgacatacctccaacaatgacaaagctgtcacccgccctttaccactggatttggttcttcggcgccaagcccattgcttgcccttcaccgccgcatggtccatcgtgaccgagcatcacttgcccttcaccgtcttggcatagtagccactttgtatcttacatcttcaatatcttcactttgtcatcattggtatctttaggtgtaatgatatcacttgagcatcaacacctttacaatccttgggatctaattatctcattcaactcaatgaaattattagtcctaatgatccggttgttaacctccacatgttgaccaaccgatcgtgtatattaaatgatatgaacaagtgatgagtattaattaataccaagtgtcatatacttaaatgtaaagatcccaattaacgaaagtgaataacatggatcaagtacattcataactaaggtataggatttgctcccctaaatatatgcatacggaatatttgtgtgaagcaagagtttgcataaatggagatgaaacattggaagcttat

SEQ ID NO: 26417 - DNA, 733 bp, Oryza sativa
caagggatattttgcatattcggattgcctcaccgtatcataacggacaacggctcccagttcatcagtgccgatttccaggattactacatcaggctgggagtcaagatctgcttcgcctcagtttctcaccctcagagcaatggataggtcgagagagcaaacggcatagtactacaaggaatcaagacccgcgtctacgacaggctcatgtcacatgacaagaagtgggtcgaagaactcccatcagtactatgggccgtgcgtaccacaccgacaacgtctaacaaggagacacccttcttcctcgtgtacggttcagaggccatgctccccaccaagctacgacatcaaagtaaacgagtacagaagtactccgatgaggatcaggaggagcagcgaaatgatgatgtgaatctactcgaggaacatcgcgaacgagttgctgttggagcagccagctaccaacaggcccttcgccgttatcacgagaagcgcatccgagcacgcacgctttcgatcggcgattacgtcctccgactggttcaaatccaagcagggcgaaacaagctctcacccaaatgggaaggaccgtacacgatcacacaagttttgcggccaggcgcattcaagattgcagacggcgatggtcgtgagttggcatattcttggaacattgatcaattatgtaaattctatgtataagtcaatagtatccatacttgtaagacat

SEQ ID NO: 26418 - DNA, 119 bp, Oryza sativa
  unsure (1)..(119): unsure at all n locations
cagcctcatcaccatgtatgccaaggcgcgtcgcatggacgacgcgaggatggtgttcgacctcatgcctcgccgggagannnnnnnnnnnnnnnnnnnnnnnnnnnnnnnnnnnnnnn

SEQ ID NO: 26419 - DNA, 261 bp, Oryza sativa
aggctgtgtttagatccaaaatttggatccaaacttcagtccttttccatcacatcaacctgtcatacacacacaacttttcagtcacatcatcttcaatttcaaccaaaatccaaacttccccctcaactaaacacagccttagtcatttgtcactttgtcagccataacacttgtttttctttttaagctctagcgctccttgtgagttgtgagtactttgttgctcaattattcctgtaaggattagcttttcttgct

SEQ ID NO: 26420 - DNA, 1692 bp, Oryza sativa
gaacccctatgattggctagtactacctccgtaggttataagactttctagcattgcccatattcatatagatgttaatgaatctagacacacatatatatatgaatgtgggtaatactagaaagtcttataatatgaaacggaggaagtacatgttaaggtacacatttataggcttgatcattttactcaactaaatactccatatccagagtggcatcccttctgttttggctaaatcacagctcaatccactcgataccaaactaaactccgcagatcagcacctaaaaacacagatctacgcaacaaaaccatggcgcatcataggcgcggccggcagaagaacgcgtacaacgagatagcgggcgagcgacagaggggagggattgagccagaccttttccgctgcgacacctgagcacgctcgccgtcggcggcgaggcgaggcgcttctccgggctcagcgacgccgtcttcgccgccggttcagctcccttccctcccttacctgcggcgaggtttgggaaatgagacgattaaaaggggagaaattctgccatgaagcgagctattatcctaaattttaaaatttaagtcactttgaagttttttcattatattctatttttaacatcagattttaaacggcaaataacacaaagtaagaaaacttttacctataaatcatttgtgatggcttagttcatttttttcaaaagcttgtcagtctttgttaaaatgtaaacgattaatctatcagttcaaataagcgcatctggtgtagtggtatcatagtaccctcccacggtactgaccggggttcgattccccggatgcgcattatttttgctctatttatgcattttttgttccatttttgtgtaataactatgctatctctttttttttgcaagtggctttcaatgcatagttttgtgtaattataattcattttttttattttttttgtttaataattatgctatatctcttttttttttccaaatggctttcaatgcatattttagtgtaataataatgcatcttttttttttgcaagtgcctttgaatgcatattctaaaggaaactaggggttggttggttcgattccccggatgcgcattattttttgttctatttttgtgtaataataatgcatctttctttccaagtggctttcaatgcatattctagaggaaactaggggccgaagaaaaaaaactgtgtaataataattcattttttttatttttttgtgtaataattatgctatatctctttttttttgcaagtggctttcaatgcatattttagtgtaataataatgcatctttttttttgcaagtgcctttgaatgcatattctaaaggaaactaggggttggttggttcgattccccggatacgcattattttttgttctatttttgggtaataataatgcatctttctttccaagtggctttcaatgcatattctaaaggaaactaggggccgaagaaaaaaaactctcattcagaatcttagaggctgttcagattgatgttattttcatccatacttttttttaataaagttgtaaaaaaatatctacatttagtttgttgccaaatttgataaatatataagaaatcctgtcacttgccaaaatttttaccattaaagtttattttaactacaatctgaaca

SEQ ID NO: 26421 - DNA, 30134 bp, Oryza sativa
  unsure (1)..(30134): unsure at all n locations
caaatgcaaaggtcaaaggtaagcttgtgtggattctgacattattgttttatggttggtataaatgtattctttttcagttaaacgattttttttagcacgggaaaaaaagaacgccatgtctcatgttaattatcatgagggtttctgtgcataagcatgcatgtaccactagtggaacagtataatttggaaaatcttttttacaatctttaacaagatagtttaatgtgttacttgtaactacaattacaaatcatctataactatcatgttctatattttaagcggattatttgctccacacttgaaaaaaaggtttgcaaaagaaaactttcatctaatagaccacttattttacaatatttatcaattatgtttctcataatatttaatttatccatataatcaagtagataatctataccaataattggctcgataataaaaatcaatagtagactttttcatgaaaaaaatcaatagcagacagcgtactcgctgataacaaggcgtatgtattgatttgctcgattttaaaatataacagtacagtctctcggaagtacttatatggatgaagaagtatgcgtgattgagataagtatacgctcgtgtatgtaaatgtttgcctttataccactctctctaaaataaataaatactagtagatcaatggctggatttcatgatcagaatctgacaaggtttcatggctgctttcggagaatgaaatgggcttttgtgctagcctgctaggtgtgcatccacctgtccatttgaccgtttcctgccactctggcaaggccccctttgaccaacaacagcttgcttcccctctctattattggataactgtggtttgcttcccttcccactacaggtccagaggagcttacctgctaatcacgacgccatgatttctaacagtccccattattgtgttgtgtttctttttcttttttttttgtgggtgtgatgaggaactgtctccgttattgtcatggacaatacagctcggtaatgatgatagtattatcagactaattaacatgtcaccagtgacaattactagctgagtttctgtgttgggggggtcctgtgtgctgtgattatgccaagagttgtcgtttgcctcctgccctcccaggctcccactggaaagtctattcgtctttggagacgacgtcttcttatttttatattttgctaaaagaatatttaaaagatggatcgatatatgatatagtattcgaatgtttaaattcaacttatatataagcagaaataagaataataattttgactctaaatgaaatcgaattcaaacttatatgtttatgacgtgatatattataatgtatcttctccgtttcaaaatataagatattttgaacggtagaagtgttacatctatttaaaatcccttatatttttggatcgattggagtattaatttaccttactaattttattaaaagaatttagtattatttttaaacgtcatgcataagacaagtgacaaaaacccacctctgtttcagacaacctgttaaaaatccagacgaccagacgtgattgagcaattcgcatcacatcactcgtcgagtcatagcagcctgatgatccaggacgccacagggaagaacccaagaagccaacgtggtagcaaaggcggccggacacgtggccgtgcacggcacgagggcacagggcaaacggcacagcgaccgggctggcacgcggcgtgaggagaggcgttagcatgcgtgttcgtcgccggcggccggggaaaacgtcggcgacaggtcactcacactcacaggtgactgctgctgatacgagtgatcaccgtctctgggagatttggacttgggtaaagtcagggcatgaattgtcggcccatcgtttccggagaatgggccgtttagttcgggaaatgaaaatttttagatgtcacatcggatatttgaccgaatattgaaaggggttttcgaacacaaatgaaaaaactaattttataactcgcatgaaaaccgcgagacgaaccttttgagcataattcatccgtcattagcacatgtgggttattatagcacttatggctaatcatggattaattacgctcaaaagattcgtcttgcgatttcccccttaactgtgtaattagtttttattttaatctatatttaatactccatgcatacatctaaaaaatcgatgtgatgtttttgggaaaaacttttgggaactaaacgggaccttatgggcccaaacttttttgatatcatcgttttaggcgagacaaatttattaaacctaattaattcattattagcaaatatttactgtaataccacattgtcaaatcattcagcaattaggcttaaaagattcatctagcaaattagtcgcaatttgtgcaattagttatttttttagcctatatttcatacttcatgcaggtgttcaaacgttcgatgtgacatagtgaaaaattttggagtgggatctaaatagggcctatatctaacattgtggttaaggatgtaaagggggtgtttagattcaggggtgtaaagttttggtgtgtcacatcaggtattatatagggtgtcgcatggggtgttcgggcactaataaaaatactaattatagaatctgtcagtaaacagtgagataaatttattaagcctaattattccgtcattagcaaatgtttactgtaatcgcatgctgtcaaatcatagagcaattaggtttaaaatattcgtctcgcaaattagttgcaatctgtgtactccctccgtcccataatattataatctaggactggatgggatgtttcatagttcaatgaatctggatatgcatctgtccagattcgttgtactataaaacgtcctatccagtcctaggttttaatattatgggacggagggagtaattagttatttgagtaaagtgtacgggcgatccttaaacttgtagaggtgtgtcatctaggtccctaaactctcaaaatgcatatccaagtcccagaacttgtcataatgtgtcatctaggtctcaaatcgccacaaccccttcaggatgctacgtggcgttgatgtggcatgccacacggatatgacgtggtattattttgactgacagataggatcaatttaattttttttccttttttcttctctttttccctttcttctctttctctctttctttgtgatccgtgcagaagaaatggaaaaaaagaagaatgaaaagaaaatgaaaaagaaaaagaaaagaagaaaaaaaagagaaaagtacacgtcacgtccatgtggtattgccacatcagcgccacgtagtattctagaggggatgtgtcaatttaggaccaaaataatacactttgacaagttctggtacctgaatatgcattttgaaagtttagggacttatatgacacaatcctacaagtttaaggatcaccaatgcactttactctagttattttttttagcctatatttaatactttacgtaggtgttcaaattttagggtggaatctaaaccgatgctaattcaaactcaacgtcaacagctaagaatcgtgttctgaacacacagcaggctcacgtaggccacgccacctcaccctgttgaccgagtcaaaccaagcggaagcttccaccgcaaggagccgcggcccacttatagcccacggataaaatcccccgcaactcgcgcacagcccgcccggcctgtctagcgcctcgactccattcaactcgcgcaaaaccgcggcccgccttggccttgtgcggcggcgaccatggccgccgccgcctcctcctcctcgccgccggggaccgcctccccggtgctcagcgtgcggatcgtctccctcgactactacatggcgccgcccctccccggattcgacttctcctacagccacttccacggtgcatttcccttcccccctctcttctccacccgcctctctcgacctccggctcgcccccctttgttccgtctctgtaccgcgcgcatgtcgagtggctgatgagttttgggtgtgtgtgtgtgtgtggatgtaggcggagaggtggaggaggtgccggtgatcaggatctacggctccacccccgcggggcagaagacttgcctccacatccatcgggtgcgtatgaccagcttctctgatgattttttgtttgtttgttcattcgtacttggaattagctaatttcgctcgtcatttttgattcaagacttcaaccgagtctgcgtgtgtttgatgctttgagcgtgagtgtgagtgacgctgtgaggctgtaacacatttgtgtaattgtgtttgcgggttggtagccatccgcagcaagtagtcctcctcatgtattatacagtattcgtgtacaacaattgatgctcgtggcctttgctgtctggattcaaatttgaaaatttggagggaaatgtgtcaatgtgcttatcctcactgtacgcgcaccaaattcgaagtttggagctccaatttcacttttgaagtcctcttatcctggatgagcttaaccttagttctctactccatatatttgatgtttgcttgtattatatgcaatatttaatactgtgtgcaatcattttttcttttgagtttggatatacacacgatgattagctctatcatatttcgaatttgtgttgttgaatgaatacagatatacttgattttctcatcttgcttttccccagaaagttattcagactattccattcatccttagttgttccaactagttgtttttcttttctgtatctaggtccttccatttctgtatgtaccttgcaaagaggaccttcttcataacgtcgaaaaaggtgattcattctttgtaatgcatcatgtacatgctattactgttgcttgtgcaatttgttacatggattattctatttggaattgtaccaatgattttctatccacattacctgaaactttttttctgatgattttcatatccacattagtacatcaccagaaactttaaattgcttgttatttatttatttatttattcatcttctaactgagtcttactgctatgtcacaaactttttagacactaattcctcttatccaccattgcaatttttatgaacttgatttatgatttgaaaggttacttcatatgtccaaagcttggccttgtatgcatctgcaacacatttagataatttagacagtatgctgaatcctttgtatgtgtctgtgccttggtgagcatctcttagattttattctggccaaaagggcagctgtgtctagaaatcaaacaggccttactttttctaaccaaatagcctaaatgtgttatttgctttaaatgttggtattgatgctccctgattaactgttgcttttaatgtcaagaacatcgcttgatgacaaggatgaattgttgactcttttgtgccctttctctaggtaattcatttatatctggtctattgagtgatcttgagaaagctttgcaggtattttgaagtccaattatttttttatggtatgaataccctgttgtattttttgatatcatcgtttttcttacagattcgcagctcatcaaaaaagaagcatgtgcatggatgtacccttgttcgagcaaaaaagttgtatggctatcatacatctgaggaactttttgtgaagatttatttgtatccataatttaattattttttaagaaaatatatttgctgctatggatgtttgaaccagttctagattatttgttctttccttctcacctagtctttccatgaacatattccatatatttatttataaatcaaaactaaacaaaatatttactgaaaacttggaagaagtgatactgagttcagttgtggaacaatttctattcagttgtgatactatgttattgcatccactgtttcttttgctgcacaatttctgtctatctgtgttcatcctgaaagattatattaggtgcatataaatcagttgatgctgtactttaagcgttgcttgccatacacatagatttgagattttataataaatgcatgccagtattttgtttccttctataagacttctccgtacaactgattgccttgatataatctgaagatattatcctcatgaagtttctcgagctgcagcccatctattggtatgttgaccccttctgcttaatttacgaccctagtattttccagtagctaaacatgtctgacaggaggaatatagctgtgatacctacttctagatttttgtttctttaatctcactacttttttggcaatggtactttgttttgttactcgctctattcctttttcattgttattgtttatttttcactgtctccgagttacaatttgggcattctctttcatagttttacatcaaagtatatcaataacattataatattacagcagtgcattgattctcactgttgcatatgcgtgttgctttattttcatgatttgaagctgtaaattcattttcccaagcaacctgaaacttggctactaaacagttattccatctgggatataatctgtcctttatacagattgtcactgttttaatttgaaattgtgcagttcatcttgtgaccttccttgtaaatacactttattcttctcaaatgggagtattttaaactatttcctgtggtcctgattttgagctgcttggtttcaggatggtgctgttcttaatagagtattccaaccttatgagtcccacattccatatcttcttcactttttggtgagagcaatgctttcttttttgttttacaatatttcattttgtctctttcgcacaatcatagagtcttaatataataaataccacagtcttgcttttatgatactccctctgtccacaaatataagtgtttttggttggatgtgacacatcctaatacatcgaatctggacagagagtgtccagattcgttgtactaggatacgtcacatccgggcaaagcccttatatttgtggacagagggagtatgtagtatattgatatttgagcggctggagatgaccatttctgttgaacttatattttagattgactacaacttgtatggaatgggctatgtacatgttacagacttcaagttccgccctccattgccagatgattttcatccaaagtcatctcttcacagcaaggtggactgctccactgaatcagggcataaggtaagtattatttccattagtctttgttggttgatactttggtccactgcttctacttaatatatcctgcctcttttccttaaaaatgataggtacatccggataatgtcgcaattagaaaaccgacaatctggatatcttcaacagtaccacattctttaatactggctagttcagccacttcccattgcatggaaggaacaaattggaacgtcactaatcgacatagttctttgatgcttgaagctgactcgagaatagaaggtccaatggcacaatgacactaacagcttttttttattgtgtatctatgtgttgcactaacaatttcattggcatgtctaggcatcctaaatgaaaagtataagatgtacacttccctttcacaagctacagcagatagcaaaatagttcggtcacttttatcaatttgggaggtatctttcctgctttgtctatatgcatatatgctagaaaatgtgctaattgcctaacctctgcaatatctgttttgttcaggaactcgagcacttaagattgttggaggaagcaaaacctgttgatatgggcagacctttgcgggattctgttcttagaagttttcttcatggaattaaatatgagactgccctttctatgctatgtccaaaggaggaagtgtcctatcacagagttccaaccatggaagaatctgaaaagctcgaagaatgcttaaaatcattgaatgatattattgggactatcacattttcacagaatgactactgttctattattgatagtgatatttctgcgggcactcaacaggagaaccagatcacaaatgttctgtgtttagagccatcggaagagggaaacactcagtgcccagtgtcatcatctgctgctcaaagaacatcatctcaattatttgaagaacatgaaaaggtaatatatataccatatatcttagttatttggttagtacttgcttcaaataaaagcaattttgctcaaagtacttactattgagtccatttgtaatttaacttgaggtgtatcaattacaaatatggttaaatcaattttcctttataccataaagtgtatttaaaatagtttcaagctgaagacctgcatggtttagttgctgaatcttggtcactgataaaatacatgatgaacaccctgattacatcaaacaaaaccattacatagccacacttgagatggtggcacgaagatatcactgggtctgaaagggcacagatagatgcttcaggatatgacgatccatagacatattctctgatcctgtcaatcattttacatgctgatctttgattggctggagatttccattctggtattaggtatatgtcatctttctgcattgcataatatttttttttctatttgggtgcaattattacctattcttgattaattcagatcctctaatctcctgtaattttttcgtttgtagcttgtggatgctgaagctcttggccttctaagctggctggcctcctcacaagctgcagaagaaccaacaactgatgatgagttggtcaatgaagccattcttagccctttattttccaagaagtccattgcagttgccttagagtctgcacagctggattttgatggtgcttctcagcaggagtgccaggatattcttgattcaattggacctgtgattggagaagaacaaccaaatgatcaaatgtcctaccgcagttctgtaaggctcggtgagagtagttccctgagcaatagtattccgcagattgatgggtcatctgatgaaaacaaggaagttccacaagaagatggtaagtataaaatcgacaggaaaagggctggattgcctagttattcatctcctcaaagtagttcaaaagccagtaagcgtggaggaaatgaacttctctggggctctttgccactttccattaaaaagagatcagatttgaatgctgatggtcattcaggtggtgcgatgcctactgagaaggtgctaagtgcttctttcatgagtggaactggaaagaactcccatgctaacccagataacactgagaggggatcttctagtccaacaggtgaacatgacccattgtgtgattctgtgagagatttgatgaggaggaggaggagatcttttcggtctgaacaatcagaagttggtaattctggagatgcagcatacatcgttcgtaaagagaatgaaattgtgaattctgagcgactagaattgcatgatatatccagtgacctttcaaattcagaaatgtattattctggcagtgaatatttgcagatgacctttgcacggaagcctccaatgaagaatgaagtattatgtttggagggctcttcagcaggtagtgagctgcctcaatgtaagttccacaagtgatatttattttatcatggtcaatgtaagttccataagtgatctttattttatcatggtgaatgcaattcatttgatgcatatagtcgttgcttgtgtgatattagctttgatgttgtttttacccatccaatatataaataattgtgttagtgcctacggtatgattatgtaacagatgttcattgttttctttcagtttttctagcattaggcttttaggtccattgccatttgcatagctcattattgtttcccctctggaacagtttggactaccaaccattataccagcatgaaatatttgcgtgtatgcaaaagaccattattcatgtaaccctataccaataatgaattatatttttatctgttgatattcacactattactcatcagggttcagtaaagatgttggtttatcatgtctcaaagcatcatttctttttcctggttttagttcctcactgcggatcttgtgcctttgagagccttgcaggaaaataggagttatgggttgtcatactcatatgtgtctcagtgaaacaaaattgccggaaatctgtagttctgtgaaataggttaccaaatctgtagttccttgatagttatgaaatttttttaggggaatatgacttatgacactagttatatgcgtgtagctactcaggaagtgtaggatattagcatggcatgggttttagggaccgtcctacttaatacaagacatattatgttgccttactataggtacaatgctattctgttaaaacttaaatctttcttggattttctggtatcattatttacttaatatcatttaaagcacattgtattttttttttgttaatccacattcgttctgctatttttcagcttccaaactgggatttgccgatatccctccgttttttaatcagaccgctgaagagaataagcagaatgaatcatttcaacgcatgggaagttcatgggatacattgggtgttccaactcatttccaaaatgatggatcagccttatatttgctgacacatgcattttcgccaccatccactgtagccgtgggccagtggctaacccaacaatcttgttctgttagtgtctctggtataggtaagttcctgtgcaaatcaatttaacaactatgtattgatgtcctcatactctctgttattttaggtcattccaactatggcgagaaagtgtctgttgatcaggaaggagcaaacaattctactctttcaccatatatgggaggtcctgctttgatggatgattctcctgcatctaaaatggctttggagcatagcattacgacatttcctgatgatacagttatgatagaaccagatctttccaaccaagaaattaaaaatctggctgattggcatgacttttcccagatctctggtggagatgagaaggataaacttacacctctcagtcaaattggattctgtgatcctgctagtattggtggcggacagcaactgactataattagcatagaggttgtaccacattcttttttcttttgttcccgacgtatatgtttctttttgttcactcttcatacaatgtaggtgctaatttacttttcttttttagaaatatctatgtctgcaaccagtaggagtttttttttttttggttattaatcatgccagtttgacttgctctatccagtgaaaagaaatatgcaaagttggattaccacataacatttctttcatagctacaggtaataacagaaagcagaggagagctgcgtcctgatccacgatttgatgccatcaatgctgtatcgctggccgttgaggatgatgctgacaatactattgaagttcatgtgcttatacgtggaaacaatgacagttcacacaggaggaggttgtgcgaaatcactcgatcttggaattgtttgttgttttacttttccatttcatcttgttttggcactaatcagtcccttcttaatttttgtttttgtcaatcaacaccactatctcttaataagtctacagaatctcaagaaattgaactgtcctaatcagaagagttgtgtacttgtgttaaacgtgaaatccagtacattagtatgtcagtcgtaatcctagttcaacaagagaggtttgcaagaacactgagtgactatggtggtgactgccacagtggcagtggcaactgatgtcatatttgatgagggtacactgatttggatcactatcttatttatgagtgttaaggatttgatataatgccatcagaaacacatttgttgcttccatgtgatgggcctatcatatgtgctgaccatatcctatgcttctggacttcaagaacaccatactactttgggttcttttgtttaggattttttcgatcgtaaaccacatgcactttcactgttttagagttacaccctcatgtaaccataattgtttgctttcagctaaggaacttgtttgattcttttttgagggctgtaagagtttagcttgttcaattgagatgtctttagtgtcctttttttcttgtaactgcagaaacctggatggagtttccggttgtgacgtaaatgtatttcctggagagagggaacttttgaaccatcttattaatgcaatatgttcaattgatccagatattatagttggatgggagattcagttaggatctttaggattccttgctgaaagagctgctcatctgggtataggcttactgaaaagaatttcaaggacaccaccgcatcagatgaaacatccacctatgaacccagtggacgaatctagtcaggagcttcctggagcatcttcagctgatgatgttattgatgatgccagtgaaaacaattggagtcatgctcatgctagtggtatacatgttgatggacgaatcatactgaacttatggcgtctcatgcgtgcagaagttaaacttaataattactccctcgaggctgtagctaatgaagtcttgaggaggaaggtaccattagtaccaactaagatattgaatcgatggtttgcaacaggttctggacgaggaagatatcgatgcatagaatatgttaataagagatcttctctcaaccttgaaatattaaatcaacttgacctggtaaatggaatccccacatttatcttgctggtacatcgtcaagatagagctatttgagattctttgtattttagttgaaatcttttatcaattttgcaacttctccttaacaagctcctagccatgatttatcattacagaaatggagttggttttgttgaaatttcttgcacaagctactgctaaatgttcttctatagccagtttttctcaacaaatattacttgaccatgcaggtaaaccggacatctgaacttgcccgtgtatttggtattgatttcttctctgttctttctcgaggttctcagtttcgtgttgaatctatgctcttgagattggttcatacacaaaactaccttgcaatttcccctggaaatcaacaggtgaaatcactccctccttaccatgctaagatctctctatctgcttcagatatatagtttctcatttgcatttaccacaaattatgtaacatgtactagagatggtgttatggattctactggcaagtgacaagcttgtatatcactacatgatatctctgtgccaaagatggccattttgctctgtggtcagcagggatccaaagaagttacattttgtgtgtaacaaggaaaaaaaagataattaggacatcttttaagattttgatgggactgctcttttaagcaccatgaaaatttaatttccatgtcgggctccttgttttataaatctgtttatcttctggttagttactcacataaagttagaaaattggattttttttttctttgctaaaaaataattaaatatgaatgcataaaatattgatgccagtattttaagtgttcttatgtgcaacttcgcaggttgcttctcagccagccatggaatgcttgccacttgtaatggaaccagagtcagctttctactctgacccagttgttgtattggattttcaatccctttatccctccatgataatagcatataacttatgttattccacatgcttgggtaaagttttcccgtcaaagtcaagtgtacttggtgtcagctcatattcagcagatccacagaaaattgctgacctgaaaaatcagctgctgctgactccaaatggtgtcctgtacgtgcaacctgaggtaatgttcttcttgggtgagctatactgttaccaagcattacggttacaggttttctttatagttgttgtagtacatgcctagcatcattgttgataattgtatcaggtctcatttggatggaccgaaatcccagcctatccacattgggattgtccttttgttctatcagctggattatcagctgtattctggaaagtattgcttagagttgcacttaactgcgatttgatgccctccatttttctgcatatacagcatcccttcgttttgttaggtcttatgctgaactgtccttttgaacacatttttaatgtcattttacaggtcaggaaaggtgtgcttcctcgccttctcgaagagatactatcaacaagaattatggtgaagaaagcaatgaaaaagctgtctgcatctcagaaggttctgcagcgggtattcacttctaaactattttttaagacctctatccatataatattaaagcgtcttattagaagttgatttaatatgtgtattctatatagtgcagtaagctctttcattttaatgcactgtgcttagacagcaatcatgtttctttccctttcatgtccctccttttggggtaaaagaacctttactggctttatcatgttacaaaatgaatagtcttcttttttcagatttttaatgcacgccaacttgctctgaagctgatagctaatgtaacatatggttacacagctgctggattcagtggtcgtatgccctgtgcagagattgcagacagcattgttcagtgtggccgtagaacacttgaaacagctatatcattcgttaaccagcaccctttgtggaaagctagagttgtatatggtgatactgacaggtatacttgtgtctttatcttctatcttcaaatcgttatgtagccatacttacaaacccacctgtttcctatagcatgtttgttcttctaaaagggcgctctagggaagaagcatttcgaataggaaaggagatcgcctcttcaataactgcaatgaatccggatccagtcacattgaagtttgagaaagtctatcacccatgttttcttcttacgaaaaaaagatatgttgggtatagctacgagagtcctgaacagaaagagcccatctttgatgcaaagggaattgaaacagtgcggagagatacatgcccagcagttgcaaagattttagagcaatctattagaataatgtttgaagaacaagacttagccaaagtaaggcgtgcttcttgatcttctctttgcaaggactactttctttggattgtcaaatttggccttcccgccatctgtcaggctatggcttgatagccttttatcttgcaggttaggtcatatttggagcgtcaatggacacggatactatcagggaaaatttctattcaagatttcgtttttgctaaggaggttcgcctaggtacttatagtgcaagggcttcctcgctgccacccgcagcaattgttgcaacaaaagcaattctatctgatcctagggcagaacctcgctatggggagagagtgccatatgttgtaatccatggagaaccaggtgctcggcttgtagatatggttattgatccttatggcctgctagaagttggatctccatatagattaaatgcactatattacataaccaaacagataatccctgcattgcaacgtgtttttggactcgttggtgctgacctgaataagtggtttaatgagatgcctcgcccaataagggaaacacttgctaaacgacagtcagcatctggtcatggtagctttagccgattaggattgaataagaaaggggttggcaaaggaagcaggatagatacttactatatgtcaagccactgtataatttgtggtgaaataattcaaggatcagacacattttgcaacaactgcttgagaaatgaagctgttgtcggcacaatagttgctggcagaacttccaaattggagcgggaaattcagcatcttgctgctgtaagttcatatttctttgataattgtgccaaacaaatgcttgtggtataccctcctacctagttccacaaacataatagcatcttaacttttgtttacataactgtttacctgattacacatacattcggggaggatgaaatcattgcaggaaaaactaaaattcatttatgttctcacttttatgcacaccaatatatgttggttcttaatagattcattcatgaagtttctgtgtaacaacctcacaagaattgaacatcagaaataatgaaattcctccactttcttttggaatatacttactctattttaactgctgcagacttgcacaatttttttatctttactgttcatagagcagatagccttgagataagctgtttcagatgaactgacagtaaaactcgttaacattgcccagatatgtggtcactgcggaggggcagattggattgttgaaagtgggatcaagtgcatttcccttgcatgcccagtgttctttgagcggagaaagattcaaagggagttgaggggtgtttcagaatcagcaatagaagctgggtattatcccttctgttgtccagaactcttctgaatttgcttttttttttgttcatatccctgtatatgctgtaaatttgtaacatgtacaatcaagtgtatttattttgttgtaacattgtacaattgtataacatgtgttgagcaaagaaatttaatgtataataatgcaaatcctcgagggaatttggacagagtccttcgctgtttgttggtgcttcagtctggaccatccccccccccctatgtccctatgctcttcctcgtcacgcagctttattcagcaggtaataattaattatagttgttattcagcagttctctaggaagtccggttttctgatatcattattcagcaggtaataattaattatagttgttattcaacagttctctaagaagtccggtttcattttgacaggcagagatagaaaatcggttggcttgtttgtgttatctttctgatatcattttactggtttcattttggcaggcagagatagaaaatcggttggcttgtttgtgttatctttctgatatcattattcagaaggtaataattaattatagttgttattcaacagttctctaggaagtccggtttcattttgacaggcagagatagaaaatcggttggcttgtttgtgttatctttctgatatcattttactggtttcattttggcaggcagagatagaaaatcggttggcttgtttgtgttatctttctgatatcattttactgaattgtggatggtcaggtcatagggatcaagggccagaggctccagattgtttgtgtaatcgtgttatctttctgacatttttaccgaagtatggatggttaggttgcctttacataatacaggaccagaagctccagctcttacagagcaaggcgcaaccagccatgcaccactggaacgtcgtctatgggggccaaggcactcgatattggtaaagaatcgaatgagctctcattgaacggtaggggatttactgaatcattgatgctcagatcaggaacagaagctgcagatcgtgtagagcaatgtgcagaacagtcatgcaatactggaactactacattggtaagaatcgagtgagttctccttgaacgggcaaatgaccagataaactttgacaaacattgacggcaactgttatgcaatgtgaaatgcagcaggagaaacgctccaaggaggttcagtttgattccatgacataacagtggagcttaattcataaaggtaccgactcttttatttcagtttagaaaggcacaactcatcattatttaagttccatgctgtagtgtacaaaagttcattgcatggaaggctaataactaaactataactagattattgctcgtagtagacaatgatagaatgcacattccgtttccaaaggcgtgctaggctttattcctagaactatgaacagcaccacggcaccatctatagagcagcttggaacagaatctcagccagttcctgtattgagaaatcacatgaaagcaaagttaaaaatgagcaatcatcaacccaaagatatttctattatactatgaagttaaatgcgtatattataattccagttacctgcttgccagatggaacaatgggttcaccccactccagaaccttcttctctagtgtctcgaagtctcctttcccagcctatttgaaaccatgagccaattgttactgtttcaattcaatcatccaagtgtaagaaagcaagagctctaaagtagttgaacattgtacctcaatcaaggcaccgatctcactatcaaaactctggtagcgcttgcgaacaagctcatccagggaaccatcctaacagcagaaagagataaaaagattacatctagatccctgaataaaaactttagaaggctgtaatgttccagttacctcgatcagcttgacaacattccgaaggccgcgggctagggtgtccattcccgatatatgagccagaaacatgtcctcaacatcagtactctccctcctcctgttgacataatagaattccaagtcaattgaaattcagttgaatcagagaccaatttacacacacacaaaaaaaaaaaacaatgtcagcgggaaccaacaatttggcatcaaagttgaatccaccaggtgcaagcccaccctacaaccatatcaaaacattacaactcatgaatagtatcatattgataattacctgaatatatcaaggcaacatattattaattcaactcacattcttaaccacacttgacataaccaaagtagcctctgaaatatctgtaaggaactgatcggtgtcccaacctgtccatatatataagcattgaaatgttatatcctatgtatgtcacaaatcgaaatcaaacaagaatttcaggcataatgtgactttcaggagctaaaggcatgcgcacataccgatctggggatcaccagtgttggcatcaatattcccaagcagaccattaattcttgcagtctcaagctcatggtggcagctgcaaattttccatggagttatgacactgccactgtaagctaccttgaatgacgttagggaagcaagaaactaacctatgtccagatagagtagcgtggttgcattcaacatttatcttgaattctcctgtatatggtgaaaaagaatgtactttagattatttcacaatacacggttaactccagacagacagcagtaaataaaattgttcaaaacactaatggtgttaatacatgaattcctgaaatccaaataacagttcaactttcgaaatcactgtaaacccaataacaaactacatatgtacctgttagaccatatttctgtaggaaagagaatgtggttgcaacatcccaatcgtacctgggagaggacaaacaagggttaggattgtttaatcctgtggacattttgttaatgtaaactaataagcatactggtgttttgtgggttcttgtggtttaggctctatcaagagtgttcctgaaaaataaaaacaaaattcagtattatatccatgtcatacatggaaaaatgtgatatagcagtgacatgtgagtaccattaaatccaatcttcttcttgtagtcaactgcagcttgaagaaaactagcctggatgacaacacggcaaaatgataaatcaaaatggagataaagtgagtggtagtaagtgtaacagaaacagaggaacagtaacaatatgtcaagactcataccaaatggtcaagttctctcttcatgtcagtattaagaagagtttggtaaccctctcttcctccccagaaaacatagttttcaccgcctaggtagtgggtgaccttcaagtggtaaaagccaaatcaagaattgacttatggaaaacctatcacaatgttcagagttcaaagataacccacctctaaagctttcttaacttgagcagcaccataagcatacactttaacctctgggctgcagtaccaatgaaggcttctattagcttcagaacatactccaaatttacatgcaaaatgcagcaaaactgatctacctagtagcagcaccgtgcatgtagcgcgggtgcatgaaaagctgtgcagtcccccacagtggttttatattggtctcctcctgcatgaagttcagatcatatctgagcaaagagcagaaccaatgcatttcgacaaaatgctaacaattttaaggttgcagaaatgtaacctggagtttctttgccagttcaactatctcatccaaatttttatttgtttcctgcaatgtgaaacaagaagcttataaaataccagaccttccactggtggccagagctacatcacacagaaacccagaaattccaaaaatttaacagaaatattccacaggagtaaaacacatcttcaaaagtaaataagaccaaataaaattccaaaaatttaacagaaatattccacaggagtaaagcacatcttgaaaagtacataagaccaaatattatgtgttgttctgaaggtatattcagatataaaggattggagcttttccaatatctaaaatagttttaattaaatagatgattaaaatagttactctgttaaccaagggtaggcatgataaatagctatagcctcgagcttcacaagttcaaaccacattcgaagacaaataataagactattatgcatgaaggcataccgtgagtgttttgccatcaggggcaatatccctgtcatggaagcaccacctgtcaactccaagcttctccatgaactcaaagtgagctctcactgcaataacaattcagacagaagttgttgattaagcaaacgtgcaaattcataatgaactgaacctaaacatgaaaccaggtaatagccatacttcttctcttagccatgtccaacgaatttgtgccatcctcccaaggccaagactttgtaggggcaccaaaaggatctcctccagtaccacggaacgtatgccaaaaggccacgctgaaccgcatccaatcctaaacgcaagcagataaaatacaaaactcagatgtattccatgacgcaaaagggaataaaaggatctgttcaacaagacataattcataaaccctaccttcatcttcttcccaagaatcacttcctcagcattgtaccacttgtaagcaagcgggttcttgctgcttggaccctgcagtgcaattgtgcaacaaagtcttagctcacaagtcacagcagttttagtccaatatataacaatctaaaaatttctaagctttatcaagtaatctaatcaaagagtcacagcagttatagtccaatacaataatataaatttccaagctttatccaataatctaatcaaagctgtaagctttcatggcctccctcacctcatacttgatcttggggatgccagggaagaactccccttcccaatcccctgaagcagcatcaccacacttgctatcgaggtcggccggacaggtttgctgcgtagcgatctgcaaccacaacacagaactgaattacaaccacaaccagaccacatttccaccgtagaaatcaaacatcactaactagtcaggatcacttaccgcagcagatagacatagagatgaggccaccagtaagagcaaaagctttgcccccatcatggcagcagcaggaccagcagcggagcggcgggcctgaagagcagcaaacaaatcagtaaccacagtgaattgacgagtgagagagaaataaataaaagaccagccagaaagtttccgatttgattgcgcacagtaaataaataaaagatcaaagattgaagaactcccaaactaatccaaaccaggtggagtcagtccatcgcccacacaaaaatcaatcgaaatccacaagaaatctccaatctgcgaggagaggatacctgcagcggcggcggcggagggggacgatgaatgggggaggagaggagaggagaggtaatcgcgagggggatgaggaggaggaggagaggaggagggcttaaggagggcgatgtggctggtggtagttgtcgtccctactccggcggtgggtgacgtcactttatttggatttatcctatccatggaccaatgatatactggtatatagtactattatttcattatctttttcgttagattaggacgagactatcgcgcgtgaaaccattatataggccgaagggcaagagattctcgtgaaatcacttgacgcaccgacgaaacgaaacggcagcgactccatatctaatctgtttttgttctgttctggtgtatctaatctgctagtaagaaaattttaatacgtgtagcattgctcccggtaatgtatttcggcgaggctaagcatggcgccatagcgtggtgtactggactctctctctctcttgataagaatcacaactgaaacgtactcctacctttcaactttcatccctcccagataaagcagataaacttctcttcagataaagatttactaccgtgtcaaatttcactaaaactgaattttaaattttaaaacttaaatttaggatttttatgttgcagtttgtttttcttttaacattagcctttgaactgtgaattatacgtatataaaagtttaatctaatttatttttggttgctcatgtgtcgttttatggcttattgtaaaccaaacgatgattctgcaattaatttctagtactatcaatttggattttttttctcaccgtaccattattgttgctacaggtgtcagtcgacacaagaagaacggaactctcaagctgatgacgcatcgcctgccgcacgatctggaaatggacggtccagatcgcacgccactcatcttatccgctcggctcaaggagaaccaaaaaagaaaaaaaaaaagaaaaatctcgctcagctcaaacagccacgaaatggcgccggccgtcgccgtcgtcgccgccgccgccgccttccccttccgcctcttctccgccgaggctcgccgaaacaccaagggctcccggagcaagcgaggctcagccaggcccctcaagccatcccctcctccccgcccatccgcgtcgtcgtccgccgctggcggcggcggcgccaccaccttcaccaggctgccgctccgcaacgcccccgcgtccgtggaggtgacgctggaccgcttccccaccgccaatcccgagcccagagcttccacttttactcgccggaatggcgagcggttgggcgacgacgaggaggatgaggaggaggaggaggatgaggtggagctcggactccgtggggccaccacgtttgctcggctccctctgcgggactcgccggacggcggtgacctcaccattgggcacccccangngggggggcccctcaagagggcntgaggagtcgcgccatttctggtcaattggtcgaacaccttgccaccgtaaagnagaagaagtaggagcaggtgggtttcccccaaancccccagcttggacatcttcgagggagcaaagggcagggaagctcgggctttcttacccgacgaggacgacgaggacgacgacgtcgtggtgttcgacccagagtacgacggctacagcgacgacgaggagttcgtcgctactgctgtcgagcagagtccacgaggcgacgccatcgcagttgcggagcttgaaaagctcaaatacgacaatgacgacgacgacgacgacgacgacgaggttgtcgtgttccacccagacgacgacgaggaagtcgacgtgttcgaggactacgacgacgacgaggaggaggagacgaaggagaagggtgtccccgccgtgatgcggtgcttcgacacggcgaagatatacgccaaggccggcgacggcgggaacggcgtggtggcattccggcgagagaagtacgtgccgctgggagggccctcgggcggcgacggcggccgcggcgggaacgtgttcgtggaggtggacggcgacatgaactcgctgctgccgttccgcaagtcggtgcacttccgcgccggccgcggcgcgcacggccagggcaggcagcaggccggagccaagggcgacgacgtcgtcgtgaaggtgccgccggggacggtggtgcggtccgccgccggcgacgtggagctgctcgagctgatgaggcccgggcagcgcgcgctgcttctccccggcggccgcggcggccgcggcaatgccgcattcaagtccggcacaaataaggcgccaaggattgcagagaaaggggagaaaggtccagaaatgtatgctctcttcttcactccattgaaaagattgttcatgctttttttttttagttagctatggagtgagcttttgacatgatttcccatgttaaattagccatttagcttacacaaatgttagttcaggtttagattgtattgcttgatatacaagttttctttctttgacttacattagctgcattttgggatgattggtggttgttaggtggatagatttggagctgaagctggttgctgatgtggggattgtaggcgccccaaatgctggaaagagcacccttctgactgctattagtgcagcaaagccaactatagccaattacccttttacgacattattaccaaatcttggagtggtctcattggattttgatgctacaatggtagtcgcagaccttcctggattgctggaaggtgctcaccgtggatatggcttggggcatgagtttttaaggcatagtgagagatgttcagtgttggtatgttccttctctctttctctcctttctttaggatctactatgttttaagtccacatctcttatgtcatggttatcttatttctcctcgaatatatgatattagaaatgtatgtgcgatttattggttattgtttatttttctggtttgggtcttacgttcatgttgtcgacggctcaggagaacaacctgaatatgagtttgaggctgttcgtttagaactggagctatttagcccatcattggttgacaaaccttatatagtggtgtacaataagatggatcttccagaggcatcggaaagatggaataagtttcaggagaagctacaggctgaaggaattgagccctattgcatcagtgcaatgaataggcaaggaacagaggatgttgttcttgctgcatacaaggttctacagaaagataggcaaagaatgaaagatgacgaaggtatttctatagcctaaatttttctgtcaaattatagtgtactagtagctaataactgcctaactggtgctcaagcatggaagtgcactttaactgactatagctgttcgcaattttagattaaatgcatatgtgctactttcaccatctatgctaaagtagtgttcttactagcattcgttttacattatcgtggttaacacttacgcataacatttttgcgttttaagatgtttatcttactactgcatgtttctgcagaatggaatggccctgaaaatctgaatcatgtggctgatgcaataaaaagggaaaggagagctcccatgaacgaatttgagatttttcatgataagggcacgaatacatggaacgttgttggagctggaattgaacgttttgttcagatgactaattggcagtaagtagtttctttgtacagtgctcactcgttacactttggaagatcagtctcagaaagcgattttaagactgcattactggtcgtttatctaaattgacctcttttaagattactaattaagtaattgtaatatctgatctctttccaaatgcaggtattcagaatccttgaaacgatttcagcatgctttagaggcatgtggtgtcaacaaaactctaatcaaacgtggagttaaagagggagacacggtagttgttggtgaggtatatattcctatgtcataaacaaaacattggacagtcatcacacaaataaaattatcagatttctaagttaataatttctgcagatggaaatggtttggacagatgagcctagtaagaccaggtcatcaaagacaatgaactcaaaagatgactctgtcagatggcctgaatttggctagatcaaggctcaagcaatggttctgtgtcgcagcagaggcgattttcactgaaatgtttgcacatgcttacaataaaatgctgcactatgacaacaaaaaaactactagtcatcacaacagctagttacacccagcccaaataaaaggaatactattttgtgttaccttcagaatagtgatgtatcacacagcttcgcctacatgctttgaaagttggattatgcaggagtgctatgtactaccttttgtgatagtagatatttgtagatgagatttaggtattctaaaatgatgtacgaaatagtttcttcagcaagattgtataaatgttcacattgattattaatggcttatacgaccgaagaaagacaattgccgttgcatcgaaatctccaaaaagatttgatgtttgagtgaaccttgttcaacactttatactagcattacgaattcaaagattatgcatcaactatctctctcttacgatgcaaaagtaatttgttcccctcaattttctagtggagatagttttcgtccgtttctgatatgttttatttgctagctatgtgggtgtcccctatgcagttgtgctagcatgccatatagggccttaatttgagcttgcttgagtgtgttgagagagtgaatgagctcctccttttatagggctggtataacggttatcctaatgcgtaatgtcagttttgcccttgtaaccgtcgttgagaagtgatcctggatgtccacgtggagcgccgagctgagccgtagcagccagggtacctaggccggcccagcaggcctccagcatcggcagggtcactcacatgtgggtcctctaggcggttgtggcagttaatgtggtttccggacagttacacctgacttgtgggccctcttattcataagcttgctatgtgggtcctttaggcggttgtggcagttaaagcggtttacagacggttacacttgacttgtgggccctcttatccataaaattgcttaggagtgagtttttcttcattttctccttattttatttgataaattcctacaacatattattctccaagtacaagtggaattatattattctggaataaatatgcattgcaagcatagctaattctctattattttagttatattgacaatcgaagtttgtctgtaacgactgtcaacagtcaacaggagggattgacgacgtaggaaaggtggttcagttcgaaagtggattgaactagttagagttgttttaggtttagttttggaaataataattgttatatttaggccggtgcgtaattttcgttttctttttaggagataaatctctgggcggtcgaatcatgtttgaatcggactcagctagattagggatatatattacacggaccttataaggtatcttttgtatacaatttttcacgtgttgccacccttttcggcgagttcttagttttcgaacgaggctagatcggtttaatctccggtgaggaagtaagtttcttcaacttcgcttgtatcaacttaattaggattttctcagtctagtccaatattctaattaagttgctacaatcgtagcccatctaatatatcgactttttattggattgcatttcgaatttatttaaattttttgagcaaatataaaaagaattaagtcatgcttaaaaaatatttgatgatacatcaagccacaataaaacaaataataattatatatttttttaaataagatgaattgtcaaatttataaaaaaattacggagggagtattatatttgcccggtagttagaagcgacacaacgaccgcacgaaatgcatgttattgcgatgtacaggatggattttgttgcgcctcacgcgtacgtacgtacgtatgtgcatgtgtcggataggatcacaagctagcggcgattcggactatttcagcaagcagcgttggaacgataaatccgattccaaaaagaactccggccgactggacataaactactaatccgagtcggatatatctggctagatgagttataataaatagcttactatcagtcactaactctctgagtctgcaattgcaacagtacattgtttcgatcgtggccgacaagctacttgatcgccactttctgcaattggaacagtacattgttctcgatcgtgtccaacaatctgctcgatcgccatggccaccacgctgcagagctgtctcttttcgtgttcgccggcgacggcattgtcgatcaggaggagtccgcttacctcgccggccatctcgccggcggcgagccaacgtaattgctgcctcccaagactgaagacgacgacgcagtcctgcaggataacgacggccgcccgaccgcctctgacggcggtgcagtgccagaaaggcgacggcggcggcgcaccgccggcgccgccgcgacgaccatccgattatctgcaagaggagaaggagaaagtcttgaagcactaccgtgaaatcatctccatagatgatggttgtctggtaagtacatgtacacgtgcaataaatagttcaccattttaaatttctatgtgttatgagcaataaattaattgtgcagtaattttgatgatcttttggtgggaattaattaaatgcagtacgctgaggccacggagaagtcggcgggggtatgcctggcagcaaaggatgctctcgtcatggcttctcgtgtcatggtaactagtatggtggttcgtacagattgcgcggctagcatcattatattttctctcatataataacatatatgtcttctcaacatattatttaaatatattaaaatgacaacataattttaaattttgtactaactttacgaaactactaatgtgtaatattcatattgtattttatatacgtgttagttactaattatttttaatatcaaattttagttatttgtaaattatattcctatatgaactctagactcgtctttcaatatatttattttaattccgaattttcgttatctgtatttgtatatagactctaggctcttcttccaatattatttatttttaactttgaagttttattatttctaattgtttttttatgtagactctaaactcatctttcgatattctttaatttttaatttcgaatttcagttacttataaattatattcctgtattgactttagattcttcttctcatgtttttttttaaattccgaattttagttatttgtaaattgtatttttatacgaaccctaaactctacttttaattttattatatttattctgaattttagttagttttaaattttaaattcctatatggactctatactctacttctaatattccttatttttaattccgaatttctatcgtttctcaattgtatttctatatggactctagtctcctcttccaatattccttattttttaattccgaatttctattgtttctcaattgtatttctatatggactctagtctcctcttccaatattccttattttttaattccgaatttctattgtttcttaattgtatttctatatggactctatactctacttctaatattccttatttttaattccgaatttctattctttcttaattgtatttctatatggaatctatactctacttctaatattccttattttaaattccgaatttctattgtttctccattgtatttctatatggactctagtctcctcttctaatatttcctatttttttaattccgaattttacctatttctaaattgtatttctatgtgggctatgtttttatttttctccgattaatatgggaatttctaggccgtgagtgcgaacgtggagatttctttttctattcctttaataagttaatagagtaaccatctaattaaatattctactgtacctctcactaattactagtactagtattcttcttgattatgcaacacaactcttactctaattaacgtattgctttttccgaaaatttcagcatactgcggagctcaatctcgctgcgccaaacgaaacatctacagaaacannnnnnnnnnnnnnnnnnnnnnnnnnnnnnnnnnnnnn

SEQ ID NO: 26422 - DNA, 1143 bp, Oryza sativa
ttgtatttctatatggactctatactctacttctaatattccttatttttaattccgaatttctattctttcttaattgtatttctatatggaatctatactctacttctaatattccttattttaaattccgaatttctattgtttctccattgtatttctatatggactctagtctcctcttctaatatttcctatttttttaattccgaattttacctatttctaaattgtatttctatgtgggctatgtttttatttttctccgattaatatgggaatttctaggccgtgagtgcgaacgtggagatttctttttctattcctttaataagttaatagagtaaccatctaattaaatattctactgtacctctcactaattactagtactagtattcttcttgattatgcaacacaactcttactctaattaacgtattgctttttccgaaaatttcagcatactgcggagctcaatctcgctgcgccaaacgaaacatctacagaaacagtccacagggtacgtaacgctcctactctagaattttttttttgttttgttgctacttccaccatttcttaatagattacattgttaacttttaaacataagaattaccatccattcaaaacaattatgtagatataaaaagtatatataaattatgtttaaattccctttaatcatgaaacaaattacaacaaaataattgataattatcttttttaaaagaataataaaatacatctaaaagtcaacgactttaattatatcttaaaatgatcgcaaaagcaggattaatatagctagcaaggtttagtcatgatcaattgactaggtggtgttcttttcttctgaagatgaagattaagtttttatgcaaaacgaggtggtattaacatataattgattgagttttaattattacaaacttgaaaaatagactaatatgatattttagagcaactttcatatagaaaattttagcacgaaacgcaccgtttagcagtttaaaaaacgtgccacgaaaatcttcatctaactcttagtttgagaaaagaacgggacctaagattctttttaactcttgtatataatgaacagactgtgaggatgtacgtgaacatcgtgatggcggc

SEQ ID NO: 26423 - DNA, 12675 bp, Oryza sativa
agggcactagagaacgcacggagcaaaatggttgcagattcggcgacaatttgagatagctgatagtcatgggggattaagatagtagcctgaaatttttgttattttagtgcagatagtacggactattggcccatggcacaacagtcatcaaatgttttagtgttcgttttgtaattaaggcatgatgaaatctccgccttcaccaccgggttatgtgggctgtacgtgcctaattgtattcatcaaatgcatgatgttcctctatctagctcctttctagtgttgttgtgctaatcctgctgcccttcacctgatcaatgcagcatatttttatactaattagggcctttgaataccgtgaatagaataacagagaagtagaataaacacatgattatgttagaaatgcaatccagctaacaacagccctaacctaaccgatccgtttttctcttttttgaaatttttttatcctcgaaaaaaattgtacgtggttagctattttgtaaaaagctcctcacgtttacaccaaatattgtatacgtcctcaaaccgacagacatccggttatcacttatccataaaacatctcgtcttccaaaaaaaataaaacgtgaataagagaaaattttgcttctaggggtagcgttgtaaaaaaacataggggtttttctaaaaatacatcctaatctcaccccacaatactcaaaccctaccccattccctccccgtctccttcacctcagcgccattgccgcgctaccccgccatccgccatcccccgttgccgtcagtcgttcccccattgctgccgccacctccacctatcgtcacactactaggcgccgccgtcctcgccggcaaatccaaccacctgggggaaggagagggtcgcaagccattccctcatcctccgggagctccctagagcgctcctaggcacccatccgcgtgtacctccacgcgccgttgggcgccctctgctcgccaccgcacatggccccgtccccgcccaccacgcatgcgccatcgctaggagccatcatcgcctcctgcccaaggaggtgctgttgctcgatgcggttcagagcaaggcctacaggggcaggctcgccacggccgagtccgtgatgggtgtaagttcaagtgtcttaatttggttttggtgattaatgacaaatctaactatatgagactaatcatttttatgagcctttctttgactagtctcatttggatatgaaagtaaaaatgatgagcggtatgtattaaacttcaccatattctaacttggtctctcttgtggatccaaaatatagcgtgagcttcctatttgatctttattgattatgtgcatatgcgttccttcatatccatatgtatgcacatcttgagggggagtttattctatattttgtttattataagatttctatcttgatttgaaatcatttttcatctcatatctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataataagatgtggaagacatgcattcttttgtgatggaccttaatcatgacaaggatgaaatgcatggagataaaacgatatgtaccacttcttatctcctactttttgataggttcatatatatgatttccatgctattgatatataagtgtgagactaatgtttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatatttgcacttgagcttgcatacgagtatatgacacttgtgatgttaatgaatactcaacaaacatatccatatctttcatatgcaaccggttggtcatcaagtgaaggatggcaaccgatttgttgagactaatgttctcctttgatgtgtgaaaaggaataggtcccactacgatgaggctaatgaatgacaccatgggttagtggtcaccaagccaaggacatcgtcatgttggcaataatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaaaaggagtctatgaagcgagcttgtgaatgatcttgtgccatattagttcatatgcatgtaggtgtatttggtgggcttgtctagccaagtgtgatgagttttctcaagtcctaaaccaagagagaagtgggcatgtccaataggagtgagtgacatcttgtgggtatgtccggtggatgtcctttggagtgtgagccctttatccttgacttaagttgtgtttcttggatggtttttttcatgggttggatggccctttgaataatctttccatagagtccaagaacgccaaattccgagacccgagtcaagagatatcaccgttttactaacggtcggttaagctgaaaagtgacctgcggtctgaccatgggccttaggccggtctgaccgggcctgttagccggtctgaccggcatgataaggcttgtctgaccggccccactggtctgttgtactggtctggtttttggtggcgatacagagtcgccagagccacaaccggtcagaccgagccgatggcggtctgaccggctactacactgcggtcagaccagccaggttgagtgggctcaatgattgccctgtaacggctagttttctagccgttacaaagtagtccggtctgaccggccactctatggcggtctgaccggcagagcacagagttggggatttcgactccaacggctagttttggtggttgggggtatatatacccactccccagcagcaagggcaaggttttggcactccattgcattatcttgaacccttgcaagagctctcacacccttgtgcacttagcttatctagtgaggtgttagagagtgagttaagccaatccaagtgcattgctttattgttttagctagtatggcacttgatcatcctcggcaagcatcctagacttgttactcttggaggttgccgcctcctagacagcttgtataggtgttgcccggtgacctctccgaggagattgtggaggaggcctggcgccgtttgtgagtggtttggagttcaccaccttcagagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttttgctatttacattcatagagacatatttgagcccatatcacctaggtttgcaaaacttaacttagttgcttagttaaccttgcactttaccttgcctagcaacttaggttagttttgtttaagtgccattaagttttaaaatcgcctattcaccccccctctagtcggcctccttgatcctacaatgggtaggatcgggagagaaaagatgagcaagggtggatgcggcgttcgagtcgtcattctcggtggcggcagcgtccaagttatcgttcccgatggtggcggagttgatgtccaggaggtgacggcggagttgacgtccaggcagcggcggcgttgatggcgtcgatccaggcggcggttggcggaggaccacgaagttgtgccacaatcgatctcgccggaggaggaacacggcggcgccggggggaggggggagagaaacgcggcggcagcgcagaaaaggatggaaagtgtgagaaattccacctgtggcccgtatattcctcccatctattacacttgaaggtatatttttgccctcccacctctcgtctacgcgaggtactgcaacatggacatatttgatacctcgcggtaccaaacactaccagctattggatcgggccagatccaacggccaggatttggtaccgcacggtaccgttagaccataaaaaatctccttatattatgggacgaggaaggaaagtaccaaaaggaaaacaaagagcaggagtaccttgaagcgatgatcatggccgcacacgttgcggcggcggctcctcgactgcttgcttgtagatggaaccgtgtggctcctctacccacttcgccgtcgcgacggcctctccaggcgcaggcggcggcgcgcatggaccgcccgcgccacgccgtcgtcgttcgctgcaagaagaagaagaagggcgccgccgatgagccagccggcgagcccggcctagaggagggtggtgatccccatcaggtatatatatcaaaactaaccgcttccttaatctgtcattagtaattagattagatctaaattgacagcacattaagggcccctttagaagcttagggcccctttgaataaatgatttatttaggaatttcgtaggattcaaatcctatacgaaattttcctatttggccctttgattcaaaggattgaagttttccaaatcctataaaattcctatggaatggcacattgcatgtggattttggaggaaatttggcaagagctccaacctcttggaaaatttcctttgagtctatctctctcatccgattcctgcgtttttcctgcgctctaatcaaacgaccattcctatatttttcctgtgtttttcaatcctttgtttgtcaaaatcctgtgttttcctattcctctgttttttctaccctgcgattcaaaagggcccttagtaatgagaaaacataggaataggaaaaacgcgggattttgataggaatgtaagtgtaaaacagaggattgcaaaacataggaaaaacacagtaatgatcatttgattggaccgcaggaaaaacacaggaattagaggagagataaagactcaaaggaaagtttctaagaggttttaccgcatgttagaattcctccaaaacttgcatggcattagacaatctataggaattttataggattccataagatccatttctttgattcaaatggctacgtaggaaaaatttctataggaataaaatcctttaaaattcctataaatttcctttaaatcacagggggcctaattgttttttcttctattttagtctccatcgtaccagcaatatcgtaagtttcaagacgtaattgaccagctccagcagtgtgcggccgaattaagagctcgtcgatcactcaaaaaggacaatatggtttgttctaagggatgtgcttctgtgctcagcaaaaaaaaaacttgcacgaaagttaaagctaatcagcggctgtgattaaaagggagattagcacttaattatcattagcgaggggtaatttcgtccaaagatttttgagcccatatccagcccagtccatctgaagcgatccctacattctaccagtccaccacggcgccgctcctcaaccgcaccgccgcgccgattttcgccttgccgtcattgctctgccctcttcttcagttaaaaggatacctgagcaggtatggcctgagtgacagtaaattcagtttcagacttaacttgtctcctcaaagatttgccttcaagttacagaacagagtcaatgccttattgctgcaactcgacttgcaaatttggttgtacatatacacatctggcacaagcttcatatttacaagcaccatgaaaacctgatatgcagtctcagcgctgccacttttcaatagaatcgagagaatggcattcgcaataggtgacaatggttgggcggcgccgccgacgcgcgggttgtggaggagcgatggcagtgccgacggtggcggagggaggcaggaagcggcgtggggagggaaccgggcggcaaggcggagttgcaaggggaagaagaaggcagagcagcggcggcaaggcgaaaatcggcgcggcggtgcggttgaggagcggcaccgtggtggactggtgggggtggggatcggactgggctggatatgggctcgaaaatatttggacgaaattacccctcgctaatggtaattaagtgctaatctcccttttaatcacagccactgattagctttaactttcgtgcaagtttttttttttcggagtacagaagcacatctctctattgttctaatcattgtcaccactcaccatctgcctattgctttatctccaatagagaacagcaaccagtcactcacatcgggattgtagttaatgttgactaatcgaaattttgtatatttgtatatagagtatttgtcccaaatagaaacgcctagcacgtacagtacatcatctaagttcaattaacgacaagtgaattatttaaacaaagacaatttagtgaaagacatcttctgaatttagtgcaaatggtaaacaaacacaacgacgaaagcatgcattagtaatgtcaggaatcaagaaacctaagtgatgaaagagaaaatttcaccagattgttcaacaacggaagcagtagtaatgtcaagaaaccaaattgaaaggagcaagctagctaaatattatatagctaatgcaaggcttgcctcgcttgctattgatataatgtaacgtcaaaactgttgcactgttgatttcattgtttctgatgccccttttgttttgcaagcaggacgatacaccattcaattatgagataaacaaaattagagggtactggacggagatacattcagcgaagataagttatttggtcagtactgttcataatatgctggggtttttattttgtttagcactaaaacaggtgaacagtgtccacctattattttgattagaccattggtttttgtagcggcaatcagcaaaaggaagaatcattatatagtcaaaggatacatgtttgttgattctagcaattcctaagtgtgtgttctgtagcgtgggttaggaactaatccccacgcatgggaaatagagtgatagactagcgtataattatttaagtattagctaaaaacttttaaaatatgaattaatgtgattttttaaagcaatttttctatataatttttttcgtaaaagccatattgttttacagttttagaagcgcgcgcacggaaaatgagtgtgtagagggttcggaacctcaacaaacgaaatcagtgtaaggagatgtataggggcttcgaataaacacatcatggttcaataaaaaatgctaatagtagtaatacaaaggaattatgagatggttatgaattgaagctgtttcagtaacactacaatcagaattaaacatgcatttaattatcagcgcatatctaatacaacattggaagtggcatttccactccaagacaaaattctaatcttcagaaatatgctgcaataagcaatttcgtagcggttatataatttaatttagcgcctcaaccttcaactttaggacttgtgaatatgaacgtaaaagttagttgcgttagtgcaaaatcaaaagttttaatcgagataaacaagttcaataataatactacgaactttctttcaaaataaaatatcatatataagacattggagatggatgtgtgagctcttgacattgtggctatgtgctataacttcaaatgtactccctccgtcctaaaaaaaaacccaatcctaggtttgaacttggacaggattgggttttttttatggagggagtataatataaatataaattagtttgttgcaaacttcatccatatataataagcaccgtgaattttactgaaatttaaaattgtaggattatgtcgtaatgttactatgaactttttgtcttgcctgttgcaaaagctgatcatgttttatttggtgagtactgtaggatggacaaggcaggatgttaacaatgactcttctcttaagagctaaagatgctatcgagttggcttctagaattatggtaaatatgctatcttttaatatataatatgttagctgttagatttaattgggtaattgatccatttaaatcaattaaattaaataaattccaaggctcgttatgctaggaatttatgtgaattcattcttttatgggatatcaatgggatgaagagttttgagaattaatccatttgattaaggaattggtaacttatatcaattagtcttaattgatggatggttgatggttgtgtagtggaggatggttcatggctagttgatgacaattagttgctctattcctcttgctattccattggtgatggttgtgtagtggaggatggttgatggctaattgatgagaattagttactctattcctcttcctattccatgactcttactcttcatcttccatttcctcttataaaatgagaatggatttgatctcccgcgaaagaggaagacacactttcatccattttccaaagctgttgctgctacggtaatcccatctcgacgagtgtgtgcacacccgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatatcaacattgtgtcattatgtgattgttgatgcttattcaacgttaagcatgctcatgttgattacattcaccactatcactggatcaaatcccattgtaaatatcatgtttattatcttgttattttggattaaaatataccgaattattaccaaatttccaacattagcaattttactgaactttgtttaaccaacttctccactcttgtgaaaaacagactgaagctcatttgagagctcaaacgccaagtgaaatttcgctgcatacggtagatcaggtaactcggttatgcttttatttggatgctcttctttgaccgaatcttgaaatcacataattttggaacgtactataaatttctctgaacatgcagaccgtcaggatgtatgtatcgacctttgttaagactgccgaggacacttaccataggaaggttgatagagcaaccattctttcattcctctgtgctcttcaaggtttggctgcagttagccatatcttgtttgaagatgctttggcttttgttcgtagcagtcaaccggattacagtccaaatcatgatgtcgaggtaattaaccgttactatcagcaggagataaaacgtttgataaataactttagggaggcttcaacaaccgaagcacttgaggtatgccactggacagagtctccccttcttttccgataatgttgatcaaattttgatcagatcagatgttgataaaattttgatcttgtatctgcttgacttgcagattcttttttttttgaacggaaaatagcactagagtgtcttttcattgaatagggcaggagaaaatacaacccctaggtgcaacaggaaaaaatcgaggagctgtagctatacactatacataatgcgggattaacttgcgcagccgcttagcccctgctaaagcccaaaggctagcctcttctttgatttttgacaagaggaaactcgttgccacctctttgtggtcaaagattcgccgatttctctccttccagatttcccatacaactagaaggatgagtgatcggagtcctttcttcggaacatttggcgtgtttgcgatgttctcccaccactgttgtactgattgtgcctcctcccattgagccggctcaatttgctgatatcccacccatccagcaacaaggccccacatccttttagtgtatctacaagtggcaacgaggtgcagcgccgtctcagcctcacagcggcacataggacaacatccgttgttttgccaacccctggtcgcaagtcgatctaaggtccaaactctattttggatgatgagccaagcatgaaatttacatttccctggtgcccagactttccagattaaagagttgaagcttgtgctcggcgttccttggcattgcgcatggtaggccgaggaggccgtgtagcgtccactacttgtgaatttccaggtaatctggtctggttctccagtgtctaagtgaacattccggaccgcttcccataagcgactagttgttcgacgaggtgtactgtaataggagagtgggattccaaagccaaatcctaaacccaggcgtcgtcctcctttccatttcgaagatatctccctctattcttagagatcgcgtagaccagcggcataaggtctttaggtctttgcccctcgatccaggcggagtcccagaagcgagtcgtgttcccatctccaattgttatctttgttgaagcggcgaatagactcctgtcaatttcatcacagggcgtttccagtcccacctatggcttggtcaggtccttccattcgtgccataaccatcgtagctgcaaggccctcgtgaatttctccagatttaggactcccaatcctccctgactggttggcaagcacgtctttgtccagttgactttacatttccctccggtaatgtctcccgtgccggcccatagaaagcgacggcgctgcttatctagctgctcgagggattctttcgtggttttcaaggcagtcaggagataaataggctgcgccgtaagcactgatttgatgagcgtggttcttcagctaccgccatgtttttccccatccaatttggacttgcagattcttcatagtacggttaatgatttaacgcagaaagtagcatcttatgttaccaaaatgactactcttcgcaagagcacactagcccatgtccctggtaaatctgttgttcttgtgccagtcctatttgcaccaaaataatattttcactttagcaagttagaattacattgattgttgctatatatggtttgtgtaggccgctccattgcatactgtgatgctgccccaccagatgacaggcaaaatgagtagctgattgattaagttgatgcttcagttgagatgtatcatcctgtctggatgaatccattatccatagcaggcaacgaaaacatgtgcaaaattaagctttcggtcaacaatatgtgtccttttcattggtcttgaatatatataacgttattattcagttattatatatggaaggactactatttgtttcaaaaaaaaaaaaagaagtactaggtttcttttgagcaaaaaaaaactactccccctatattttaatgtatgacaccgttgactttttaaccagcatttgatcattcatcttgttcaattttttttgtataaatataaaaatatttatgttatacttaaagaacatttgatgataaatcaagtcacaataaaataaatgataattacatatatttcttaacaaaacgaatggttaaatgtgataaaaaaatcagattacatatattgtcataacttgatttacatatattgtcataacttctagtccaaaataagggccaatatttgcgctaccgagtagcgacccaatgcatggagccatatgtaaagggattactgattcccaaattatgaaaatggtcaaaaatagagaggaggtgattttctgggaaaaagaaaacctcaccatacgggcctacattagcacggcaagtaaggggttagttttaagtgggtcgagatgggctgggccttacgttccttcccacaatatggcccgtgtattagcacggaaagtacggctagttttaattgggctgacatgggttgggccaaatgttcccacggactccgaagtaaagcccttcttcttcggcgccggccaacttcgctcgccgccgcacaatccatttccataccctcggccgtcgtgagaaacacccttaatctacactgggatcaactcaaccaactctgaagtatacacgactttcgatccagccctaattcgatcgtgtgccgtcgctgatcctttttacttaacaattttttttaacagctgatcgccaccgtaaatcctctttgtctctgttcggctaggcgattcagttgattaacaatgcagccacgaacagagcagcagaagcttcctcatcatgggtaccgagctcgaattcgccctata

SEQ ID NO: 26424 - DNA, 3042 bp, Oryza sativa
  unsure (1)..(3042): unsure at all n locations
gccaaatgttcccacggactccgaagtaaagcccttcttcttcggcgccggccaacttcgctcgccgccgcacaatccatttccataccctcggccgtcgtgagaaacacccttaatctacactgggatcaactcaaccaactctgaagtatacacgactttcgatccagccctaattcgatcgtgtgccgtcgctgatcctttttacttaacaattttttttaacagctgatcgccaccgtaaatcctctttgtctctgttcggctaggcgattcagttgattaacaatgcagccacgaacagagcagcagaagcttcctcatcatcatcaaatccagagcaagtacgcgctacctcaatttcatattataaggcgttttgatttttttttcttagtcacacttatttgtgtatgatcaaatttatatataaaaaaaagaaacttagtaaaatttataacaccaatttagtttcattaaatgtgacatagaatatgttttaataatatgtttagtttgtgttcaaaaatttatatattttttaaaacttgattagacttaaaaaaaatagacaacttataatttgaaattgagggagtacgtatttaacgatcttatccacaggtatgtatcgtaggctcctatccaccacctgcgtgttatatgtacttgtactatagtgcaaatgagcaatcccgctatcaatatgaaaatctgcttaggtcttattcgtttgattatattcccatgagaaaaagattataggggattaggtacggaattaatcccctcaaattaaatctcgattctcttgagtgagggattaaattaaaaaaacaagactttaatggttcgtttcctacttaagagtacaaaatttagaaggaaaaaactagaattgtgatgataagcgggaaataaaacagattacctgttgcacttgcatccctagattacgtacttgcttatacgaatgtcaatccagtactactacggtactgttatacgtacttgtgtacttacgctagtatagtgattttatccatattaaaaaaaagaagttataaacagtagtgaagtgtactagtgatggatcgatccaacatcaaaacaagctacagggatttgatcaacccctgcacttgcgtagagagcatttcggacactgtcagtcatcatctgaatttctgaaattctgaacctgacgtacgcaagaatcagcatcaagtacctgacgaaatggttgcttggctgacacttgtccagtgtgagctttccgttgaactgtcaattgcttccctcctttttcccagcttttctgtacttgttgcccatgtcgttcagttcctcatcttcttcaattttcttctccatttctcaatccattgtcagtactacatatgtgtgtacttctcgcggcgccattcttgtcatctaattgcaggttagttgtaaaatgtaaaatcgaattggacattttgaaccaggtcatggattaattgattaagatgctagaagaaattaacaagctgtgccatgcaatatatcatgcatgcatgcatgaatatgatggctaagtaggtactaatgctaatatagaagagagagagagagagagagagagagagagagagagagagagatcatctgcctaagtacatatttgaagaagctctacttaattaactagaaatggcgccaagccactcttcttgttcgatctactgctagctgctgctgctgctgctgctatactactcgatctcttgctcgatcgatcaaacgcagattgatcaagatcaactcgatctgatcatggtagacaggaaatgatatatgcatgatcgctcagaggcaaagtgcgtgattagccatgcaatgcccggtgcaactcgatcaatgggagaggaagctgaatggagagtaggagtcggagccctgcgacgaggcgaccatgtcggcggcgccgccgctcgccgggaacccgcaggcgccgagctggtccgccgcgtcgccgccgccccagaagccggcgaccatctgcgcgaggtcgtcgacgtcctcccggagccccatcatgccgtaggcgtcggcgtcggagtagcgccgcatgtcctgatgatcggccgcggcgccgccgcccctcggccggaggcagctctccggcaccacgctgctcaggtacccggagttgtcgtcggcgccggagaagaggaagtcgtggccgttcctgtccatgtccagcagcgacgacgacatgctggagcggtggggatcaaccgggaccatcaccggcatcgtcgagcactcgcccaccgacgacgcgcccgacgccgcgccatgtccgtggtggtggtggtggtggtggtggtgaccgtacgagccaatgtgcggcgccgcgcccacgccgccgccgtactgcaccgaggacggcgcggcggcggcaacggcgtactgcggcgcgtggaacggcgcgaggaacggcgggtagttgtaggcggcgtgggtgtagacgaagttggtgcgcgcctgggcgcccttcatggacagcgcggcgcggtcgtacgccagcgccgcctcctgcgccgtgtcgaacgtgcccagccagtgccgctccttggtggtcgggtcgcgtatctcggcagcgtacctcccccacggccgccgccgcacgccgaggaacctccctggctcctgcgcgcgccgcctgctgcgccccgacggcggccgctcgctcatcggcgacgacggcggcgacggctggctcgccggcttcggcggctccgagaacgccatcaggctggcctggctgctgctgctgctgctgctactgccgctgcctcgagtgttcatgaccaatgcaatattgcaatattgcaatgcaatgcaagagtgagagtgagagtgagctaggctttagctaagctaaggtatatgaatgagctcgagctaagcttagcttgtgtgtagnnnnnnnnnnnnnnnnnnnnnnnnnnnnnnnnnnnnnnnnnnnnnnnnnnnnnnnnnnnnnnnnnnnnnnnn

SEQ ID NO: 26425 - DNA, 4729 bp, Oryza sativa
cccagctgcatttggggcaattcttgcatctaatgccttagcttcctacaaatgcaagtatagtacaatgagaggagagctacatgtgtagagtgcatgcagagagagagatcttatctgatgaccttgacttcccctactacacccctctcttgtgtgtgaatttggcatatatgtgttggcctgtgaaaatattgcattgcaagatggggtcaggtcaagccctagctagacatctgaaaaggtgtgaggaggagaaggtggtgttcaactggagatggggagaaaaaaggagaaatctaagggcaaggaggctccacacaatggccttgacaagatgtactagaaatgcataagttagttaatttgcagagagaccagattaaactgataattataattatgatggaaacgagcacagcacacaagacacatgttcttgtctattccttagggtcacacccgggttttgggggtggcctttgcactactttgactttagacctcccttatagaaccaacaagttttgtggaaaagacacacaccccaaaaaaataatatgtatgctaggacagtgtgggtgtgggtgtttgtgtgtgtgtgtgtgtatgtgcaattgtagaagtatgcaaggcagttcactaaacataatcaagggaaaggtagaaaaagaccacttggggcatgcacatttgtctcaccaagttgtggtttgaataaaaggagatcagacagagtttagtagtgaaaaggtgcactcacaattcacagaacaaaagctccacatagaacgcttactttaatcatttcgaatttgaactctgattttcaattgttgattctatgctaattccaaaaaacttccatatattagatattttggtggatatcattccaattgtattggtaccttaacaattgtcagtgcttgctacgaaaactctgtttctagttttcagataattgatggcaattaattagtactgcatcaagttcaaatcttcagctcgcagattggacaaggttattgtactggtcaaacagttcgatctcacagtgttagtgttgctgttgtctatgtgattgattactaagttattaattaaacaagcgaccaagtaccaagaggagagtgcactacagcacacttgtcccattttatatcgaccaccaaaaatgacaagcaattacgcaactgaagatgatgatttggcactgatctaacgaatgaaagattgttcccactcttcaagttcctatgatccatgttgattggtctgatcatccccaatggcattgtcctgcatttgactgaacaatgattaacataagcatgcatggtttcttgttgttaactcttttgtttacttgggattggcaggtggcaggtgatgatcagtgaagcagcatatgatatctaaactgagagtagtagtagaagaagaagaagctagtacagaggagtgtatgtgttggagctaaaactgacaagtacgagactacagctccttgcaaaagggggctcctgaccatacattgctataggctggctctacactctacacactactactgtctacacatgcaattatacacacagagatgaaatgcatcttcgtctctcccagtcccagctactaggccacttgtgcgagctttgcctacaaggatgatcatggatgcagaggcagaggcagagcacgcagcaaccactccctggaccctgcagcagcagcctgggcaaggctatgtaggtagaagaatggagatatgatgtgtggtagatatctacatactatataatagatatatatgtttttttggatttaagtaagatacatggtagaagtgtatgccatgagtgattttcaggggacatcggtgttggtcgttgttgcttaaggagaatgatggtgacaaaaaatgtatgttagagatcagagtcttggagttctattataaagccccgttcggtagtgagctagtagtggcaatgttttccttttagcatgttttccaaactgctaaccgactgctaagattagaagcttaatcagttgctaaacaatttggtatgtgttttctaaggatttgagtttaaggactcttgtatggatttttatttgttgatttcttaactaatgttgttggtttaacttaactagttttaaaagaggtattttactgttcttaaggttgtgcagtaccaaatggcaaatcgtgaccgttgatctagcatcatccaacggtcaaaaatcgtccgtacctcattgaagcggtatcgtgggtgagagggtacgtctgtactttcacgtgcggcatcactttctttcgtgtttcgctttcttctctctttcacgataggaaaaaaatcgccggggaagagcagtgagagaaactagccctaaatcgcagggctggggtggcgagaggcaagggcaacgagagatggtggcgagagcacgggcatgaaggtcacgaatcctagatggggacattcccggtggtagcctcgatgcgactgtagtgtggtgacctcgatgtgcgatggcggcgcggcgcagacggccggcacggacgacctgatgcggtagatggaacagaggagaagagagtggcacagaggatgtcgctattggctgagtgggcagtgattagcagcggtatctcattttcgttagcccgatcatacccctgctaaaccaacggttatattatattgatacctcgtgttacattgttccccgtagattcttaaggacgggaaatatgatcgtttagaaaacattgaaacacttacactgtaacataaaacatatggtttcgtaaaagaaaaaaaaagtatatgcatgccattgggattggtgagatgataaggtagaggcagtaaaaaagaatggagacggctacgccgacgccgtgtacaagggaacagtaggtcgtgcgagtgagagtggcctccccgtgggacgacgtgtcgccgccgcattgccccgcgggacgccagccagccacagccacagagccgagccatacggccgcggcgcgcacgagagacttgtacaccggctacggcgccgacaacgctagctactatagcgcgcgctctgggctgccgcgccgcgccggccgctcccaggacgtgggcgcgcgcgtgcgcgtgcgcgtccgtgcgtgcgtgcgtgacggcgtctgcgcgcgcgccgcgccgatcgatcgatcgttcggctagctagctgtggtagctgccctgcgcacgcacgccgcgcgcgggctatgtatgcaccaccggcgcaatgcacaccgccgcgcgcgaccggccggcgccatactctcccccggcgcgcctctcgctttgtactcaactacgacttgcttctggtgtcttactacgtaggagtacctgttttcttttctttcttttttacacaacatttaacaaccctagctacaacattttttaattttctctcttgttaccatacaaagcatcaataataaggaatggaaatggtgatagctagaaattcttgttctaaaaaggagaaattatcggccaactgagcattgttttcatatcgtttttgaccttttccatttctcccatatagcatttttgtttttcttttccaacgacattttgcagtcgttaataaatagttaaattggtaaatatgaaaaaattttgaccggtcaataatcattttcataatgtctctgaccatttttcatgtgttaaagatacagctatgagcaggtttcaaaaaacgatcggttttcacgagaaccgcttggttttcgtgaaactgcccacggtcaatttagggttacatatcagttttaggctagtttccgtagtacattgattgaaaatccccgattttatcagtttttgggtaaaccggtgagaagggtttttttatttccaaaacgaaaaggtaaatcccggccatgagcgagtgaaaggcatgacacacaggtagctagatagcaatagcatagcaagcagctcgagtcactactcactagtagacgactaccagtgtgtcacacactcacactagtctatatacatatagctgtcaaatgtatacatgtgatgggtatagctagctcagctcttgaccgaccgggcatgcagtccaagtgtcgtgcgtgtagaggataagaagagtcgagatgatgtacacagtacagatggatggaacgggggtagaaggataggatgatatgtgtaggagtagagcactgttcacgtaagcacattgctgatgatgatgatgatgcatggtgtggtcgtagacgagagagagagagagagaggctaacttcacttgttctgcagaggaggcgacgcgtcagctgcctctgccagcgccccccgaaatggtaaccaaggattgtgtttggtttgctttggttgtgccttttccaccggggaaatggtaacatctcctcatacttctcctcctccccaactggccaaaccaacaagaagtatatacactagtagtagactactagtactatactgtactattggagtagtactagggctagtgctagccgtatagtatgagatattgagatatgacaacatttttttctcctgtgttttgggcctctttggatcattgcccaaaaaaaatggcattcaaaaatcgtcactcatttggtttagataagaaaaattggcattgccaaattatttagcatcctttctatgcc

SEQ ID NO: 26426 - DNA, 14426 bp, Oryza sativa
  unsure (1)..(14426): unsure at all n locations
nnnnnnnnnnnnnnnnnnnnnnnnnnnnnnnnnnnnnnnnnnnnnnnnnnnngtactatactgtactattggagtagtactagggctagtgctagccgtatagtatgagatattgagatatgacaacatttttttctcctgtgttttgggcctctttggatcattgcccaaaaaaaatggcattcaaaaatcgtcactcatttggtttagataagaaaaattggcattgccaaattatttagcatcctttctatgccattgcatttggcttggctaagattggtatctgcaccagtactgtaaaaaaacaatagtggtcaagctctatttttgtgttttttataagttagtctacgatattttctaatattatgtaatagtctaatatttaaataagtatgaacaaagcataggatggcattttacagcaacagagcccaacttttgggcctttttttttgccaggattcgagacgtacggcagtggcagtgtgcaatgcaatcgcagttcgacactcaaaaaggcaaggatggccacaagcttgggagatcatgctactgtagcacagctacagtaagacggcctacagggaggtatgatgagtttttaagacaatgttgactcctcgggaaataaccagcctgtatgccagattcattcgcccaatcactggatctcataatcccaggaaaagacacaacaagcaggaattctgcaagcaaaggtccagacaggttttgccaatcgtttgagagatggaagaatatccagttcagaataacaccatcatttcattttccccccgacatctcaagctgaatcatcatatcagcatcatcgtacaaccaaaagaaagaagaatcgtatagaatacaacgaaattcgtgtttgactgagttcaatgccccaggtgaggaaacagcaagccagcacccataattcagttttgcagcactggatttcacaggttttgtattgttcactgtaaattgtatacaagtgctagtcttgaggtcttgcctctctcgacaaatgtggcttccggtcatcatgtgacaggcatgcagcccgcaaatgggatttccagtgtcaaaatgccaggaagagcaagtgcttacaatgcttacaagaaatgggactcacaaaaaagtgaaatcaagaaaaatgacaacagcaacgccttcagctccctaataccagagaagttaaagaatcatagggatttcaactttttcttcttcgatgctttttgggacttggaatctttagcagcctgcatcccagaatcgttcatcagtattttccaccaagcaaaaatatgtaaaactaaaaatattcaaactattttccacggtatagctatgtgtggctgtgctattatgaacggagtatgtccatctggtaagccaagaaggcagtacttagaccctgatttttaccaagtagactatgcaatgacagtaacccagaagcttagtctcctgattctcctctttcttgtgaaggaaaactagtaaaagggtattacagtattattacctttagatttttctttttatttttcttctttttcttgctctgttctcctccgttttgaaaactcttatccttctgagcaatatgatatgactgtcagatacatgtcaaaaaactttcggcgtatggtatataaaagcagcaaaattgaaacaattcacagacattctcaagtgaatgttcatatacttgccttattcttcctttttcttttgacccccttggtttcttctccatcttttgaatcatcagaatcctgatagtcttgaaattgtaagcgcggaaatcaaataaacaaattatatatgaaagttatcatcaacatatatacctcagaagaatctccgaatgatgaaacgtgccgtactattcttcctgaagttgacggttcacctagattgacagaataaaatggtaggtcaaattcactggttcacataaacagttaataatgggcaaacattgggaatgagaaaaacgctggtgtaggtcaatcctaataccttagcagacaatgcagaaaccaagcaaccttagcattagctggtggacaaaataaatgtatgatcaagtcttataaccgtttttactaattaaggtttaaattgtttgaagtttcatgttcctatataagacagatgtgcagcccacctttgagccattttctatcttaaccatcaatccatcatatcatagaaaaaaaatatcgagcagtcatgtaataacaaatgctccaaattacggaagaagaaatgggaaaataaactgtaagacaaggttaattttcatgctcttatagttttatgagtatttgtactaaaatgcacaccattactggtttacgtaaatcattacataatgtaatctataatgacataggacacgcaatacatgcattccaaagaaccagagtaccagacatatgacagtgagatgataagaaatccgtacccttgctagcctttattgtttcttttgcatttctcacagccaatttgacaaggtctgggttcagagattccagcccatcaggctgctgaagctttctctcaaggaattttgctaaagcagcagccttgtttgtagttagtggtcctccaggatgagccatcctatttaaaggagtacagtatttgagcctttcagggtcatgtcatgagcataacaaagaacaaaaacccatgaagatcatactttacatagagcaagcctacaaaataaagtccacagagctagactccttggtcactcgtgcatgagaaaaacaataacacaatatattccaagttatctgctatgatatctaccatagtttaaacctaatattatgtttcaggcaaaatccaccagaacttgaaccatcgctcttttttacttccaaaagcgagcatagatgcaagaggcactgattaattcatagtataaacacagctataccataatccaaacatgatagttgtcaaacatatagtatttcgctatctcagcaatacagatttcaaatatgtgatccaaatttctgctagcaatatattcagattagtttcctaggaggacttgaaatctttccctattaggagtcttatcttttatctcctatatatgctatattgtaagccacatgggaaggggtgacgtcccattgttattcccctgcgtttgtaaccaactcctcaatagtgatcattgccaatagacgctcatggtttttccccgtaagtgttttctacgtaaaaattcgtgtctccgttgtgcatatattttcataacaagtctactttgtcatttttggcttatgtgcaggcaacaggcaccagaggcaccttggggaaaagaaggcgcagaattgcaaacctcctagcttaattgcttaaacagtgagaaattgctataaagcaactcaaaatcccagttcaatcaacaagcctataaaaacgcacataaatgatactcctaacgtaataatttgaacttcaactacacgcaattccttcctctgaatcacacaaacagcaaaacgaccaaaccctaatccgcattcgcaaggaaacacacctagcttagctcgatcaatctgctcacgaaaaaggtatagaactaatcaagtagccgcttatacgcgggaatctagctttccccacaagtgacactagacgaatcgcttgaatcagcaaactccaagctacgaatggatctggagtcagggaaaatagaaggaaaggggggcgacggatacgatacgacacctgggctgggggcgggaaggggcagtaggcgctggaagcggcgcgaacttgctgccccggagcgcgcggcgctcctcgtcggtgaggtcgccggccgccgccatgacgccggccgcaccgcacgatcggcggcggtcggtggaggtgtgcgaagaggaaggcggcggctcgactcctccggttcagttgggctcttggaccttctttgggcgcggtcggagtcggaccggactggaccggagcgtgtgttgtgttttgactttttgagttcaaacgggaggagtacttctgtatgacatacaggtgggtccgggtataaaaattcacgcttccgcgtaaactttgacgaatttttgtactccatactgttttggcttctacgatagaacattcatatggctagtttatccaaaacttggacagctagttcaaaatttggcttttaataatttccatgtgcttcagacattcatatgatgcaggccaagggtgtgtttagttccacaccaaaattggaagtttgactaaaattgtaagtttaaagaaaaaagttgaaagtttatgtatgtaggaaagttttgatgtgatgaaaaagttagaagtttaaagaaaaaattgggaactaaccaaggactaaatagtgcgagattctccgaagaaaatctgcaaagcatgatcaatgaatacaattcatccaagattcagaaataggggaatccatttcccaatcccacgacatgctaagaattgatgtagtagtattaatgtagcacgcattacacaaagctcgtcggatcgagaaatcacaaagatgctccaaacttataatgccaggacaaaagatgttcagacttattgccatgttatgtgctatcattgaacattttaacagttgaactggatgtattcacaagatcaccgaagccccggagttcagatggtagcagctaaagctagttctgccagcatctttacatcacatggtaactcggcaactacattacatgtataaaagagcaaacaaaatgacgtacacagttgaggatgaccaacagaagattcagctcaaaacaaagctagtattactgggtagtacggcaagcatgatcagaaaaatcgatttagacatagtagatcatgccgacttcgacgaggctaatgtggggtatgtgcagcgccaccgcgggacccctgcagttcttgcggaggaacgagtaagcgtagtcgatggcgaacgtcttgaggaagttggagttcttccttgccttcacgtaggagtggccgatgatgtaagtcacgccggcctccttggcgtccaggagatcagccagctcgtcccgcacctgggggtcgatccgctcctcctccgcaatctcaaaacggactctgcgacgccggctgagactaccggactcctgctcgtagatggactggaggctccggagcgtctccgacctgctgctccttgtcagggacgtgcctgaagcctcgttattggagtccctcatcaccagaccggtgccggttgtgtcctctgtgtgtatgacagccatcctcccttccgaagattcgtagctcccagaggaggctgcctcctcggcttccatttggatgaacttggcaatgctcatcaccaagtggttctcaaagttctcgtcatctttctgcacatctttgtagccatacctcacgatgcaccggtacatacggtattccctggggccgatccgtccaatgaggtaccgttcgtcctctggaacgaacggcacaggtacggacttgacgcaaacgaagaccagaacctgatggaaagcaggcaggttggtgacaaagtgcgagaagatggaaggcaccccggtgaccagctctgtgtagatgagaccgattccaggcacccgaacgatcccaaggctcggaccaagtgtcaggatccatttcattgagaccttgttctggagatcaaacaggtacttcctccgagagccgtagtgccatacgtacatgacgagcatgaacacgaaggcaaatacgattggtgcccatcctccctgaggaactttagtgactgctgccgacaggtacaccacttcgattgacccaaacgccacgacaaataacaaggcgagcaggatgtttttttgccacacaaatatgataaccaatgccatcaaccaggtggtaacaaacatcacaacgatacacgcaagacctgaaatcggcagaggaaatgacaaatgagttgcaataggagtaacataatactaaatatagcatgagaaactcctttgttttttgagaatcagataagagagctatcatctctcaggagaaaacaagaaagctaataaactagtctagttcaaaaagatgcaagcatacattggcatgcatcgccaaattaagttgaagagtgtcactattaagtagtgacctattcagaaaaataacagctggtgcacctattatgccccatgaggaggaaccaggtagctatatgaatgtgattctgaattacagaattgttgtctactataattaataatgcacattcctttaaccttttaattattcaacattggaatataaattcaaatttacatggcatgctggtaataggggatctaaactgtttgaatttataacctaaagcagtcctatagtccatactgttttcttagctactgcagtattgaagatctgagttgatcaaagttaagagtataaagaagtgttcaaacttaccgtaagcatttccaataactgtcgtgtctcggaaaccaagtgtcacagcaagacaaagaaccatcagaatccaattaatctcaggtatgtaaatctgaccatggatccaccttgatgtatgcacgaccttaacccgtggaaaacatcccaaagaaagacactgcttaacaattgaaaaggtagcagatatgatagactggctgcccacaaccgctgcaagagttgcaatgacaaacactggccaaaacagggatcctgcaaatatgatgcaatatgaagcaagaattcttggcaacatacaaaacaaattattccaaaatatgcttggagttatgaagattacttggtacagattggtaaaagctatcttctacagctgacatgtttctggaaagaaatgcagcctgccccatgtattgcagcacaagacagggatatatggcaccaacaaaagccaactacaagcaggacaagagctggagtcacaacgatagaatgacaaataccaccttaataacttaggatgcaatatgcatccccaaaaaaaatgggaattttatgttgcaacttgcagcataccctaatagatgcagcagtgaagtggccaagatcagcaaacatagcttcagtacctgaagtcacagaaattattaggaaacccattcactaaaattgtaagataaatggcttgagccacatagaagggctattcaaattcacctgttatagcaagaagtactcctccaagagaaagccaaccatcttttcctgtcatcttgaagaactttataacataatgtggagaaagagcaagaaatattctgtggttccagtggatgatattataaagcccaataacaccaatactcaacagccatactacaacaatgggcgcaaacataaatgctaccctatgagttcctcggtgttgcagtgcaaacaggccaacaagcacaatacatgcaatgaacaccacccaacctgcacaacagcaagttagttaaggtagtgaatgctgttcactgaaagaaacccctagtaatggctgctggaataggtaactgcactaaaaatcttgtatggtctcctaaaagaaaattgtatgagagagagattgagagagatctaacaggttaaatctacatcaactgtagtagcctgcaaattcagttagaattaagttctcactatatgactcgatcagacaaatatgctcctaatatggtatccagatttaaaactttaaagcagcttgatgatactaatgaacttcaaataagaactgggtattttgattcaaataagcatcttgtatggatgttatttccaggggagatttataaggccaaaggccaaagcggatccaaagtttaggaagttcaacttatgacatacagttagcaaaaaaagcaggtaacttacaaatagccaacaatttgcgacagtgtgtaatgattagaaaattagcaagactagatggactactttcttaaaacagcttgctacagaaaatgaaatgattagaaaatgctggtgctagggaatatgttgagcaaatttcttagcagctcataagcagtagaaaagacagtgctaaggcataccatctggtattcctcctgggccagggtcttttaaaccagagatggctgacaagactgcagcagacacaacaagagaatttattagcaaaaccatccaggtgaaaaagcatgcgttgaataattgaaaaaaaaaagaaagacgaagctaatctaatgtacatgccaggcataccagagatagcaggtgtgaaaacaccatcacctatcaccatgcatgcgccaaacagaacaaaaagtagtaaacaagtccgtagcttcctgtgcttctccaggaatcttttgagtggagaggaaataatgccaccaactccaggctgatagtacgttgaaagctcttcgtctgccgattgctggtttggaagcaggctgaactttgcatgcctgcagagaagtgagtataaagcaaatgttccacctacataaacaaaaattataatcaatcaaaaaacatgataaagatgactcttaaactaactagacagaacaatgcataaattcgttaaagaatggagtagcatatttattgacgatgacatatgtgagttgttacagaatatgatcctctatatactcctgatcggcttaggcagatgtgcacgatcaaaactcaagcacttttgggagttgaagaacataagttaaaatacaacgtatgtgtttctgttaaatttctgataacccagcatatagtactatgaagttactcaccttccccattatcatctgcgttcaatacaattattacatacttcagcaacggaagaagtgtcaaagtccaaaatatcagcgaaaacaatccaaatatggttgtctcatcacggtaattattcagcctcccagaaaatgcacttttgtagacgtacaggggtgatgtactcaagtctccatagaccacaccaaagctctgaaatgctagcagagagatagttctgcaataacttttccattggtcctgcaaaagcacaatcatcagtacgccgaccctgtgattgtgaatagtaactattactgagaaccgatcagtacagtccagtatgtaaaacaagagagaaagcagatattggtagctgggcatgtattaaacagattattaatttgatattggtagctcatacttttattagactactcttttgtcgaggggaaaaaccaacaactatagatcacgcaaatttagaattgtcgggattaaaagtggtagctgtacacgtctcaataaaaaaaatgtgatgccaatgcgtcaacgcagcaaaaatgtgtaatactaatgtactagccaaccccatccccaaccaaacaccaaccaaaagcacagttgacttgattcatcaactacatatggctctaaaaccaagctggttctcagtttcagcgaatttaagcgaaacaagttcaccggattgatcagcacgaccgcaccgtctcgtattcgattgcaaacagtaactcgccgcaccccgcttgaaatcgcgaaatcaaaatcgaacgagaaccctctcggaatcaaacgcgagaccttcctgacggtaaaaaggcgagcaaaatcgagacgcgcgcgttatcacctcggcgtgacgaccacatcggagtcctaaccactcgcggagtcacaacacacaacccacccaatcgccttatccaaaaaaaaaaaacaactcctcccaacaatgaacagatggggaaaaaaattcacagccccttctcgaaatcgagcagaatccgatccaccaccggagacgggttgggggaagttacctgcggcgcggccgggccggtctctgcgtccattgcgctcccccccccccacccaccgtgacgacgggctgcaccgcgaagcaagcagccccagatcaaatcagatcaaatcaaaaccaaatcagctaacccgcgccttggcggccgtggggtcgcctcgccggagcaggagagaccacgacgacgacgacgacgaggaggagggggtggggctagcaagaggagagaagcttccacgcggcgcctggttttatagcggaggagagcgcgcgcttggagagctcacgtcgccgtctcgacgaagaacgcgtaggagcagcgtggtgcggcggcggggaggcgggggcggggtgggccccggcgcagtgggttttagggcggggcgggtgactggagtgtggggtcaggagatgctgccgccctgcgggatggtgggccaggggtggcagcgagacgtgtgttgccagccgggccgagaggagcctgcccggtcgtggcctggaccgtggggccccgtatcacgcggacacctagacgcacgggtgcaattttgacacgagcggctgggatctggtgtgccgtagctgacagtggaccaacttgcggtcaggatgtactccctccgtaaaaaaaaaaacaaaaaaaaaacactaaacgatagggcacagtacaatgaatatgggcaagacgccaaaaagcgacctcttgcgccatggctgcgacaacctcagaccaaatgcaccttccttttttttatagggataggcttcgtggttcatctagataataatcaaacacccgaataaattgtgcttggtggcaccttgtatagtttattaaacacctctctgtagctatactcccttcgtggctctgtcctagaaaaaaaacttgtgaatacgtatttagatatggttagaaattggtttttttctgaataaataattgttaactactacagttgtatgactgtagagtcggttgaggatgctcgtgagagcttacatcaaaaattggcgttactcatctgccaattaccaacgagcttataatggttaaaacctacttccttggtccaaaaaatcgaatctaggactggatatgacatattctagtataataaatctgaacataggtatgtccagatttttagtattagtatcatactagaaaaaatgcccgtgcgttgcaacgggtaaaaccatttttgtattgatatacattgtaccttttggttttggataaaaacttattttcttccttcctattcagtctcggcccaacccgctacttctctctacttggcttacttcttttgaacctagaccacaagtagagctataggcctatctcgtatagtcgactgccgtgttcaacctcgaagataggaccgtgtagtatgatgccagaaccaatactccccatcaaatacgatccaatctttctcaatctcctaaaattggttgagtgctcttattcactcgatcttttctttccgtttttatcaaaaccgcagcgaatccataaaactctaggatataaatggtgacttctaaatatagagattgaatctgataaattaaagcggaaataaaagaaaaaattatggggaaaatgatgatggagtagtggagaattgatttttcaatcaattggaggagggaaagcatgagaaggccgatcgatgtggcggtggtgctagagttcggcccgacgacgaaaaaaccgggtagataaaaaaaaagaatcctcacaatgtgcacagaccctttctcatgacaaaaattgcgaataaaatataaggacaaaaaaagcggatgggaaaaaaataaaagcggaaaaaaagaagaaaaaaaaggcggataaaagagagggacttttttttgctgttttataatgtgtttttttctctggtaatttttacggtcttttttctacaccgttttttagacgacagtttcttttttcgcgtggctttctttattttttttacgatcggcgacttttatatttttgtacagtcggctttttctgtttttttcagcttttttccgccacattatttttcccgtttccagtccggatcggactttttttcgctgtttttctttcgcgtttcattacgatgcgttttcttttcccgcatgattttttttcaccctttctaaaattatggaatttaagtagtagagattaaaactgaaaaaagtattaaaacctactcaaatacagatgacgtaccaaaatattggcaaaaatatcttaaacttttataatatgtaaagattaattactaggttattttttataggagagggagtactctacatagttagtgtggacgttctaatacgatggaagtatgatcctcggttgctgctaccaacagaacttgcaagcatattcaatccgacacctcgtttgagcacttgaagactagggctgtgtttagatataaagtttagatccaaacttctatcacatcaacatgtcatacacataacttttcagccacatcatctctaattttaacaaaaatttaaactttgcgctgaactaaacatagcctagaattattaccaaaccaaatccaatcgtgtctctttaatatatctgcacgtttattctacgaattcatagtagtagctctataatctacgtacggcttctttgccacggaatattatgatgaccattaacgatcaaactaatttcaacctgtggtcaaaaggccatcatattccgcgtgaattaattgagctgctttttcagatgaaaacgaagataaaaggtgttaaacactcagactccgtgactatacgtgcgtgtactgaactccaaagtccaaaaacgtcctatcttaagggcgctcgggactgaatcgtgcaaaattctgatttgttcatttagtttttttttttggtcctagcggaacttgattcgaatagtcagatggcgtgtcctaaccaccttgtcaaaaacaattccggccacataatgaccccagtgactccaagagccgtgatataattaataataagataaagtacagtgctcgtgagattgactacaggatcgcatggaaccaagccgatctcacaaattagattggaaaactgcaattattgagttaatatatgcacagcatatgtcatctaaaaaaggagtatacagcacaggatccttattttaaaacccttttgacaatgaccagcacgtttcactctactacaattctcttacctccgtcgttttccacgtcgtgtataatatgttcttggtcaaaaaaataacaggtgctcgctgatttattttataccaacatttatatattcttcaagagtttcgagcagctcatatatcctttttagggtgtgcttaaatgaagtgttcggcagcatggcaatatagaagatttgtgttgttttcgcgtgcacgcttttcgaattaagatgtattttttaaaatatctatggaaaatttgattaaaaacatatactaaaaaattttaaataattaacactcaactaatcttttttatcaaaacactcaattaatattgcactaatgcctaacctcgttttacttattttcctaatttttttattttattacctctcgtacacacactaaggctatgttctttcctcatgattgggaacactttcctccagcacggaaaacaaagtagtccattatcgcgtggttaattaagtattagccatttttttcaaaaatggatcaatatgatttttttaaacaacttttgtatagaaactttttttaaaaaatgtactgtttagcattttaaaaagcgtgcgcgcagaagacaagaaagaggggattgggaaccctcaggaaggaacacaacctaagaagctttaagctttaggccctgtttagatcccaccttaaaatttttcaccctgtcacatcgaacgtttgaacacctgcatgaagtattaaatataggctaaaaaataactaattgcatagattgcgactaatttacgagacgaatcttttaagcctaattgctatatgatttgataatatggtgctacagtaaacattactaatgacggattaattaggcttaataaattcgtttcgcgttttactgacgaattctgtaattagtttttttattagtaccaaaatacctcatacgacaccctatataatacccgatgtgacacgtaaaaactttatgccggtgattaaacaccccattagtgccagtacatactacgtgcaagtggagtaaacctgttctcctggcaggaataatgaattaattagttgcacatgtgaccagtgtgtgtgcacgtgaaggagtagatcacagctaactgaacgacggctgggccggggcaacaacgcgattggcacgcggaatctgcaggggattggtacatgaagagatgagagagcccttgtcgccacgacgagacatgcattcgcgtgtgacgtactctcgcagtctcgctcgctcgcctcatccgtggaagccaaccaccgagcagggccgtgcttccggac

SEQ ID NO: 26427 - DNA, 2589 bp, Oryza sativa
atcagctaaaaaaacctaacttctggctatatatttggatactattataacttatgtcttatgtccagatacatagtcagaagttggcttctttttttttttttacagagagagcactttacttaagggtgattggttggttatttcacattgccaagccacatcatagtcatgccacatttttcttaggtattcgtttgttttgatgttataatgatatgccatagtttcttagccttgggacccacatgtcattctcttaaatttgaaacagagtgggtgtgttcggaatagcatgtttccggcatgcacagcaaacacggaaaacgaagcggtccattagcgcgtgattaattaagtattagctaatattattttcaaaaatagatcaatatgattttttaagcaactttcgtatatattttttttgcaaaaaaacgcactgtttagcagtttaaaaagcgtgcgtgcgaaatacaatggagaggggctgggaacatagggttctaaacacagcctgtcactcttgtagccaactttttcttagtcatacgtgtgtcataaattgtctatggtaaggatagaatcaaccaaacacccccttagcttgctagctaagctttttttttttaggaaaaaaaatcgctggcttaggtcgtccgagacgatgaccgtactgacccactccatctgtttttgacttttgactgcctaattaggctattggagacgtgttccgtctgacagctccatcgattgttaaaattaaattgtaaaattttattttgaggttgattttagtttttcaattgtagattaccttttaatatttgtcttaatcactaaggatacaattgtagtttaccttttaatatttgtcttaatcactaaggatacatatataaatgttaaacatcaaatatttttaggtgctaataagcactgctcagtaaaaaaaatcaaaccctagatttcaatctagatataaggtttaaattttttttggaacgaaggggatacacggataagaccatgagtagttggctgaacagctgctgatggtggcggtggtgctctatcagtgtttatctgctcaagggagggagttgccaattgcagctctatatatagagagagagtggcgatcatggatcacttgtttggatgtgaacgattcaggaattgtcatttgtggatgtgaacgactctgggaaagcctttttgattgtgacgcatgaattcgttgagtgtagtggaaattaggccgtgtccgtgtgtggttcatgcctgatgttgattgatgtttttctctcaaacttttggaatttgctctttttatcttgcacggatgaagtatttgagaaacttttagaagcacaggacatgggaatctggtagttcgttgccaccttaaatgattcaggagcttgtcttttgagcgtggtcgaacatggtatatcaaacaagtgcgccacaagagtacatatatgcaaattaaaatttatacgttctaaaatactttttacttcaagtaacatgcaataacgttgccacaaccacaaggttatttttatgaacatctagatcaaaagccaatctttttacaaataataaaatcatgtaacatctaaacattatgatggagatatctgacagagcctttatgtttgcaagttagacaatcttattgtaaatcagttacgagtactatatactaaattttttctatttttatttagacaaaagacttaacttgcataatcgatatcgatgttgctgtaaactgtaagcaacagttgtgcattagtccacatatttttagccgaaagcctttgtttatgtaatcaattctagtgttactagtagaaactataaagagccgtttatattttaaagtactgtaccagtacttatatattactttcttcgtttgatactataaagttgctttggttttttttattaccaaatttctttaggtttgccaaatttatagaaaaaatagtaacatcaataaaattaaattagtttcattaaatataacattaaatatatatttaataatatgtttgttttgtaaagaaaactgttgttatatctttctacaaacttgatcgaatttaaacaaatttaactagtaaaaggacgacttataatatgaaacgcagagagtagtataatattcatcgtagataattacataaacctttaagcacaacatagataatcgcctcataagaaattattcttttacaaatttatcacaacaaaatataattgtccaaacacaattaagattgtagcttgaattggccgtgacacataaccacctccaaaaccaaacacgcttttctttccgaaggagaagagaagagaaagggagaagaagggaacattccaatcaattattcgggtgcgaaaaggcaagccgcaaggcagctcaacgcccgtaggcagggagaaagggaccgaaaaccagcaaccgaacgaaagaatgatgccaccggccaccacctccaccaccaaagccccccccccccccccccccccccaaaaaaaaaagggtaccgagctcgaattcgccctata

SEQ ID NO: 26428 - DNA, 4397 bp, Oryza sativa
cttttgcggaaaatcaattaaagatagctcacgtgcgaggaagacgccatcgcgagaggcggaaccgagcgaggaggaaaggagggcggaatctcgcgatccccaatccgtggaggggcgctccgatgcgccgattcggcgagagatcccgccgatcggggagctcccggggtgggattccagctgcgggatttgggggcgctgagcttgagctcgggggaggcggggggtgggcccagggctgcgagcggcggcggcggccgcggaggcggggggtttggttgtgggttgtggggttgggggtggatgctgtcggtgaggaggcggcaggaggatgcacgcggcgtagggctccggggcggcgccgcagcgggcggcatggaggacgacgcggagctcgaggagggggaggcctgcggggacgagacggccttcgtcgaccccgacgtcgcgctctcttacattgtgagtggtggcccgagcgaaatgcccgcggtttcctctgctcctgttgagttcgtcgcggtttctatgcttgtttggtagttgcccgatgacgatttaagcttagttgagtagtttgatcggttatattcgtttagagaacggacatgtctagcttaaattttatgcttcgtaggagtgatgctgctgatttagcatgggaatgaagtgattgcattgatgaatcatttgaagtctgatcaattcgttgcttcggttgtcggatactggaaacaattgcattggtgcagcatttaaagtttgctctttctttttttgtttgtttcgtagtagttgttgttgatgatactatactagtctatgtagatgaatcctttgatgacgctggttattatgtaatagaatgtgaatctactggttgcaattttggtattttgtgcggtttattcgagattggcagtattagcataacattttatatggtggaatcaatctctcctccttttcttttcccttttgaactgccaggctgaattcatggtgctattacttggatttgttcatgcaaggctacacgttatttttgatagcaggactatgtgcttcctcgagctacttttaatggatcaaacatcactcttagtctacaatgcccagtgaattaattaaatacgcttatgttttgaggttactgtcaacagttactttatagtaatgaaacggaattttaaactcaaaatttccaatgcatgctttatatctgaaatcctttggaccagaagaaacggaaagggaaacaaattgaaaaggcagaaatagcgaagtgtttaattatcaaaacttgcctataggtaggttgccttttatggataacttgcaacatgaatgcgatagacaccagcaactttcacttgaagacgatatattgtattgtgccaacaatcaaatctgttgaatggttccttttttgctcttgatgtgcttttttccctcaggatgaaaaaatccaagatgtacttggccattttcagaaggactttcaaggaactgtatctgcagaaaatctacgtgagcagatatgagttgctgacgtaatcattttcactttggtacactatagagagacattaaaacaggggattaaaccatgacaggatcgaagtttggtgggtatggttcattcttggctacttaccagcgttctgccggtgccccaaactagaagtccacctaaggcggcaaatgttagctcaagatctccttatcaccagcctacagaggtgcttaaattagttttgactgtaaacattcaatgttttaaaataatgttctgatgagatgacctggaatttagagcatgtcccagaacactttggctgtggcagctccatctgtttcaaaacataatggttccatggtgccactttctgatgattcaagtaagaaggaagtacatcaaagcacaaaagttgaaagagcctctagcacccaagattcattgaatgggctatctaagtctagtgaccacaatagatttaaagttcggatcaaagttggttcggacaatggtttggcaagaaacaatgcagctatttacagtggtttgggtcttgatatttcttcaccttcatccatagaggatagccctgatggctgtgggagcctctctccagaatttaacaatgtgccaattgaatctcccaggaccattcttcaggtaaattactgcatgaactctttgcacttatttttcattatgcaaggttcatacaatgaataactgtcttcattctctaaatatatggaacagatcatgacatgcttttcagttcctggagggttcttgttatcccctctgcgagatgatcttgttcaactgacacaaaaggttgtgcctacatcaaagaaatgggaaacaaatgcaaacacagaaaatgtacaagaaagatatgaagggtatgcggctaaaagggtgaaatctgatgctaagaaaaagaaagctgtagatacgaagaggtcaaaaagcagaaatgatgtcagcgcagttatgaaaaatgagattgatatagaaacacctgctggtcaaaagatcgtattggaagctctcaacataccattgctgtctaatcccagaaccatggaggcaaaggacgggagccagtttgaagaggatcctatgcgagacaccttggtggaaaataaagatgcccgattgaaagaacggaccatcaacagtgacttaatggcaatcaaatatgaaaatgtcaaagccgaggcagcggaatgtttagagaacagtggtcctggcagttcaggaatggatttttcagcagtcaagggggaagtgaaattcaaggcagaaaaagcagagatccatgtagaagacaggaatactactagtgaaaaggacttccaatcggatagaaaacaagaaagaaaaataaaaacagagagtaagtgcaatgccacaggagttaactttgaaggtaacaaggttatgaatgaaagaacacctgttgtcggcaggagcataggaaaggtttctagtaaagaaacattacttaatgatattaatgaagaaaatgtctccaagagtgagtccagaagaagtcagaaagagcaaaacatgaatgcttcatcatcttctgatttcctggaagatgacaggggtgtcctttcttctggtgcagttaaggagaggaaaaatgattcgcaatccaaatctagccatccaggaaggaaacccaaagcaaaatcacatagagatgttagggagcacttacctgaaggatcttatggaggcaaggatgatacattggagaatggaagtgggctgggagagttacggccaaaaaaaatttggaagaatgatagtgagagggattctgatatgcctgggacatcaaaaagggaaatttcatctagtttgaagaatgataggcacacacctgctgaggagcagaggatgcatgtacctccatctgttagtgcacctactgcaaatgcagctcctatgcttcctgcccccgtcgtgatagaggaacattgggtatgctgtgacatatgccagaaatggcgtctcctgccatataagatgaatccttctctgctaccaaagaagtggaaatgtagcatgctacagtgcctgtaagttcacttttcaaatccacatataatcttcaaatttcgtttattttagtaccttatgttccctttatacttcctgctcattttgctgcctctcttattacttcattgaaccaatgagtgtatcagtattcggtagttagcataataacatgtaataagaggcaccatgtgcattgagggttgtttgattggactgcctaaaattactccatccgttctaatgcatatgtttgattattatttctcctaattatatgttctcaataaatattaaagatataatggtaacacaatgcttttaatgagaaacatactaatgccatcactaaaattgtattacatggcgaactttctttccgttctatctcgaatgcaagaaattttttgggtggagtgactagtggctacaggattggagtttgggtatactcttttaatggtttcatgtgccccctatatgcacctgaactgtttaggctgtagttcaaattaaaaatgactatacagtagttaatgttattttctgctatcctgtagctttcagtaaggtgatacattggtatgcatgagtaatgttatatttattcatgttcgtgcttatgcgggacattttgtttgtttgttgctgaaaagctacattttccaacttttgcagaccagggatgaatagatgtgaagttagtgaagatgagactaccaatgctctgaatgcactatatgtcagtccagcccctggcaatggcgttgcttcggttggacattctcatgttgcttcttcaggg

SEQ ID NO: 26429 - DNA, 4783 bp, Oryza sativa
  unsure (1)..(4783): unsure at all n locations
cccctatatgcacctgaactgtttaggctgtagttcaaattaaaaatgactatacagtagttaatgttattttctgctatcctgtagctttcagtaaggtgatacattggtatgcatgagtaatgttatatttattcatgttcgtgcttatgcgggacattttgtttgtttgttgctgaaaagctacattttccaacttttgcagaccagggatgaatagatgtgaagttagtgaagatgagactaccaatgctctgaatgcactatatgtcagtccagcccctggcaatggcgttgcttcggttggacattctcatgttgcttcttcagggctaacaacatcaaacactttgaatgtaaatggacatgttgaacaaagtaggaaaaggaagaatactctgagtgacggaaatgtttcctttgatgtttctcagcaaatgcaaggttcggtttatccactgagcaaccaacatgctcctattagaagtaaaagtgctgctgatagtatccagtttcctgttgagagagattctaaatcagttgaccatttcgttgagaagaaaaggtccaagagcaagaatcatggtagctcttctgatggaggttctgtctactgtttttccttctattctcctagtttggtttcccgtatgaattcactctagttgcatcatttggttatgtttcttttctgaaactttctttattcaaatacaggccatctcgtggaaagatccaagaagcattcaaaagtaaaaagcaagagagagatggatcatgatgaatacagaacttctaagaaaattaagaaagaggagcggcgccagcgccagtctggcatagattctaaccctggatatgatttagctagtggagacgttcctgatgaggccaaagctttgccttcaaaatcgatggccttacagggttcgagtgaaaggagtgatgttcctccatcaaagtataaaagtgtttctaagtataattcttcagaaaaatctaagagatctaaggatggggatgtttttcttcctgaagacaagaacaaggaacattcttacccctctgatgcacaaaaaccagatttgtctagtaagaagaggatagtgaaggaatgggaggagagtcagcacaattcaacacctccggtgagtaaaatgtctattgtaaaccaaagctcttcttccaaagaaacctgcaaggatcagaacttaaaggaaacaaagtcaaagttaacaaagtctgaagaaccgtttgccatgacagattcaaaatcaataaaagttgcacattctaatcaaacttcacgcaatctaaataatgagctatttgaggacagcacaccttttgctgttaaaagtggtatgtctgaaccacctgaaaatcgatcttctgaacaagctttggatttggctgaacctgcctccagtgatttggcctactttcagactacagctgtaacttcaagctcctcaaaggcttccggctctcagagaaggaaacaaaacttccacgttgcaaaaacttcaccaattgagtctgtctcttcatcaccacctagaatctctaacaatgacaaggtctcccatgacaaaatactgggaaaggatggatctacatgtgctaatacaaacaacatgcagagcttggtaaagaatactgaagttatagtagataatgttcggcaggccaggaagtcacatgagagcatgcttgctagtgaacctgttatgaatggtttttcacaagggaactctgataaagataatgaattgcctcagttaactcaaggccatgcttccaatgggattatttcgggaaggagtttggatgatgatctgcagcatgcatctgggaggaaagattcttctttgaaaagctccaatgcagctagaagtcataaccacttgcattatgctaataaaaataacttgcttactgatggctcttcaatccaacataggatggcagtcttggatactaaaggtgattccatggtacatgaaaacaagagaagtgttacttctctccaagacagaaatggatcaactcattacccaccagatggaaatccccaatcagaggtgtcattcggaaaagaaaagtcacatcccaagagcaacaagcatgatatgcagaattccaaagcccaaatgctcccctcacctctgaaagaaagtaaagtggaatcccactccgctccattaagatctaatgcatcaaaattgacagcacagttaaagcggggcaatgttgaaaatggagggcaacatggcattacaaaacaagcaatttctaatcctgcagacacttccagtccagttaggaaggataataactcaactggatatgctctcaaagaagcccgggatttgaagcacaaggctaatcgtttaaaggttcctcaccctagctctctttgctgtaatgcacatgaaagtgagttttttatatgtaaggttctcacatacttgtctgcaggaagaaggaaaagaacaagaaagtacaagactttattttgagtcagccttaaaatatttgcatgttgcgtcaaccttggaacctcctccaagcattgatggctttaaacaatgtgatgcagctcagaacttgtattccgataccgcaaaactctgcaagtaagttattgtagtactaatatatatgttggattacttgtacttgattgaccatagttttcttcctcaaataattggcactttcctgatccaaggtggaattccacatatatccatcattctccacgctgtgcgtcgatttttgtgcttgtaaaatcattaaagggtattttggtcctatatttatagcatatctttcccagtattcattattcagtcgaaagtgcctaatatttaaaaagcatacgagtattgtccttttccttctaccagcccaatttattgctatggtgaaacgtggtacaaattgagagggtgcatgatgattggatgatgacatcatttctgtgactctgcaatctgccatgcataatattttttagtgacagttctctcctgggctatgtttttttttatcttcttcatgaatactatgcatgaagaaccagaatgtactgcaaataaattcctggtagttccctcatgttgtaagttggaagtttgaagaagaggctctttcgtaatagaataccgatcgacgctagcgaggagagtggaatcacccgttggcctgaacggagagtggaatcacccgttggcctgaacttttcttctgcatggatcgacttagatggggtagtctaataacttggttcgcctgacggctgacgctgttcacagcacaatttatgtaaacagctgttgtactcaattcctcatgtttcatcactataattaattgattcatgtgattgtccagctttgttggtcatgcatatgagaagtccaagaaaatggccgctgctgctttagcatacaagtgtgtcgaagtagcctatctcaaggctgcatactataaataccctactgcaagcaaggatcgccagatgttgcaggcaattgtacagaatccaccaggtacttgaccttaaacactaaaatttaattacatacattagtctagcttgcattttagaatttcaaatacttttagtggtcataatgatattctttttttggaagtgtgagctcatcatactagtaatatgtgccgtgcccaaaaattcagaataccatatccaatcccctgcccttgctgatatttcactgttacattcatactttatataactgcatcttttccaggcatcatcatattgttactgtttcttctctggattgtgtttgttgctttgctatttacttctgtttattaccttcgtaggtgaatcaccatcatcttctgcctcagacattgataatttaaataacaatggattatctaagggcccttcaagcaaggatgctaattcgccccaagttaccgggaacaatttgttactagctgctcgcaatcaaccacacttgacaaggttactagcctatgtaagttcttcatacattgatatatataggcagttcaaaaagttctggtttcgagagtggtttatcttttatagtgtatcggatgagttcacaatctgttatctatgtaataacaaattaaactgttcactatgatggtattagcaaattgcacccaacaaatctagattggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttagacaaatgatgtcaactgtgccttcgatgcaactcggaaatcacagatggcaattgcttcggctgctagcaaccaagaaaatggaatagatggtctttcttcagtaaaaacagttttggattttaacttccaaagtgtgannnnnnnnnnnnnnnnnnnnnnnnnnnnnnnnnnnnnnnnnnnnnnnnnnnnnnnnnnnnnnnn

SEQ ID NO: 26430 - DNA, 7000 bp, Oryza sativa
  unsure (1)..(7000): unsure at all n locations
nnnnnnnnnnnnnnnnnnnnnnnnnnnnnnnnnnnnnnnnnnnnntagcctatgtgagttcttcatacattgatatatataggcagttcaaaaagttctggtttcgagagtggtttatcttttatagtgtatcggatgagttcacaatctgttatctatgtaataacaaattaaactgttcactatgatggtattagcaaattgcacccaacaaatctagattggatatcataaacgagcatattggatagattttggcaagtcataattaagtttggtttgaaggtgacttgtgaaatgtttgtcgggaagatcttttttctgtcttaagtactatacttgttttacatcctgttgtgatgttgctcatgaattctgctgcataaccttattgctacatattcaaatggcaatgccgttatgtggagtcatatggtgatgaaccaactcattccattccccaaaaccaaaaagggttaggtttgggattagaatctaatgaccctaaaaccctgaagtgaacacctcataacttgatagtacgttacttacagtgcgtcatgccatcgattacagttatgatctgatgactctgtttatattcttagacaaatgatgtcaactgtgccttcgatgcaactcggaaatcacagatggcaattgcttcggctgctagcaaccaagaaaatggaatagatggtctttcttcagtaaaaacagttttggattttaacttccaaagtgtgaatgatctactaaggctcgtgcggctttcaatggagtctatcagctgctgacatgttcagaatccaggaaaatgacatccctttacaaggtgctgttggatgtgcattccatatttgagtaatgtcccagacttgccagtagcatttggttgaaaagttcaactgtgcgaaattcataggtcttctcatttaagtgtgctggttaatttgtacatgaagtgtttgtcttatcttctattccggaggcctgtttttacccattgctagcatctagttggatggttttatccatgagggaggttgctgaagatgtgctttgcagattgcactgatcaacttgattttgggcaagactgcctagttacagactgcacttgataagcttatacacaatgctactggacagcagctcctttgtagataatcttctttcctccatgctgtaaatgatgtattttcgtcatggagttgacttatggttgaatagtatcatatgttcctttgagaagggcaaaatggtggtttccacttagcaattttgatggtacgtttcagttacaaataaattaagttcaacacactctccgcaccactaatgcttatgtaatgtttgattctttagcaggtcagaggacaaaagtgttaattagtgtgctaaccaagaaatcagccagtggtgtctctttttcagtgccacttctggataaagttcaagcaggtaccttcactgatactatagtaccttagtacattcaaaccttgcacctcatgatagtgcggaataaaatgacttcttgaatgaattggtctcatgctattctgcaaaggtgaaaatgacctcttcattgataccatcctaggttgtataggtaccctgtgacttttgcagtaaattagactatatgcttaagtgctgaaataagaacattgtaattccttggttcttctttctgtaatgctttctactctgtagggttatactataatttacatatgcatgcacagcaccaccactgtaaggttcttcgacccaaaactagaactgaaagttaggaacttccactatacagatggcagcacctgaactgaaaatacattgattaccattttccactccttactcctaacagtaatcagtgatgtttgtcttttctttttcagatttcaaacaagaaatcacttggaccatcacatgtgtatgaacaatgtacaaagattttcatgtacaataggctaactcgttccttgactatcagtacgacgactataaccagcgcgtgtacatgtatatatacccgaatggtcgaagcgtttgtcttgcgtgctggtacactcgtgacaccaatgtacttttagtccacatttttcttctggcaaattttgttagtttcacattagtcgttgagatgtgatagaacttatctggactgagaatgtgttgcagaatgcaaaataagctctgtattctgtactgtttgtatcgcgaatcgcatcttcagttcagttgagtaaagtgatgctaattttagttatgcaattatcctttgtttattctgcaaatgaatactgtggcggcaacgtaaatctgcatgtccacgaaatcatgctaaaaactactcacatggcattctatatttaaaaaatgtgcctgctcgatcgtatgctgcaatgcaaatgtgtgtgtgtgtgtgtgtgtgtttttttttttttggtgggggggggggggttacaatttcgatcagaaaaatcatcatatgctgcattgcaaacttgttaaatttggggttggtttcgatcagaaaaatcgtaaaaagacagttatgcaccacagttcggtttcgattaattttatactgatgtatcagatcaagatcatttccatttgcgaacaattcttcagaaatttcatctcccagcctaacacatcggccactgcgtatatctcttctgtacgcggatgcgtcgtgtcgtccgacgaaaacttgtgcaaatgcagtgcctcgccagcgccggcgtccacccagctgaacccgatctccttcttgacgcctctgtccctcatcttcctcctcaccttggcgacgccgtcccagtcgcccacgtcggcgtagatgttcgacaggaggacgtacgcgccggactccgtcggctccttctccgtcaaaattctggcgatcctctcgccgatctccgcgtcgccatggattctgcaggctccgagcaagctctgcagcgccgacacgctcggccccgccggcatccgcatcatgagctcctcagcctccgccagcctccctgcccggcctaacatgtcgacgacgcaggagtagtgctccggccacagctcgacgccgcgatcggcagccatcgagtcgaagatgtccctgccggcgtcgaccatcccgccgtaccggcaggccgtgaggacggcgaggagcacgacgccgtccggtgcgacgccggagcgcgccatgtcgccgaagaggctcatgacggcgccgtagctcccgtgcctggcgttcgccgagatgatcgccgtccaggcgatgaggctccgctgctccgtctcgtggaacgccttccgggactcttccaagttgccacgcttcgcgtacatgtcgatgagggcgccggcgacgtactcgctgtcgccgaagcccatgctgagagccctggagtggtacatctggccgtacgccatggacaccgtctccaccgcggtcaccgcgctgaggacgctcgcgaacgtggtctcgttgggtgtcaggcacctggccatggacgagaagagctcgagggcgtcgttgcaccggccgttctgcgcgtagcccgagatcacagcgttccacgcgatgatctcccggcgaggcatgaggtcgaacaccatcctcgcgtcgtccatgcgacgcgccttggcatacatggtgatgaggctgttcgacgccgccgcttcgccggacacggcggccttgaggcacgccgcgtggaccatctgcgctcccctcgccggacagtccgctggcagcgccgacatcagcgccacgaaggtgacctcgttcggcggcacgccgtctcgccgcatgccattgaacagcgtgagggcgtcctcgccgtccatggagatggccgtggtccatgacacgacgtcgcgctcgctcatggcgtcgaacagcctccgggcgctgccgggagcgccgcacttgtagtacatcgcgacgagcacgttgccgatggagacgtatccctcgacgcccagcttcaccgcaaagccatggacttgccggccgagctcgagcttcccctcgccgccacatgccgggatcacgctgcagaccgatatccggtcaggctggacgtcgccgtccctgagcatccggaggaacacgccaatcacctcggccgggcagtcgccgtcttgcgcgagcccgcagatcaacgcgttccatgagacgaggtccctcgccggcatatcgtcgaacacactcctggcctccccgagagaccctccacgtgagtacgcagtgacgagcgcgttgccgacgaacacatcagccgcgagcccggaccgccaagccagcgcgtgcagctgccgcacgaggaagccctccccccggccggcggccagcgagagcgcgacggtgcacgtgacggcgtcgggccgcacggcgccggagcggagcatccacgacgcgaagtcgagcgcctcggccgggtcagggaacgcggagaggatggtgttgtaggagctgacatccctcgcccgcgccgcggcgaacaccccgacggcggaagggaacgacccggtcttggcgtagcgggcggcgagggagttggtcacggcggcgaagccgtggaggccggtggttacggcgacggcgtggagcgccgggagggaggccgggtcggacgccctgacggcggccgagaaggcgatggggttgacgcggcggtggcgggcgagcgacgggtggggaattccgtcgaacgggtggtgggcggcagcggtggagagcgtgcggatccgcagccgccgtagtggcatctagtgtagtttttcaaccacggatttgagatcctctcactaaagtcacatgattttgagtcactgacatgtgggccctctttgttatggacccacatgccagagactctagtaggataaaagcccaagggccaaacccctcctcttcttcctccggtctctcgctcctcgcgcaaatctccggtcgctgcagcccttcggccatggcggcgtcgtccgtgctgcagcctgcggcggccgccgccgcgtggccgcgcttcctcccctctcctcgccggagcgccgcccaggtactaaggtttccttcacttcttaggcctgcaactcctgtttcgtggcgtggggcaggcaattcgtcgaatggcttgtggttgggaagaaatcaagaaattgcagcgcagcgacagtaaaattctagggtaattggctaaggtagtgaagatgctacattctcgggaacgaatcacctgaccgggctgaaatctgtgtagtgtagttcaaggcgtactgtaactttgtaggtgcagtttgtggtgaaaattttccatctcgtgtgttgtttgaaacatgaaactagctcagtcttagcttgaaacaacaacagaacttacttcttggtgtagaaacgttaggtgtgttgtgactactgactagtttcccataattctgtccccctttttggccttatccagttgcaatgtaatcttatcagatgtttctttcaggaagagttgcttgatacactaacagttcaacacaatatccttttgatgtttatgttccttgtatacaattactctgaatgagaaaccccccatttcatattataagatgctttgatttttttctaagttaaacttccataagttcaatcaagttaaagaaaaatatagcaactcttataacacgaaattaattctattaaatctaacatcgaatatattttgattatatgtttgcttgatgttaccatgtttctatgcttttctataaatttgatcaaatttaaagaagtttgatttagaaaaaaaaatcaagtgtcttgtaatatgaaaatggagggagtaacaccctattagcatccctacaacaaatcactgattcctgaactattttgtggttaaattaaaggcttctgaatagttcttatttatatccgaactctcagatgtgtcatttattcttggaacagacatatcaagttctttccatgcacaagtttgagtggaagcgccctttcagcggtaggtaccaacattcgctgcaatttacaacattcagtgacaggactggagttgtaaacttgtaattcaaactttggtttcacatcgttgccctgaagtgttgagataaattttgtgactgcatctgcaggttcacaccggtccggtattcttcttgtttgcagaagttcaggttcctctgtaaaagcagctacttcaagcagacccgaagctgtttcctcttctcataacgatcaatccagcaaacatttatttggttctgtttcagatgcttataccattatctctggctattggattggccctgatatggatgatggctgtggtaatgttgtggccattctccaaagaattgtatgatactgcatttgctgttaaaccacatgaattttctggcgtttgaagataatttttatatgctagatcatcctccacattaaagtatatccataaccttttccaaacaatgcctatttgcccggcgaaaaaaataatgcctatttctgatcgtattatttcttatatgaatcaatgtgccactgcaaatggtttaatcatgtgtcattattggtatgtttgcaaaatgtattgttagattctattccagttggcctaaaagtgcaggcaggcttgtttaaataagatctgagtgggatagaactagcagagtcttttgttacaagctacttgacacaaattcacagaatcacagtgatatttacatggtactattatgaaagataattaagaaacgacttgccaaagcaagtcttctcgtcaacttagcatatagactagtcactgaaagtgggcccactcaccttctatatagagcagtgtacacctggagctgagctcaagctatagctcangtgactgacaatggcgtacagggcctttgaggtgacgctcatcctcgcgaggaatctgaagaagtgaacttgatcacttccatgaggtgtacgccg

SEQ ID NO: 26431 - DNA, 17416 bp, Oryza sativa
  unsure (1)..(17416): unsure at all n locations
tggatcgaaaaatgtacgtagcagattcgtccacgtcatcattagtaaaaaaatttactacttatgaataaatctatgagtaaaatttttactcgtgatgacgtggtcgaatctcgaacgtctatttttcgatccaatagtagtttctaactttccaccatatatatggtttccactgtatatttttcctctttttactaatcagtagcacgttttcttttctttcttggaatatttatgcattactcgtcattcaacaaacatactctgcatgaaaattcatcgccgatttatttaggtcagtttggacgccttaggtggacaaacgagaatcgacagtcccttgttgatgccgttattccaaggagcgcttctgatagttgtgattttttttctactctacccattctaaaatataatatttttatgttatttagcaaataataaggttaggttaaaaaaattccttttcaagtcatttcatttgttaatgttttttatattttgaattggtcagactttctttctaattggcttcaaaaaaaatgatgagaatcatgagaataaatgcataaatgcttatattgtgatatactccatccatccaaaaatatattagtatctagcctttaaaattgatcttaaaatataacaacttctccatctgcattcttttctcagccaatcataatatttcaccattcaaatttcctacacactttccctcaaaaaaaaaatttcctacacacatccttttctcaaccaatcataacattctccaaatttaatttcatcaactttctaaatacccgtgttcaaccctaacaatctctaattttatgacagagatagtaaaatttgaatcctaaaaacacctatattttactccctccattttatattgtaagactttctaatattgcctatatttatatagatgttaatgaatctagatacatacatatacatatgaaaaggaggaagtagaacggaaggagtagttgttatagtgtaagttgttgcaagataattttgtatactcatgttgtctagtttttttcctctaattttttttggggtacatgtatttttttagttgatgcaaagggtggggaatttttattcgaccattaatgaaatatttcattgtctaaaacaattcaacagatatctcaagatttcaaacgtattttgaagttgtttgattcacgtatatccaccggtgtcaatgaggtttaagtaaggcttgagcaggctccagtgccactgagtaattaactgaccaaaaccaatcaggacacagaaatcaacctgctaaaccacatcagaaaaaataacaaattgaaggagacagcagaaacaacatgcatatgttcttgcccgctcagattatttcctctggatatagatgaatcaattctgtccatcttgcatgagactatgtacagtcatacagattatatctgaagaacttgctaataataccgcatcaacattattcacgatcgagcatacgcaccccggcactaatctgccgaagaccggtcaggattcggtggttaccaatctgtctcgatcggtttggcattattcccagtgcagtgttaccttgagcatctatatcattctcatgtaattaactggattcaataaaacttccttcatcttaaaaaacctggggaatcttcagttttgcatcattcatgatgtcatgatgatgatgactcaattggaagtttggaaaaagttttaagataaacacagtaattcttcctgattcttttacggttactctctagactccagtggatttattctcaggagatatttatatctctcatcattcaagaaaagatatttctgacgagaacatcttcagttaaaacaaaaagaaaagcagttacactttcactacttcctatagcacattcgagcagtaaagccggttaaggaaaacaactccaagttaaaagaaggaaaagcagttagactttcacttgctacagcacattcaaaggctgagtagtaaaaaagccaaaaactcgcatcttcagcaacacgcgaaagaagaataaaccatttaaaaactcgaaaaattgagccagacaaagatatggtatcgatcctctgctatgataatcatcgaaaattatggacacgcagcactagaaaggccagtcctgcaagaactatatcctcaagctatcatctatccagcatcagatgcctcctgatctatcctaccattatattcaaacttatttgataaaaaatctaactgcaggaaacctccccaatcagggagagtgatgataatatgtaggctgctcgattattctccattgaatatttgaatggctcaacaatccggaggtgttgctttgtggatcttttaggaaaaagttattccgatctctacactaattagaaatacacatgttgtttaattatagacattagaattcaaacctagtaaactctgcttcactaatagtgcgcttttatgtacttaaaatggtccgttgaattatagatattagaatctaaacctggtaaactccgctacactaatagtgtgctatgtacttaaaaaggtccgattggtggctaataagctcgcaccaataagttattactcaaattacgtagttacatgtatttctaatataactagtagtactagcaaatatgatacattatcactcactagtaattactattatagagcatcttaaatctcatctcatataaatatgatacgcataattatatcaaatcatcatcccgttcacatcatttacacagtatctcaacatatatccatctattatttcaataatatttgtcataaattgatccatacatatcatagtaaagcgtgggtatcatctaattacattaggttgaacattcatatttccaacgatactcacttggaacatgtttgaggatgattctagttgttataccgtcttttaaaatcttcaatcaccctaaacagtttagattctcccgtagatatcaaattctataaatatgtaactgtacaatctagaaaataagctagtaaaaaccaaaagataagaaaccctctttctatattctcgttagctgattaccgataaattgcttctcaatatttttgactccttaagacatttctaacccaatgactaagatagtattcatagtattaaataagcagccacctaaaatgaaaaatgatgtgacaagtgaataaatgaggaaagagaagaaaaccatgtcttacatgagacagagtttctacacaacatccaagacatcatgtgatataatttgcattaaatttgagtatggaatagtggtatttgcattgaaagagtagtgtctagtattagtttcttgatgatgtgaagtttatgaaaactgtgtctagtgtcatgggttaggaatggccttataacaagtttctagttcctgctttaaccaccaactttctgccaaactttggtactttaggtagttttggaatattacaagtgggtcccactccacctcttatacatacacctgcatgctgaagctgtgaagcataccatcactccactccatcacctcctgcttgagcaagcaagcaagcaatcgctgcagccaactgttcgaccagagcgagttagccatggcgtacagagttcttgaggtgaccctccactcggcgagggacctgaagaacgtcaacttcatctcgcgcatggaggtgtacgcggtggcgaccatctccggcgacccgctgacgcggcagtgcacgccgccggacccctacggcggccgccacccggcctggaacgccacgctccgcttcaccgtcccgcctaccgccgcctccgccgccggctgcctccacgtcctcctccgcgccgagcgctccctcggcgaccgcgacatcggcgaggtcatcatcccgctcgccgacgtcctctccggcccctacgacctcggcgcccgcccgccgcagttcgcctcctaccaggtccgcaagcctcccccatcgctccgagacccgcggcgtgctccacctctcctaccgcctcggccccgtcgtcgcgccgcagtccgtcttcgcctacccggcgccgccgccgccgccgccgcagctgttcgagaccgctcctccctcgccgccttacgttcccccaccaccggacgcctaccttcgtaaaccgtcgccgccgtctccaccacccgccaagctgtcgccgccgccaccgccacagacacagacacagccgctggcaaagccgccggcgccggcgacgccgtcgcgagctggcgggcacgtgccggcgctggcgccacctgcggtggcgaaggccgacaggcacgtgtcgacgccgtcaccggcgaaggccgactggcagatggtgggcacgccgacggcgacgaaaggggcgagcaagcatggcagcctggagttcgagcgggggctcaacgccgggctggtcggcggcgccatcggcgggatgctggtcggcaccgagatggtgtccgacgcggcgttctaccacgccggctacagggccgggctcgccgaccgcgacggatgggccgtctactaaaccgtcgtcgccatggctgcaggtgcagcgccatgcatggtcggtcggcgaagatgcttagctgaataaaagtctctggttttctttttttggccttttgagattagctcaataaaagtcgatgaaatttactttggctgagagtttgtaactcttcctcttcggctagtgaattaatcgacttgttgtatatattttgttactggttatgatgtaatatatggccacgaaaatccaagaacatgacatgctcattagaatggcttttgagaaattaaaaaaaagttcgaagaaaatctttgaaaaggagtcgggagttcctgcttttttattatggaagaaagaaaagaggtaacccaatttgttaagaaaaatcggaccctaaaactttatcattgtacgattaacttaagaaaaaccggcaagaatctcaatgaagaaaataacaggactactcaaagacggcataccactataacctagcacccttaggactaaagtaccgatataagtcatcgttgtcaagcttaaagtataggagtacaagcaactccgacttcctattacaaacaaaagccaacgatcacctaatgtagggagcgtgcctaaactctaggaccatgaaagaaaaaccgcaacgacgcatctaagaaggaaaatttatggtgccggtgacatcgcctctaaggaagaaaggagggaaatataaggtgccaatagacgtcgatgtcaaaggctttcatccaatattctccctgccaactacaccattcacaagtgcctcctctatatcaggaggagttaaatgttatcattaccaagctcatcaacccacccccatccatggtcatgacctagtctcgttggatttgtgcaccgctcccgactggctttctacaacattatcgctgccaccaacccgagcaccaagagtcacttagagccagggaggggagagtcgaggcctttgccgtcgccttccttgcaaccacagtggtttccggcactctgctccggcggtggtgagaccccgggcggcaaaatttaaatttgaaacagtaaattcgataaattcgatcaaaatcggttcaaatttcctggctcccaaccccgatatctcactcccccgccgtcgttgtgaaccctgctctgctgttcatcagttgtagacaaattcggactctgttccaaaatcccagtcgatcagttaatccgagacagttcagtatagtgccagcaaaatcagctaaactccgtataatagcaatcggaaacagcaaagcaagcaagcaagcccgaaatcgacatgcttaccaacacgagttcgagtccacttccatgcacgaagctatatatacatacatggatgcatcgagcttttgttgccaaaacaacggaactttccatcgacgatcttgctgagaattgctagctcgatcagctccgatcgagatcatgatgacggcaactactccccccgccgtcgccgtcgccggcgagagcccgccgccgctcgtgcacctcgcatttaacctctactccaccggcttcatcgccgcgacggccaccggcttgcgcgtcttctcctgcttcagctcgccgctcaacaaggtgttcgccagggacgtcgaggtgtgcccggaggacgacggcggctgcggtggcggcggatggaaggtggcgatcgccgagatgttcaacgaggcgttcgccgccgtcgtgttccggcgggagaagggcggtggcggcggcaccgtcgacaagatctgcttctggagcatcccgaacgggcggatgtactgcatgcacaagacgctgccgttcgacggcgccgtgcgcggggtccggctggtgggggagttcctgctcgtcgccggcgacgagagggcggcgctgtacgagctgccgcacgccagcgcgccgccgaagaaggtgaaggtggtggagacggcggcgaacccgctggggctgggcgcggtggtgcagcccgacgggaacgcgcggttcgtggccgccgcgccgcagaggatgaaggggatggtgcaggtgcaccgcctcgccgaggaccacgtctacgtgcgcgcgcactactcctccctcgccgccatcgcgctctccgccgacggccgcctgctcgccaccgccggctccaagggcacgctcgtccgcatcttcagcaccagcgacggcaagctcctccaagcggtatgtgcatatatatggccctgtgctctgcttcgttttcaactttggaatatactcccccgttccagatcattagtccttccttttttattttggtcatagttaaactgctttaaatttataaaaaaataataatatttttaacctaaaataaatatattataaaattatatttaattatatatttaataaaataaatttggtgttgtaaatattgctatatttatttatttattataaatttgattaaatttgaagtagtttgattttaatcaaagtcgaaacgactaataatatggaatagtgggaatatatcgtatatctttatttttttccccttagattgtttattttttcaagtttcatattacagtattgaaatatggtttgcgaataactttacaagaccgttttgtcctttatttttgttagttttttaagtatgtgaaattaatatggcgtttgcgaatatgaaaactttttgggttaaatttgctttagttaactgatatttagttttaatgagtatacttactaaatatgccttgtttgcgaatattttggtttagttttcgctagttagttgatcggtatgaaaatgggatactaacgatctctgtgatcgttacatttaataaccaatataaaatcttaaccggccacccacaactaactaaatacaaacaaccacgcgcggcggcggcgcacgtcgctctgctatggcgtcccaaaacccaggcgacggcggcgacgagcaatcgccaccgccggctcctccgtttccggcgcgccccacctacctatccttcagccacgacgcttcttgcttgatcgccgccgacgaagcctccgtccaatggcgctgctgcgagaccttcaagctgcgcgggctctacgaggagagcggggccaccgccgccgccggtgacatgcgcgaccggaatcagtcgacgtgcgccgtcgtccgccgcgccggcgcggggtttgaggtcaggcgtttcaggccgggctccctcaactacagctcgcgctacgacagcgtgcggatcggcggcggcgacgacgacgacgacgtgcggtcggtgcacgtccacggcgaccggaccgtcgtcgtgcacgccggccgcgtggacgtgttcggcctcgacgacgggaggaggaaggcggcggtgctgcagcggcgggtggagaccggggacaaccgggccggcgcctgcgccgtgtcgagggggccgcccggctcgccgttcgcgttcgcgtgccccggcgtgaacgacggcaacctgcgcgtcgagcggtgggtcggggggttcacgccgctggtcatcggcgcgcaccgctggcgtgtcgcgagcgtcgccatgtcgtggggtgctaagctcgtcgccacggccagtgtcaagggcaccattgtgcgtgtgtttcgcgtcgccgacggcgaattgctccaggaggtgagattggcggcggcgccggcggctgaagcaactgctaaaaaatctaaaccccacaacactgaaacaaaatctctaaccaaatttagagcatgcgtaaaatatttttcaatattgtttttatgaattttaggttttttatttattacatttggtttattgttttgtattatatgcgcaatatcgtttaatttagctatattaggattgcatttttttatgatacggaggggtatgttactgtgtttaatgtaaacacctctttgtttagtccatttcttgtattactatactataattttttacattttattgttcaccaagtttttcttattgtttatatattacatgcacaatatcattttatttggtaacaaatatcataatgttaaaagatgcttttcatccatttctagatgaaaagaggcttcgatagagctgatatctacagtattgtcttctcccccgattcagagtggcttgctgtctcgagtgataaaggaaccgtacatgtttttcatatcaatgtttgttcgccatcttcctccaaaactggttgccaagatacaactcaatcatatgaatcatatggtgcaaaagcaatgaaaaaatatgtttcttctataaaaggtaattttaattttgaaacttgtttgttagctttacttatcgtaaaaggtaaattgtattttgaaatttttgtgtattattttatttctgactcattgatgattttaatatgctttcagatttacttacattaggatatttcgatccagaaaggtcggtagctcaattccatctatgtgataatgtaaaataccttgtcgcatttggtacaagaccaaataaaaatattgttcttataatcggtatggatggaaggtgagttaaattatgataatattttctcaactttttctttcttagtttagatgaaaaaaaatctgacctctaatgtttgtgcagtttttaccggtgtcagtttgatccagtaaacggtggagaaatgaaacagcttgagtacacgaattttttaaatatgtagggatgatgatctgttcaaaatcagaatatgtattgatattatcatagttgacagagaagttatcatttttttcacttgtcttatttcgatttgtagttaaaagatatttttgccttcatagatttgatttatttgtgtatatagtgtcatcgtattattctctttatagtgtagtgacacgataatatacaataatacttagcacacttgaatcaaacttaattctcttaaactgattgatttaattttagtatatataagttctatttaagttaaaaaaatgatattttgagaatagaagaatactgggataactatgaaacatgtaacatgtagcttgaactatgatgttcttattattaccactctcttcctcgggcttgtttgtttggatattattagtgtatggcgtcgtgatagcgggctattaaaacgttgacacatgtcaaatctagctccgaaagacaagcaaacagtcgattcgcgacggttgccgagaaagcgacgatctatcaagcgcaacgccacgcctatcaatcctaaatggctacgaaacacaaatatcccctttgatgtgtgcttgtgtacgtatatgtatgcacaataatgttaaacgtgaaaaacgtaaataaatgtttgtgttgtactatgtatcttcctaacaaccagtcgagtgcaagtgtgcaacaaccaaggggtcattattactgtagattaataataaccgttcctataacaagattcgacacgaaagtgttcctctaaaaaaatcgacacgaaagagatctataataaccaaaaaaaaatagtaatattaattggcgcccgcctcctaattttgctggtaaaaaaaatataaaaatgtttttttcgattacatggcagacgcagatgcgtgcgcaccattatgcacgtgacaccacactcggatcctaccgattaaatatgtggttttatgatactccatcttaaatatgtagttctgggataaatttagtggttaatttgtagttttatgaaacatcaccttaaatctatagttttgtgataatttagctaaaatattatgaaatttaatcaaaactttaacacggccaatcaaataactaaaaattttgttcatcaacaacaataagcatgtgctcttaaaaatataggcgtaccaatagatacactgattttctggtaggataaaagggatgggagatgattttctggtaggataaaagggatgggagattgagatataggaaaatggatgaagggttaagatgtactacaccgaggttagaagaatgagtaagattaaaagataccctttagccttgggatttggaatattttaatcctatagataaaattcctagaaaacctggagaatttcaatactacaggagaaattcataaggtctttgaacaaacatttgaattaaatcatttcctttataagtattcctataaaatagataattccatatagattacggagaaaaaaatatctcatgtttttttttcttcctgcaaactttaaatcatttttttgaacattcaatatattgaacattaaaagcacaaaacgtgcactggagatacatgattgtttttccaaagagcagcttgtaagagttgctttgtaggataagtattgtcattacaagtatgactaatattttgataattcagcacttcagattcaactttaaatcgttgcgttcctcatttgtgtcaagtagaagtttcctttctttttttttaatttcgttaggaattcaataagcatgttattccatttctatattttcttctattttatgttttttacatgcgttttacagggttgcttagtgggtgggatgttaacgattccgatatggcactaccgttccgaaacttggcggtacgacgtatttcacgtaatccggtggaaaaccaatatattcctaacaaatttcgtgaactaaaatttaaacacaaatccctaaacttactgatacattaaaaaatcgatcagcttcaacgaaatttcggttgaatccatcgaaatcagatcgaaatagacagactctgatcgactgccattatccaaacaaagtctgatctagggctgtcaacgagccgagcttgagtgagctcgtctgcctaagctcgagctcgacacaagctcgagccgagctcgagcctattccacattcgagcttttaggcaagctcggttcgagctcgttcgagctcgagctcggctaccgagctcggtcataagtagtataatatatattttaatgataatcttttgataagtataattattttctagttaatcacactaataaaagagtagaaaatgattaaaataaatatattatgctaacacatgctaatttattgtgtaaatagatactaatatatatatttacctattagtttattatattaataaggtgagctcgagctcgtcttgttaaagctcgcgagctttgctcaggctcgggttcggctcgtttgaagctcgagccgagctcgaatcaagcctagaacgagcccaagctcgagctgctcgcaagccgcgagctttttttttgacagccgatcgattgccatgccatcccacccaccgttcgttggtttgatgatgatccaacggccaccaattaaaaaccttgtagccaaaaaagaaaaaaaattataaaaaccaagaggtcgcgcacccaaagccctagtcctcctccatccccaaactccgccgccgccgccgtcaccgccgctcgccaccgccgcggccgccatgagggcgctcgacgagaaggagacgaagatggtgttcgagaagctgttcaagttcacggggccgaacctgaagcacctcctggagcggccggcggtggaggggcccgacccgcaggccgggcgctactgcctccgcctccacaagaaccgcgtctactacgcctccgaggcgctcgtncgccgcgccaccgccgtcgcccgcccgcgcctcgccggggtcggcacgcccatcggcaagttcacccacggcggcgcgttccacctcaccgtccacgccctcgacctccttgccgcccacgcccgccgccgcgtttggctcaagcccgacaccgagcgctccttcctattcggcaactccgtgcccaagtcctccctcgcccgcatcacagagaacaccaaggccaacgacggcgtcgtcgtcatgtccatggccgacgtcccgctcggcttcggcatcgccgccaggtcggcgcaggactgcaggaaggccgacaccaacgccgtcgttgtgctgcaccagtctgacgcaggcgagtacctccgccgggaggaggagctcatgtgaggtgagggctgaggcttcattttactcttgtgggctgattgtatcgtaggacttagctaaccttacatattatgccttcttttgtgtgcaacaattttgtcatttgcttagcatgcgcctaattggttgagatgagaggattgtagatgccaagtttattcaattgcaatgctaattggttgctaaatgaggggtgcttgccccagaatttgtgaaatcaatcttgccaaattccgaggtcgaatcgatgttttgatttcagagttagctaaatgagggagtgtttggaccagactatgtgctaaattgtgtgaaatcaagcatgctgaattctgatatcgaactgatgtttcattggatacttcatcgttttgactgtattttgtgtattagtattgattacatttgtcgataaaccttgtgagttacagctgagttgcattgcacagacattgtcttgaatttggtaatccaaagatcatccttatgcggttatgtctgtctttgtaatgtgttcacctgccttcattgataacttggaacaggaaggattcactctcctcctgtagcatgcattcttcagattagatatatgaagtgggttagaaagacatgttttcagttttccatataggacattgggtgagcttggctgtaggcagcctttgggcgatactgtttctgttatatacctctttttttgttcatccatagtggatcgatgtagaagttagactgatcatgtctaatctatgttcaacatgattggttggatcactattttcttggttcagaatgaatcaaaaggtttcttttttactattcagtgctgatacgagctgtgcatagcattggagtccctacaggcctacactgggattgtgattgtaggtttatggtttgaatatttttttgggtccacgattttattttagttgtagcatgtgcagactatttggttggcctgaattgctgtaactacataaaacagttgtcacccaccatgatactctgcttcttttgttcccaatagccaccaaaaaaaaaaagaaagatatggtggtacaaccaaacgaccctatgacctgactgtgcagtaaactattctttgacgccacataacttctttgcttgattacatggtctgtagaacagtttttcgtacaagaatgaagacacttgtagccatgtacattcggcttaaaagcgattccgattgtgaatgcaattctgattttccagctatccttcttgcaggtgttgaggtttgacacattggcgtgactgcaggactgaaggatgcgcttcctcttcatgcgataattcgaagtttttctaccaccagtaaatgtgcgatttttacctagttttaagatagtggaggtctgttgtatcatctatctagtagaaaaattttgttcccaggctgttctatgggcctaaaagtgttctgttaagctgtaacttatcggtaagctactgcatgactgaatgctgcaggcctgcagtaacatttgatcgtgatcaatgatatacttgtcttatggaccctacggataaaccctgtctgtccaatcttcatcagtttacgttaaaacctctggatttgtacgcattttggctttgataagcagataaaacttacaaataagatatgtatttcctttataggaataatgtgcattgaaagagagacacaatgactgaagggtaaatactgatcgatcagccacagaaaaaaaaaatcagaacgtcacttggcgacacaatcgtaagttcgtaacgcagcgtccgggcggttgaaacttgagaggcaaaagggaaactggagttgcgatgtcataaaccgagtgaaaatcgtcgtcttcttgttcactgcaagcacaatgttcagagtgcacacatacaccatgaaaagaacggcctccccatctcttgttcacatcttcaatatgctcctctgcagaggccagtatgcaagggattggaagctaacgagaaaatttaacaggtaatgtcaaggatacgatcatatcttgctaaaagaccggaaaattttgacaggacatacatactttatgtagtagtataaaattgcacattcctgagaggtttcagcactgatgtacgggtagtggtgtataagtgggtaagccacgaacccactttagattaaaataatcaattcgtgatttattttcgtttataaatgggtttcacgggttagccttagccccttgcaccctgcctacgggtgttaaattaattttcagtctaacatgtaacagcgatgaggctggccgccagcggcgtcggaggacacgacgacaagcacgggaggcaatacagcgaagatatctcgaatcctagccgcacgtttttaatcctccgctctaatcctagccgcacgtttttaatccaacgggagagggtttgcgcgttcgtggtcttcaatatcatgggacatttaattatttgccagttttaagatgtgccaattaatgatttgccacttgctgtttatgacatgtggaccctcacgtgacaaatcatttaaaaccactcataagagtgacaaatagttaattattcccaatattggagtacggtgggggtcggagttttataagcccatgaagcggcccaatatctgagcccaataaccttgaaaccggcgtcctcaggttatccttgcacggaagagaagtctgatgagccaattaaaaaaaaaatcagaacatgagtcattcacaaaggaacactacccaaaaaaggaaaagaaaagaaaagaaaagaaagaggattgagacattcagtatttcagtgctagcatgttgtaatgcagagtccaacagagagttatttttgctgcttttttattggcaggaaagaaattaaacttaatggcgatttcgcttctcagaacagaagaaggcatgacatgcaaatgcaaagactagaggataaccaaacaacatggatgcattcaaggcgctaatatagaggagaatctgggggccttgggggttcggagttttattttccgacctccttcataaacagttgcatcttgctgcaagaaattcagataagtcattgatgacgtataccatgcattattaaatttcatataatcatgtctgagaggtttcagtagtgaactagcgatggatgtcaaatgctgagtctcccgtgcaacagagatgttggctttgccttcgccggtgtttcagtccctttgctgatcagccatagaaaaagttcagaacatgaactcattcacttggttctacgaggatgaattcagacattcagtgcgtataccgtgccgtaaactcgtaatgcggcgttgcggtgcccaacttagaactgattttgctatatctgaagtctgcacatctcacacatagaaaaaaggggggaaaaaatctgtggacgagggggttctgggttttgttctccgacccctgtaaattgtaagacagccaactaaactcgcagtaatctgcttatgttgtgttcgtatgtctactctctcagattttttttggtgtctgctttcatttccttgcaccgaagactgatcagcaactgaaaaacaaaacaagttgagaatgtgatttggttctacttgtatcagaggggaacaaggggaaagaaacaatcaccgttgctccactcttacgtcaaaaaaaaaaaccgttgctccactcgaatgtgacgattgatcatcatgcaactgatgcctcgcttttcagaagaaggcaccacatgcaaagaagctctgaatctctctgaacctgtgaatggggttcggagttttattctccgaaccccctaaacaaatcgttggattaaaacgtgcggcgccaaatccttctccgtcgccggcggtgccaatctcacctctactcctgaaatactgaaggtggccactctccctgatttttattttgttgctgtttgttctcagtttcatgcgcagaagactgataaccaactaaaaaaattacggtgactttgtcaatctcaaggacttgccgattcagttttcgaagatgctcataggggtaggatttatgtgcgtgcgttcataggggtaagtgtgcgtgtgttataagtgtctgtattatactgtataattctaaaaagaaaaaaaaaatcagaacatgacctggtaattctatcataacttcgctgataattaatcaactgctcgaacttcgctgttcagaagaaggcatgagtgcatgacatcaacttcgctgttcagaacttctatcagtgatcggtaggaggggttggggtttgcttctcccaccccgagcacggatagtctttaagggcctgttcagattgtagttaaaataaactttatgctaaaattttggcaagtgacaggatttcttatatatttatcaaatttggcaacaaactaaatgtagatatttttttacaactttattaaaaaaaagtatggatgaaaataacatcaatctgaacagcctctaagattctgaatgagagttttttttcttcggcccctagtttcctttagaatatgcattgaaagccacttggaaagaaagatgcattattattacacaaaaatagaacaaaaaataatgcgtatccggggaatcgaaccaaccaacccctagtttcctttagaatatgcattcaaaggcacttgcaaaaaaaaagatgcattattattacactaaaatatgcattgaaagccacttgcaaaaaaaaagagatat

SEQ ID NO: 26432 - DNA, 437 bp, Oryza sativa
  unsure (1)..(437): unsure at all n locations
agtgactgatagtaagctatttattataactcatctagccagatatatccgactcggattagtagtttatgtccagtcggccggagttctttttggaatcggatttatcgttccaacgctgcttgctgaaatagtccgaatcgccgctagcttgtgatcctatccgacacatgcacatacgtacgtacgtacgcgtgaggcgcaacaaaatccatcctgtacatcgcaataacatgcatttcgtgcggtcgttgtgtcgcttctaactaccgggcaaatataatactccctccgtaatttttttataaatttgacaattcatcttatttaaaaaaatatataattattatttgttttattgtggcttgatgtatcatnnnnnnnnnnnnnnnnnnnnnnnnnnnnnnnnnnnnnnnnnnnnnnnnnnnnnnnnnnnn

SEQ ID NO: 26433 - DNA, 883 bp, Oryza sativa
  unsure (1)..(883): unsure at all n locations
nnnnnnnnnnnnnnnnnnnnnnnnnnnnnnnnnnnnnnnnnnnnnnnnnnnnnnnnnnnnntaattttgggatgaatttatcaggacgtgacaaatccaccccccttacaagaatctcgtccccgagattcgaggaggctagcaagaagataggttgggcggtcttctcttcttgtctgacttcttccgtcgcgtcttctataacgaacttgcctagcaaaacttctccactctggactgcttggctcgatctcctgttatagatggaatcgtctcttcacctgacttttccctggttgcacctctagctgacttcgactgggctgcggcattggaagatggggcttcagttccagaacttcttataactcatatctttggagtcaacctcatacaggttaccacttcatgttatgcgtcaacactagcttgtcattactaggataccatgtttgtcatcataagaatatcatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtcttcccaaatggctttactgctggacttcttattgtctgatcgttatcctgtcaaatctgaagcttcgtttgtagatgtgattttaatctgacctctatagactatcttcgaacatatcacttggttcataactgggaatagctctcatgaacaagcaactccgattcactttctttatgttcagtttactttccactattctcttcatgttgtcatcatttagcattcaaagtattcctttacacatt

SEQ ID NO: 26434 - DNA, 626 bp, Oryza sativa
tccttgctaacattggcatcagtggtgccattattgctatcaccattggagtctttctcagagtcaaaattgctagggttgtcattctgggtgccttcattgatactatcgtcgatatcttggtgaatgatgttgacattgcacgcttgatctaagtggtcatgaatggggcaagaaccatggttgttggtggtatcatcatcattagtattgctagtgttgttgtctgcgttgtgtccgtcttcttggggtagtaactcttgatgcacaacagaagatccggtgatctgaagtggctcagtgcgctgtctttggttaccacatggaaatactgggatgttgacaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgtgcctcccgatagaactcgtgcaggtactctgtaaaggtcaaatctccttgcttcaggtagcgaaactctcgttttcttagtgtgatcattcctgcggg

SEQ ID NO: 26435 - DNA, 734 bp, Oryza sativa
  unsure (1)..(734): unsure at all n locations
nnnnnnnnnnnnnnnnnnnnnnnnnnnnnnnnnnnnnnnnnnnnnnnnnnnnnnnnnagaacattattttaaaacattgaatgtttacagtcaaaactaatttaagcacctctgtaggctggtgataaggagatcttgagctaacatttgccgccttaggtggacttctagtttggggcagcggagaacgctggtaagtaggcaagaatgaaccatacccaccaaacttcgatcctgtcatggtttaatcccctgttttaatgtctctctatagtgtaccaaagtgaaaatgactacgtcagcaactcatatctgctcacctagattttctgcagatacagctccttcaaagtccttctgaaaatggccaagtacatcttggattttttcatcctgagggaaaaaagcacatcaagaacaaaaaaggaaccattcaacagatttgattgttggcacaatacaatatatcgtcttcaagtgaaagttgctggtgtctatcgcattcatgttgcaagttatccataaaaggcaacctacctataggcaagttttgataattaaacacttcgctatttctgccttttcaatttgtttccctttccgtttcttctggtccaaaggatttcagatataaagcatgcattggaaattttgagtttaaaattccgtttcattactataaagtaactgttgacagtaacctcaaaacataagcgtatttaattaattcactg

SEQ ID NO: 26436 - DNA, 655 bp, Oryza sativa
cacaccaagagaatttattagcaaaccatccaggtgaaaaagcatgcgttgaataattgaaaaaaaaaagaaagacgaagctaatctaatgtacatgccaggcataccagagatagcaggtgtgaaaacaccatcacctatcaccatgcatgcgccaaacagaacaaaaagtagtaaacaagtccgtagcttcctgtgcttctccaggaatcttttgagtggagaggaaataatgccaccaactccaggctgatagtacgttgaaagctcttcgtctgccgattgctggtttggaagcaggctgaactttgcatgcctgcagagaagtgagtataaagcaaatgttccacctacataaacaaaaattataatcaatcaaaaaacatgataaagatgactcttaaactaactagacagaacaatgcataaattcgttaaagaatggagtagcatatttattgacgatgacatatgtgagttgttacagaatatgatcctctatatactcctgatcggcttaggcagatgtgcacgatcaaaactcaagcacttttgggagttgaagaacataagttaaaatacaacgtatgtgtttctgttaaatttctgataacccagcatatagtactatgaagttactcaccttccccattat

SEQ ID NO: 26437 - DNA, 694 bp, Oryza sativa
  unsure (1)..(694): unsure at all n locations
nnnnnnnnnnnnnnnnnnnnnnnnnnnnnnnnnnnnnnnnnnnnnnnnnnnnnnnnnnnnnnnnnttttcaccgcctaggtagtgggtgaccttcaagtggtaaaagccaaatcaagaattgacttatggaaaacctatcacaatgttcagagttcaaagataacccacctctaaagctttcttaacttgagcagcaccataagcatacactttaacctctgggctgcagtaccaatgaaggcttctattagcttcagaacatactccaaatttacatgcaaaatgcagcaaaactgatctacctagtagcagcaccgtgcatgtagcgcgggtgcatgaaaagctgtgcagtcccccacagtggttttatattggtctcctcctgcatgaagttcagatcatatctgagcaaagagcagaaccaatgcatttcgacaaaatgctaacaattttaatgggtttgcagaaatgtaacctggagtttctttgccagttcaactatctcatccaaatttttatttgtttcctgcaatgtgaaacaagaagcttataaaataccagacctttcacctgtggccaaagcctcattacacaaaaacccaaaaattcccaaaatttaacaaaaatattccacaagagttaaacacatctttcaaaggtaattagacccaattaaatttccaaaatttaaca

SEQ ID NO: 26438 - DNA, 745 bp, Oryza sativa
  unsure (1)..(745): unsure at all n locations
attccgaatttctattgtttctccattgtatttctatatggactctagtctcctcttctaatatttcctatttttttaattccgaattttacctatttctaaattgtatttctatgtgggctatgtttttatttttctccgattaatatgggaatttctaggccgtgagtgcgaacgtggagatttctttttctattcctttaataagttaatagagtaaccatctaattaaatattctactgtacctctcactaattactagtactagtattcttcttgattatgcaacacaactcttactctaattaacgtattgctttttccgaaaatttcagcatactgcggagctcaatctcgctgcgccaaacgaaacatctacagaaacagtccacagggtacgtaacgctcctactctagaattttttttttgttttgttgctacttccaccatttcttaatagattacattgttaacttttaaacataagaattaccatccattcaaaacaattatgtagatataaaaagtatatataaattatgtttaaattccctttaatcatgaaacaaattacaacaaaataattgataattatcttttttaaaagaataataaaatacatctaaaagtcaacgactttaattatatcttaaaatgatcgcaaaagcaggattaatatagnnnnnnnnnnnnnnnnnnnnnnnnnnnnnnnnnnnnnnnnnnnnnnnnnnnnnnnnnnnnnn

SEQ ID NO: 26439 - DNA, 843 bp, Oryza sativa
  unsure (1)..(843): unsure at all n locations
aaaagtaaggcctgtttgatttctagacacagctgcccttttggccagaataaaatctaagagatgctcaccaaggcacagacacatacaaaggattcagcatactgtctaaattatctaaatgtgttgcagatgcatacaaggccaagctttggacatatgaagtaacctttcaaatcataaatcaagttcataaaaattgcaatggtggataagaggaattagtgtctaaaaagtttgtgacatagcagtaagactcagttagaagatgaataaataaataaataaataacaagcaatttaaagtttctggtgatgtactaatgtggatatgaaaatcatcagaaaaaaagtttcaggtaatgtggatagaaaatcattggtacaattccaaatagaataatccatgtaacaaattgcacaagcaacagtaatagcatgtacatgatgcattacaaagaatgaatcacctttttcgacgttatgaagaaggtcctctttgcaaggtacatacagaaatggaaggacctagatacagaaaagaaaaacaactagttggaacaactaaggatgaatggaatagtctgaataactttctggggaaaagcaagatgagaaaatcaagttcaaaaggtaaatatctggtattcattcaacaacacaaattcgaaatatgatagagctaatcatcgtgtgtatatccaaactcaaaagaaaaaatgattgcacacagtattaaatattgcatataatacaagcaaacatcaaatatatggagtagagaagnnnnnnnnnnnnnnnnnnnnnnnnnnnnnnnnnnnnnnnnnnnnnnnnnnnnnnnnn

SEQ ID NO: 26440 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnnaagaaaaataaaaacagagagtaagtgcaatgccacaggagttaactttgaaggtaacaaggttatgaatgaaagaacacctgttgtcggcaggagcataggaaaggtttctagtaaagaaacattacttaatgatattaatgaagaaaatgtctccaagagtgagtccagaagaagtcagaaagagcaaaacatgaatgcttcatcatcttctgatttcctggaagatgacaggggtgtcctttcttctggtgcagttaaggagaggaaaaatgattcgcaatccaaatctatccatccaggaaggaaacccaaagcaaaatcacatatagatgttagggagcacttacctgaaggatcttatggaggcaaggatgatacattggagaatggaagtgggctgggagagtacggccaaaaaaaatttggaagaatgatagtgagagggattctgatatgcctgggacatcaaaaagggaaatttcatctagtttgaagaatgataggcacacacctgctgaggagcaaaggatgcatgtacctacatctgttagtgcacctactgcaaatgcagctcctatgctttctgcccccgtcgtgatagaggaaaaatgggtatgctgagacatatgccagaaatggcgtctc

SEQ ID NO: 26441 - DNA, 705 bp, Oryza sativa
  unsure (1)..(705): unsure at all n locations
nnnnnnnnnnnnnnnnnnnnnnnnnnnnnnnnnnnnnnnnnnnnnnnnnnnnnnnnnnnnnnnnatatgtgttttactcctgtggaatatttctgttaaatttttggaatttctgggtttctgtgtgatgtagctctggccaccagtggaaggtctggtattttataagcttcttgttcacattgcaggaaacaaataaaaatttggatgagatagttgaactggcaaagaaactccaggttacatttctgcaaccttaaaattgttagcattttgtcgaaatgcattggttctgctctttgctcagatatgatctgaacttcatgcaggaggagaccaatataaaaccactgtgggggactgcacagcttttcatgcacccgcgctacatgcacggtgctgctactaggtagatcagttttgctgcccctttgcatgaaatttggagtatgttctgaagctaatagaagccttcattggtactgcagcccagaggttaaagtgtatgcttatggtgctgctcaagttaagaaagctttagaggtgggttatctttgaactctgaacattgtgataggttttccataagtcaattcttgatttggcttttaccacttgaaggtcacccactacctaggcggtagaaaactatgttttctggtgaagaagagagggttaccaaactcttcttaattctgacatgaa

SEQ ID NO: 26442 - DNA, 704 bp, Oryza sativa
  unsure (1)..(704): unsure at all n locations
nnnnnnnnnnnnnnnnnnnnnnnnnnnnnnnnnnnnnnnnnnnnnnnnnnnnnnnnnnnnnnnnncagatatatccgactcggattagtagtttatgtccagtcggccggagttctttttggaatcggatttatcgttccaacgctgcttgctgaaatagtccgaatcgccgctagcttggatcctatccgacacatgcacatacgtacgtacgtacgcgtgaggcgcaacaaaatccatcctgtacatcgcaataacatgcatttcgtgcggtcgttgtgtcgcttctaactaccgggcaaatataatactccctccgtaatttttttataaatttgacaattcatcttatttaaaaaaatatataattattatttgttttattgtggcttgatgtatcatcaaatattttttaagcatgacttaattctttttatatttgctcaaaaaatttaaataaattcgaaatgcaatccaataaaaagtcgatatattagatgggctacgattgtagcaacttaattagaatattggactagactgagaaaatcctaattaagttgatacaagcgaagttgaagaaacttacttcctcaccggagattaaaccgatctagcctcgttcgaaaactaagaactcgccgaaaagggtggcaacacgtgaaaaattgtatacaaaagataccttataaggtccgggtaat

SEQ ID NO: 26443 - DNA, 1843 bp, Oryza sativa
  unsure (1)..(1843): unsure at all n locations
nnnnnnnnnnnnnnnnnnnnnnnnnnnnnnnnnnnnnnnnnnnnnnnnnnnnnnnnnnnnnnnnncatttcctgttaaaccacatgaattttctggcgtttgaagataatttttatatgctagatcatcctccacattaaagtatatccataaccttttccaaacaatgcctatttgcccggcgaaaaaaataatgcctatttctgatcgtattatttcttatatgaatcaatgtgccactgcaaatggtttaatcatgtgtcattattggtatgtttgcaaaatgtattgttagattctattccagttggcctaaaagtgcaggcaggcttgtttaaataagatctgagtgggatagaactagcagagtcttttgttacaagctacttgacacaaattcacagaatcacagtgatatttacatggtactattatgaaagataattaagaaacgacttgccaaagcaagtcttctcgtcaacttagcatatagactagtcactgaaagtgggcccactcacctcctatatagagcagtgtacacctggagctggagctcaagctatagctcaggtgactgacaatggcgtacagggccttggaggtgacgctcatctcggcgaggaatctgaagaaggtgaacttgatcactcccatggaggtgtacgccgtcgtctccgtctccggcaacccgctcgcccgccagtgcacgctccccgaccgccacggcggccgcaacccgacgtggaacgccacgctccacctcgccgtccccgccgccgcgccgggcgcgttcctccacgtcctcctccgcaccgagcgcgccctcggcgaccgcgacgtcggcgaggtgttcgtccccgtcgccgacctgcagctcgccgccgccgcgcactaccagtacctggtccacaaggtgcagagcaccaccgagcactgcggcgtgctcagcctgtcgtaccggctaggccccgtcgtcgtgccggcgccgccgctggcagcggacaccggcgctgtcccggcgtacctggtggtgccgtgctacgcgaacgcgccgccgtacgtctacctgtcgccggccaatcctgcccgcggcgaggccgcgtcggcgtcgccgtcgccgccgccgcggcgcaagaggagcggtgactttgggcagtggctcggcggcgccgtccggggaatgttgtccggcgaggccatgtcgccggacacggcggcctacgacgccgggtacaaaaccctgatcggggtggctgatggcagacgtgtcaagttctagctagtaggagtactattccagattagcgtggcttgaataaaatggaaaaggtttcttatgtactttttgcatggctgggagactaacttttgtacgaggaagtattgggtggaaaccgtggtagaaacttaaaacttggaaactaatgttggatcgaaaaatggacgtccgagattcgtccacgtcatcattagtaaaaaaatttactacttatgaataaatctatgagtaaaatttttactcgtgatgacgtggtcgaatctcgaacgtctatttttcgatccaatagtagtttctaactttccaccatatatatggtttccactgtatatttttcctctttttactaatcagtagcacgttttcttttctttcttggaatatttatgcattactcgtcattcaacaaacatactctgcatgaaaattcatcgccgatttatttaggtcagtttggacgccttaggtggacaaacgagaatcgacagtcccttgttgatgccgttattccaaggagcgcttctgatagttgtgattttttttctactctacccattctaa

SEQ ID NO: 26444 - DNA, 576 bp, Oryza sativa
gcgtgcatggttttagatgccgcgaaaattttttagttagactttgctttacgctggtgcattcatttgtgggctggcagatctctttagcagctgccagccggtttatgctagctgacatttaaaaggtttgcctaaaaaatatagtattttttatgcggacctcttaatgtgacactgacggactcgtgacccccgaattttctacgccggcgtttttttctcgtagccgccaaaaaaaatattttctagacgccattaaaaatcgtttttctagcagtgatatggggccgttccagtacaacccgtcccgacccgccctgttaccatccctaccgggtcagtcgcccgacctgcttggtaggtgaatccgccactgcgaattaggtgagcccacacgcgttctttgaacattcctatggtacatcagtgcatatgtacctggtgtatatatataagtcattgggataagattgatcacacaagctatcttctgcaaagagcacgcagagcgacccgtgcctactgccttgcctacaaggggggtaccgagctcgaggtcgccaatagataagg

SEQ ID NO: 26445 - DNA, 570 bp, Oryza sativa
  unsure (1)..(570): unsure at all n locations
actataaggcgaaaaacgactcgggacaccagcgaaaaggaagcagacacnggaacggaaagcacccaaaaagggactgaaaaccagaggtttgaaggcaagacaggaaacaaaaccgaaggagacagggaagggaacgctaagatagcccgaccaacgacacaactacggaagaaggaaaagaagtttgagcggtcagaacagggccaggaaagcctggagcagctcaaagaaaagctgaccacggcaccgatggaaggtcttgcagacatcaaaaaagactgagatatatattgtgacgcaccaaggcaaggactaggaggagaacggatgcaggacgggaaaacagaggcctaagcgtcacgacaattgcgaccacatgaggaaaactaccctacccaagaccgagaacacgcagacgtggtacatgcgctaaagaataggagacaatatctaaatggaaaccaatgcgatagctacactgaccacaagaggcaaaagtaaatctccacccagacagaaacaaaacggaggcaaaggcgatggactagaaaaaatcaaggactaaga

SEQ ID NO: 26446 - DNA, 561 bp, Oryza sativa
ctttcttatcatccttcgtggctgcacagttctttctccttgccaagatttaaccgttccttaccaggagctaatcaattttttaccagttatagcatcattttttatgttgggttttgtgagtctaatcgctttaggctttgtttctcccgcctgtaccctctggcccggctattctaatagtttttttctggccagatgtgtacctctgtaccctcgatactcggcccctcgacatgtcaccatgcgcctcaataccgtctcggtacctcgtaatggagctgtgacagtacccctcacgccactctttccacccttcgcccgttcctggatcatttcacccccttatgttcacggcatggactcccccgtgacccccatttgctttctccgccacttctctgtctggtgctccaccatgagccctgctatacgccaggtttagccgttgcccacgctggcttgtggttggtgcggttcatgtttctctaccttaactcgtgacccggtcttttttttctttggggtccggctcgtttcccttattgtgtgtttttcacc

SEQ ID NO: 26447 - DNA, 558 bp, Oryza sativa
ggcgaattcgagctcggtacccaatgggtacagtcaaaaacataattggttaccttggtaaggatgggaaaggcacattattagactcaagtccagaatcactaattgtcccaacaacggcactttaaaatcatatattacacattagttaagttgctgcagcctaggagcaataaaaggttaacaaagtggaaagtggaagatagaaatttcaccttgataggctacccaagatttgacttgacatagcagtaggatcaatgttttcagtggcaacagtggcagcagaagtagattttggttttgatttccttttcagttttctacaggaaaatgaaaataagtgaagtttgttggcaaaggaaatcaacatgaagatatggatatagaaatcacctttgttttgccactaaagcataggcctctttggcttctggatctgcttctttgcaacttgtccatctatggccataatttttgcagataggacacttttgctgacatttggtacctgcttttctcttgcccttcttattcccctcaaccccacctttgtgc

SEQ ID NO: 26448 - DNA, 541 bp, Oryza sativa
cccctccttacaaaaatcttgactaaacccgaaacccgaactaaactatcaactcaatagctctaaaaagcactaccgggaagcctcacgctccctatctatttatacatgaggcaggctgcctaaagccacgaaccaaactcatactagaagtgctaatccgcataggaaacctcatcgtacaagaaacaaactttacataaccaatcataccaaatttggactccttccaaattcgagtctgcatcccatacacacacaatacctgcatcgtatgcaatatggaatcttcaccaaccacgtgcattgaactctagcctaagtatcccgcatgatatctgaccatcgcggacattgcctttccacgaagtcgactcccgatccatcgccggcaatactatcccgaggcatcaagtcacctacacatgaaacaaataaagaaaccatattccgagaccaagctatctccaacttgactcattagtagcaaacaactgtattacatacgcatagtatccatctagaagccataatcatgaaa

SEQ ID NO: 26449 - DNA, 559 bp, Oryza sativa
tgaaagaacaccctctataaggggacaacagctcggtacccgtagtagtgcccagggaggagaccttgatacgatagccatctggggttttctctaagtgctgcttgacttctcccatagttatgtaaggaggagggcttccattgttgtctttctcattatacacctgcgccatataccccgagatgaccttcacatttcggccaagagcaaatgagcacctcgctcactgaaaggcagccaatttgaccaaaaccttaatattgcagagcgcacatagaggcagcatgggacaaaaaagtagcaagtagggccaggtgtatgacaccagccttgttgtccatatagagtagtagtagaataacaccagccctggtgaccatatagagtaggcagaaagctccacaaaagtccgggagatgcttgtaccaccaagaagtgatcggccgtcggtagacaccgaaaggaaggccgggtcggtattgatcttgatgatttgaatgaggacactccatcgaatgaaggatcttgggaaaaaaaaaggcaagcactggacacc

SEQ ID NO: 26450 - DNA, 786 bp, Oryza sativa
  unsure (1)..(786): unsure at all n locations
ctagttagaccgccgaatccgataaaacacaaatcgacgaactctcaaagtatatgacaactttattgcttctctctgtgtttacaaagtgcaacagccgcactccttacaaaaatcttgactaaacttgaaaccctaactaaactatcaactcaattgctctaaaaagcactaccgggaagcctcacgctccctctctatttatacatgaggtaggcagcctaaagccacaaaccaaactcatactagaagtcctaatccgcataggaaacctcatcgtacaagaaacaaactttacataaccaatcataccaaatttggactccttccaaattcgactccgcatcccatacacacacaatacctccatcgtattgcatatggaatcttcaccaaccacgtgcattgaactctagcctaagtatcccgcatgatatctgaccgtcgcggacattgccctcagacggagatcaaagcatgtcaaagaagaaagatgatgacgatgatgtcccgactggttttcaagaccatcgcaaggaactcaatcacatctttggcagacccctagcttatgaatctaagagaaagcaaaagctgaccgaacgggagattaacactgttcagcccgatacgccccaatatcttcggtggtcggagacaacaattaagtttgaccactcggatcatcctgaccgagtggtccacccggggcggtaccccctggtattannnnnnnnnnnnnnnnnnnnnnnnnnnnnnnnnnnnnnnnnnnnnnnnnnnnnnnnn

SEQ ID NO: 26451 - DNA, 915 bp, Oryza sativa
agctcggctaccgagctcggtcataagtagtatagatatatttgagtgatatccccttgataagtgtattattttctagttatcacactaaataaaaaagtaaagaatgattaaattaattatattgtgctaacacatgatatttaattgtgttaatagatactaatatatatatttatctattagtttattaaatcaataaggtaaccaaccaatataaattgtacacagttaagctcggtagaaactcgagctcggctcggtaaagcttgcgagcttttgcccaagctcggggtcggctcaattggagctcgagccgagcttgaattgagcatagaacgagccaagctcaagctacttgtgaccttcgagctttttttgacagctctaaacatatcccagtgcaagcactagaagataatgagatcgaactagagcagcaagatgatggctccttgaatatgtcaggtatgactacaatgaagatagctaaaaccagtaggacgaactaaatgtttatattgaaaaattgggctcagctactattgttcttgtttaattttataggtgagagtgctaaagaagacaaactttaacacatccactactagagaaagcgtttttgctcccggtttgtaaccccctatactcctagttttacaatcgggagtacgaatccgggactaaagatggatatctttagtctcgggcgaaataattgggactaaaaatccatctttagtcccggttggggcagtgccagtcccggttggtcactgttggtatttgatatggttacagataaaatccgcaagcgcacggatataccgatgtagcacttcccctacggagtattccaagggtatcgaatccaagggaacgtgtgtgatcagagcttcctccggttcacccaag

SEQ ID NO: 26452 - DNA, 582 bp, Oryza sativa
cgggtgagaaacccactctttatagggcgaattcgagctcggtacccgttgaggggtgcgaaaaaccgcagctccctcgacgtcttgctgcccgataagctctcgtgctcgtcgcccggcgtccaaggcccgttgtcgtcggtcctcagcctcctttgcagcccgttcgcgttcctgttgttcacgctgcagccgttctcgctcttgtgcttggcgctcctcttctagtcggtgtcgttcggcttcctgttgtacgcgtagctcttctgtttctcgggctttgcgctattcttccatctcgttgtcagccatgaagatgccgaagtagagaggcgtgtagttgtcttcaaagccttcgtcgaagtcgttgaggttgcggtagtcatagcggtagccgaagtcgtcgtactccacgatctccgttggtcgcgagtcgacgccgggggagctgaggtagccgtccagttgtttcgtcgaaaccgtgccgagtggctggagtatgacgccgacttccctggagctaggccgaaccggggctgaagccggatcccgcctaggcctacggggagaagacgcccttgt

SEQ ID NO: 26453 - DNA, 2311 bp, Oryza sativa
aatcgtagattatttttggaaattgctcgagcgtaatagtatttcggtcgaaattccgagttaattataaaaatatgtttcttgatcagattagattaaaattggtagtaatttagatataattaataactaaacaattagatgaactcgtatagattattatagatcatttttggtaatctctaagagtcatcggttcgcggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacagcaaaatatttatacccgcaaaatagtttaagtcaaaattgggtttgccgtagttcgcagatagtaaagttaataaaaaggaatcgactttcacattcgactttcatttggatttatttggatttttatttgaattctaaccgaattcaaatcaatttttgacgtaactatagagcccgagaaagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgctggggcaattacctttgggaaggtaattgagatgcggcatgtggagacatgagcgccacattgccatgatgttgatgacatgatttgtgaaaggagaaataaaattaaataactgtttttgactggggcggacggaggatttgggtggtatctggaaaaggctagtaccgtccccggtcaattaaggaccgaaccatgaagttaagcatgaaacaacccccgtacaaccgcacttctcgtatgggtatagacctagcggattagatagccgagcggaggcagtatccttgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgagagacttctctttcccgggagcgccagaactcctctcactgctagaaacatggacgcctagagtgcatgaggatttaagttcatggagtgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcggaaacgtggacgtcctcagaaaaccataacgactcaatggcgggaagctatccttgggatcacaatggatggtggacagaaccgtcattgtttaatatgaacactggtattaaaacttgatcagtctatgctagatcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctttttctgcttgggagatgaagacgatggcgctcagtaggtcttagtacggtcgttgcctgtggcaatggcttgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctataaattcgtgtgt

SEQ ID NO: 26454 - DNA, 446 bp, Oryza sativa
ccagtgcatttctaatctagttttgttcgtacctgagttttgtatatgcatggtactgttcatctagattaaaatattgtggctagattaccattgtgattagcctaatgacctacttggcttggttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgcagaacttgtggtatgttattccacaagtgaggccgctgacccaacag

SEQ ID NO: 26455 - DNA, 864 bp, Oryza sativa
  unsure (1)..(864): unsure at all n locations
tttgtgtttatatgttgatgacatactcatatttgggaccaatattaatgtggtgtctgaattaaaatcatttttgtcccaaaaatttgacatgaaggatttggaagaagctgatgttatttcaaacattaaattgatcaaaggcgaggatgggattatgctttcgcaagcccattatgtggagaaagtcctaactcgtttcgggttgatggactgtaaaatagctccaacgccttatgacccaagtcttaagcttcgaaagaacaaaggactaggaaaggatcaattgagatactctcaaatcattggctctctcatgtatttggcgtgtgctaccagacccgacatctcatatgctgttagcaagctgagccggtttacttctaacccggagatgatcattggcaagcactagaacgcatattaagatacttgagaggcacaatgtcatatgggattcactataccgggtaccccgctgtgcttgaggggtatagtgactcaaattggatctcggatgccgatgagatcaaggccacgagtggatatttgtttactcttggtggtgctgcagtttcatggagatcttgcaaacaaacagttttgacaagatcaactatggaggctgaacttgtagcacttgacacagccactgttgaggcggagtggctgcgtgagctcttgatggacttaccggtaggtgaaaaacctatcccggcgatccttatgtactgtgataaccaaacagttctcataaaggttaagagcacaaaggataatatgaagtcctcaagacatgtgaaaaggnnnnnnnnnnnnnnnnnnnnnnnnnnnnnnnnnnnnnnnnnnnnnnnnnnnnnnnnn

SEQ ID NO: 26456 - DNA, 561 bp, Oryza sativa
tatagggcgaattcgagctcggtacccgatacaaacgaaatgcctaagcataaaatcgacgaagatgttcaatattccaagaattattgatgagagtaccatcttcgcgcttgaggcgataagaacctggccgagtgacttcagcaattatgaacggtccttcccataagggagataatttatgccgatcctgtgtggtttgaattttcctcagaaccaggtcgccgactaaaaaggctcgcgatcgaacattccgattatgataacggtccaacccttgcaaataccgagtcgactaaattaaagctgcttcacgggcttcttctagtcgattgatgtcgtctactcggccctcttcataacactcctcgttgaagttccgaaatcgtagtgattcaaattccacttcacttggcaacattgcttctgcaccataaaccaaaaagaacggcgactggccggtagcccgactgggagtagtgcgtaaagaccaaagtacggatggcagctgatctacccacttgccagcatagggacgtagtcggtcgaaaactcgtgctt

SEQ ID NO: 26457 - DNA, 1141 bp, Oryza sativa
  unsure (1)..(1141): unsure at all n locations
nnnnnnnnnnnnnnnnnnnnnnnnnnnnnnnnnnnnnnnnnnnnnnnnnnnnnnnncttgacaactaggaccatgctcacaacctaggaggtcgccgacacatataacagtagcggctcttgcggatgtggcgaggccaaaactggtggagtggtgataagtttcttgaagtcttcaaaggctttttgtgcttcggatccccactggaaattgtcagtcttcttcagcagcttgaaaaagggcatcccccgctcgccgagtcgtgagatgaaccggctgagcgccgtcatgcaaccagtcagcttttggacgtctttttgggagcttggcgatttcatgttgaggatggcgttgattttctccgggttggcctgtatgcctctttgagataccataaatccgagcaacttccctgacggtactctgaagatgcacttttcagggtttagtatcatcctgaaagcacgaatgcttgcaaaagtttcttctaaatccgcgatcaggtcatccttctgcttggtcttgacgactacatcatcaacataagcttcaacattgcgaccgatctgagttgaaaaacatctttgaatcatgcgttgataggttgctcctgcgttcttcaatccaaagggcatggtgatgtagcagtaggccccaaatggcgtaataaacgaggtcttcaagcagtcggactctcttagtcggatctgatgatatcccgagtagcagtccaaaaaactgagtaactcgcagccggctattgagtcaaccacctggtcaatgcaaggtaacccaaaagggtctttagggcaagacttgttgaggttggtgtaatcgacacacatgcgccattgccccgtctttttccgaaccaagactgggttagccagccagtcgggatgaaggacctccttgatgaagcccgctgctaacagcttggttaattcctccttgatcgcatccttcctgtcctgtgcaaaacggcggagtcgttgcttgatgggtttggcgtcttccttaacatgtaaagagtgctcaatcacctctctaggaatacccggcatatcggatggtttccatgcaaagatatctttattattttgaagaaaggtgatgagcgcgctttccaatttacaatcta

SEQ ID NO: 26458 - DNA, 568 bp, Oryza sativa
tatagggcgaattcgagctcggtacccctactccaagaatttgacttagaaattaaagataaaaagggagtagaaaattccgtagcagatcatttgtccaggctgcagatcactaacatgcaggaacaaccgatcaatgattttttaagagatgacatgctgatgacggttcacgactccaacccgtggtatgccaacatagtgaactacatggtatccaagtacataccacgaggggaaaatcaatgaaaattgaagtatgaaagtcgctgtcacatatgggatgagccatacctatatcgggtctactccaatggcctattacgaagatgtgtgccaactgaagaaggaccaaagatcatagaacgatgccatgcctcaccttatggtggccattacggtgcattccgcacccaggccaagatttggcaaagtggtttcttttggccaacaatgtacgaagactcaagagaattcgtcagaagatgcaccagctgccagaggcaaggagaaatcactgctcgcgatgcaatgcccctcacatacaatttgcaagtcgagatattcg

SEQ ID NO: 26459 - DNA, 560 bp, Oryza sativa
tatagggcgaattcgagctcggtacccgaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatg

SEQ ID NO: 26460 - DNA, 531 bp, Oryza sativa
cgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaaggacaaccaatcacttgggaagagtttatcgaaggattcaagaagacacacatacctgcaggtgttgttgctttgaagaagcgtgagttccgggcacttaagcaaaaggatcgtaccgtgacggaatatcttcatgagttcaatcgtctagctcgctatgctctagaagatgtgcgtactgacgaggaaaggcaggagaagtttttggaaggcttaaaggatgaactgacagttatgttgatctctcatgactatgaggattttcaggagttggttgacaaagcaattcgact

SEQ ID NO: 26461 - DNA, 102 bp, Oryza sativa
gaacccttcaatgaaccgtcggtagtatccagccaagcctagaaaactctgaatttcagtcacatatttgggtgctttccattccgtgacagcctccacttt

SEQ ID NO: 26462 - DNA, 556 bp, Oryza sativa
agcgcgccagctgagtgaaacggttcaggtactcttgtactgtggtattcccttgctgtagtctcctgaactcattcttcttcatccgcatcaccgcagcaggcacgaagttgtcacggaaggctgtggtaaattcctcccagtttggttctccggcatcttcttctcgggcttctttgtacgtgtcccaccagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggtcgccttggttgttcgcgatagcttgcagaacttgagtttgggtggccataactccggccagagtggttaagtcgggtgtctaagtttcgtcaaagctggttgttgcccgacgtcggcttgccatctgtgtaggttgatggagtaagtatcctattttctggggccagagctgaatgcc

SEQ ID NO: 26463 - DNA, 240 bp, Oryza sativa
atattggaggataaagaaagaaatcacgtgtattctttggccactgggaaatggagtagagctggaaatgcgggctgcatatgtggcttgaaatgtggccacactatagcattcatcaacataatcatgcacctgccccccctaatagatgtgatgaagcacaaggcatgagcacaaggcttttcagacacttgccactctctacatgtacatgtcttctcttcaagatcaactacatgc

SEQ ID NO: 26464 - DNA, 1213 bp, Oryza sativa
  unsure (1)..(1213): unsure at all n locations
cccaacactagcatcctcacgtagccaccccataaccttatcacaaacccacgctctctttgcattcctgaccttctcgctttttctagtactaagaaaaccatggtacatctcatggaccttaatctgaaaaagaaaaaagatgcaatttgataagaaaataacaaaatatgcaatgtaacacatacctgcactgctggaccaccatgaatagttgatgcatgaagcctccatccacatccttctttgatacatctagctctgaatctactaggatcagtttttttaacaaaaaactcgaattatttcttaatggaatattgagccacagccaatctaaactcacacattgaaggataaatagtctcaacagtcatgggtgggttctctttgtcatatgcaacttgtgggattactggatctgactgagcatctcgtgcaatccactcttcatcatcactatcagtgatacttagatcatctcccccttctacctcaggcacattatcagttccagcaatagagtcatcactctcagatgaagagtcatcactctccgatgaagagtcatcaataccaactgagtattgtttctcatcatctacacctacatgctcatagtgcgggaatggattttctaggtatgcatcacttttggatgcctgactagtgctgccttcctgagtaaaaaatgcctgagaggggactgaaagtgatggagtgcaaggcacaataacttgggacagattaatttggtttcccagagtgattaccactttaccccttttagtatgatgaaagcactcaaacattgctgtcaagtcctgatctttgcatattggaatgagttctttgctactagcatgaatataatgcaaacatacagtttcatttaaagcccatggatatttttcacaaatatcacccagaaaatctttgaagttagttacgtctgcatcaataggccatttgaaagaaaaaccacccggaaattcaggcctacatgtcttgcccattattctcacgtcaagtaaataagtagaagatgggtccattctgttgatgaacacatcgtcgatgtgtgagaagaaaaatgtgaaaaatgtaactgctctgactccctaatacaagtatattactcatagggcataagatgnnnnnnnnnnnnnnnnnnnnnnnnnnnnnnnnnnnnnnnnnnnnnnnnnnnnnnnnn

SEQ ID NO: 26465 - DNA, 339 bp, Oryza sativa
cagctgactgtatctggaggacttcttcttcgtcaccgatcattgggcattaggcattcatgaataaaggtgaaacaattgaagaaagtctgtcagatcaaaacgggttcggaggatgtgtttacctgtaatgatttccggtcggggacgagcaggcccttgtactttaacaggagagctggaccttggatcggcgctggcatcctttttaggagggctgtcagcttgagcttctacatcaggaatatctttatttggttctgtacccgactagtttccagtcgggggctcctgattagcaccaattccagcttcgaccgactggttcccagtcggggg

SEQ ID NO: 26466 - DNA, 332 bp, Oryza sativa
tcttcaataacaatggaccgagtacatttgacgcttccgaaatctttgacaagctgagaattgctccggatacatatttcaagaatatcaaggaagctggaagtatgggagcgagcctagcattggcaatgaccaagtctttgtacccgaagattgacattgacgccgttgatggctttgcagacgggacgagcgaagaagccgcccttgacctcatcaacgatgcgcagaaagccggcgataagatagccggtgatgtagttgaaagattccaggacaacgaccttcggccgactggatctactaattccgatgatgaaaaaactgatact

SEQ ID NO: 26467 - DNA, 719 bp, Oryza sativa
aattcatcagtattgtacaaattgagcctccatcatcattaatcatcaaaatcattgttatatcaatcagtatcagttttttcatcatcagaattatcagacccagtcggccgaaggtcgacatcttggaatctctcaaccacgtcagcagcaatcttgtcagcggctttttgcgcatcattgatgaggtcaagagcagcttcttcgctcatcccatctgcaaagccatcaatggcatcaatgtcaactcttggataaagggatttggtcatcgccaatgccagacttgctcccatacttccaacttctttgatgttcttgaagtaagtatccggagcgactctcagcttgtcgaagatttcggcaacatcaagtgtactcggaccggcgttattgaagaacatggcttggatgagtggagtagcggcattagcgactttgtccctggccccttcaagcctattgatcttgtcgactaagacatcaaactgtgcctgggacttgatcttgcggtctgcatcaatagattcacattaacgaatcagcatatagaagataatggcttttgaggtactgattatttggtaccttcaacctcctttaaagatgagtccctctgttttgctagttctgccttatcattttccagagtttgaatttgcttctctagttgagatatcttggcagcttgcactacattgactctggttaatcaagat

SEQ ID NO: 26468 - DNA, 356 bp, Oryza sativa
ccaactggatcagaagcacttggttgggtttcagaccgaattcttggtcctccgcttccctgaccagtttggcggtgaggtgattggtgttgagcgattgggggatccgacttcatcaaagcaaattcctgggcgtgatatcttttattgttaactgattcaacaaacagataagaccgtattttgtgaaaagttgaagtgtttgattacttaccggtggaggaggattaaaggcattgaatggcacgactggcagcaagtgcgaatagctggcgacgatagcatttgagaatatcatgtacatccttttcttcatgaccctaaagttaagagagtccggatcttcacaatttgga

SEQ ID NO: 26469 - DNA, 2189 bp, Oryza sativa
gaggatccccaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatattctcatcacctggacactttggaatggatggattattgtggaattggattcacacttccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcctaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctagaatcgtgtttacaaaatagctttgagcaactaagtatctttaaatgctgtttactgcaaccctaaccctttatattataactcccttgtactcccttgcatttattatgcacttgtgggtgtgtcttgttgagtacggtggttgtactcagtcttgctcaattttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatgtaccgaaatcagaaggatgaaatgcatggagatcaagctatatatgtcattctttctctccgtgctcatattgatatattcatatataatattttcatgtgattacataagcatgtgagactaatgttttgtttgagccatttcttgtttagtctcttttcacattgagaacatggagatgatgaaggtatgcttctatcttagtgtacacatatgatcaataacttctattcttgtatagggtaagttcacaatcttttatctctaattatgcatacatttgtttctcacaaaaatattttgtatgcatacatttagggggagcaaatcctataccttggttatgcatgtacttgatccaagttattcacttttatttaattgagatctttacatgtgagcatataattgagtatatggca

SEQ ID NO: 26470 - DNA, 1497 bp, Oryza sativa
tgttggtatttgatacggttacagataaaatccgcaagcgcacggatataccgatgtagcacttcccctacggagtattccaagggtatcgaatccaagggaacgtgtgtgatcagagcttcttccagttcacccaaggataccaagtaaatgataggccaggatagagaggatttactagtgagaaacagtgtctagggaaagcttaattttaatcctaacgtaatacttcaggaactggcaacccgttgttcctagatgtcgctctactacgtacccggacagggaggacttaagtgctctcgaggactgtcaccacctctacacccacctcaacgtattgtgggatacgcagcaattactgaataataattacctaaacatcacgtctatgcaattaatatctactttagtatttataactcaccaaagcaatcactatatttaagttgattatagcgaacaataatcccgtatgctaattaggaactaaccaagaggtaattctcacaagataaatctaaattactcaagaagaatattatattgaattcaggataataaacagaataaaagaaataggagaagattaccgacaactccggaattcttccgactccttctactctactctcttcctattatagtatacaatattatagtacaatagagcctcttataattcagcttaagcttagaagtgtgtgtgtgaagtgagggagtgaagcctttatatagaggtaggtatgactgttggcgaaggggaaatgtccgaagtaccccgcaaccgccatcagggagtgatctggagcgtccacgccaaaccccaggatcaacggtgaacctgggctgggccctcctggcctggccttcggtcggtggattccccgatccttcgtctatccatttctcggagttttgggttgattcactaatgttttgatgaagttcacaaaccctccttgtatggatacataattctcctcactttagtctgattttcctcccaacttcagggtttatcatctgcatacaaatatacaccaacacttgtggaatacgtgagattaagcacctatcactatgttggatgttttattatccgaactttatgcagacgttggcggtatagaatcgacatttaacagccgccaacaaaaccccccacacttagcactttgctcgtccctgagtaaaggtcagtgtagaatgaatttcttcaagagatgaatcaagcatataaatcattcacacccatacctatacctgtgaattttatcagtggctatcttaccatcttgagtaattgataaatggaatgatcttgattccagtccttcttgcttctctgttagactcgtggggtttttatgaattttcgcaaactagctcttttcctcatattgacttttctctcttgtctctcaaagatgtatattttctttttggatcctctccaaggcaaagtatgccagaattcatccctattctaaggct

SEQ ID NO: 26471 - DNA, 2182 bp, Oryza sativa
  unsure (1)..(2182): unsure at all n locations
nnnnnnnnnnnnnnnnnnnnnnnnnnnnnnnnnnnnnnnnnnnnnnnnnnnnnnntttggcggcataggttctaagataggttccaaacttcactctatctgaacacttaagattcgactatcatcttattattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaaaattagtccttaaggtttgaccatttggcttatcctacagtcaagatggctctgataccaacttgtcacgcccggaaattcactagtaatttccgaactgatttgtgcataaaatcctcgtccaggaatcagccgaggtacacaaactgacaatttaatatacaaatccatcataataactaaactgataaatacttacttaagaggcacttagtcctcaccaagaagaaaaactgcagcggaaaataaaatctagcgaagcttcagctccactcccacaggcagctcaactggggtataagccaaacgtcttctccttctggatcctttttcttcaactgaggttgattgattattgcaaaaatgagcatatgacatactcaacaagccacacagcaaatatgcaagtgcacaaggattccaaaggatggcataatataggctcatttgcaaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacacaatccaccacagcgcaccgttcctggatcataatcacccccttataaacaaggcatggactccccagtgacccccatgggcttatctcgccacttctcagtctggtgctccataatgaaccatgctatacaacaggtaaagccgttgcccacgctggcttgtggttggtacggttaatgtttcacaacagtagctcgtgaaccggtccttaattgtcatgagcacgactctcaaaaccatgtgctcacaacccaccattatcaagttttagttggcaagtaattaattagccaatcacgattaaccatcgtgagctatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgcccgagatagagcgacccgctgcggatttggaggacatgaacacgtagaggacgacgagacgaacccaacgatactcaccctcgtgccaaacgac

SEQ ID NO: 26472 - DNA, 700 bp, Oryza sativa
atttgaaatttatttacgaagtggttttggagatgattggaatttgcaagtgaataggaactgctgcttttgatgtggtccggtcagaccgggcatgtgctgccggtcagaccggcgtgtattacgcagtcagaccagcgcgggcgactctgtgtcggttttggtttcaggttgtttatttggaaatccatgattgtttcatgattatggcttctagatggatactatgcatatgtaatactgtagtttgctaccaatgaatcaagttggagatagcttggtctcggaatatggtttctttgtttgtttcacgtgtaggtgacttgatgcctcgggatagtattgccggtgatggatcgggagtcgactggatggtaaggcgatgtccgtgatggtcagatatcatgcggaatacttaggcttgagttcaatgtacgtagttggtaaagattccatatggcatacgatggaggtattgtgtgtgtaggatgcggagtcgaatttggaaggagtccaaatttggtatgattggttatgtaaagtttgtttcttgtacgaggaggtttcctatgtggattagaacttctagtatgagtttggttcgtggctttaggctgcctacctcatgtataaatagagagggagcgtgaggcttcccggtttcaattttgagagcaattgagttgatagtttagttagg

SEQ ID NO: 26473 - DNA, 875 bp, Oryza sativa
  unsure (1)..(875): unsure at all n locations
nnnnnnnnnnnnnnnnnnnnnnnnnnnnnnnnnnnnnnnnnnnnnnnnnnnnnnnnttttgtatatgcatggtactgttcatctagattaaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgcagaacttgtggtatgttattccacaagtgaggccgctgacccaacagcagcatgcggactttgagaccagtaatgatgtggctttaggtgtcatgctttcgctcctgtctgaccagctctacgacgtgtatggtgcttacaccagcgccgcagagctatgggaggcactggaccgtaaatattcggtttcagatgcaggacgttggatatatgtcgtggagcaatatcatgactttaagatgattgacaaccaatcagtggtgaagcangctcatgatcnttttaacgatatgggtgagatgtctcagnttggtgctattgtgatntctaagtttgtggtggngggcattattgccagcttncttcattttggagggattttgccactgcacttaagcacaaacgggaggacatgatggttgatgacctgattgcccacctggatgtggaggagaag

SEQ ID NO: 26474 - DNA, 281 bp, Oryza sativa
cacctccctattcaccccaatctaatggggtcgccgaaagaaagaaccgcactttgactgacttggttaacgccatgttagacagtgccggtatgtctaaggcatggtggggggaggctgtattaaccgcctgtcacatcctaaatagagtgcccactaaaaatagtgagatcactccatatgaaggatggaaagggagaaagccatcactatcatatttgcgcacttgggggtgcttggcgaaagtcaatgtaccaataacaaaaaagcgcaaacttgga

SEQ ID NO: 26475 - DNA, 631 bp, Oryza sativa
  unsure (1)..(631): unsure at all n locations
nnnnnnnnnnnnnnnnnnnnnnnnnnnnnnnnnnnnnnnnnnnnnntgtcagttatgttgatctctcatgactatgaggattttcaggagttggttgacaaagcaattcgacttgaagacaagaagaacaggatggataaccgtaaaaggaaaatgattgtattccaggaggcacaggatagtagccagaggcagcgtatcaagccactccaaattggtgaatctttttctgcaggtcaagaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccatagaataattatcggagttatggaataagatagactgcagtttacctatgcccttttctttc

SEQ ID NO: 26476 - DNA, 1022 bp, Oryza sativa
agagagagagggaaaagtggggggaaagggagagggaatcacggggagtgatttccccctctttattgcgcgcggggacgccgggatgcggcggaatccgcggcgtcggcggcgctagggcacggactaggcggcgggttcggcgcgaggacagggatgacaggtgggcccacccgtcagcggcacgcgcgcggggaggtggccgaatgggccgcgggggagaggagagggagggggagggagctgggccgagccggcccaagaggggaagggggggaaaaagactttttagggtttttctttttatgaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgctaatttcttttcgaattttaattaattctattattccttttagagaatgatttttatttcgggatgaatttatcaggacgtgacagaaatatccgagatcctagtcggttacgattgtattttatctgtaactacatattctgttagggatatggactttattttgtaatacggaccccttctcctatataaggaggggtctgggtgcctctaggggcacgatttcctcccagatcatacgatcaataatacactcggcggatcaatccccggacaggagtagggtattacttcttgatttagaaggcctgaacctgtataaaattccttgtctctaaacccatccgcttttccagcttgatagccacccccttttagtattgccgaaatcttgtttcgacagaatcctatgaaattcctatggaatgcctaatacaatgtaagtttgggaggaattctaacatgaggtagaacctcatggaaactttcctgtgagtctttatctcatctaattcatgtgtttttcctgtggtccaatcaaacgatcattactgtgtttttc

SEQ ID NO: 26477 - DNA, 809 bp, Oryza sativa
  unsure (1)..(809): unsure at all n locations
nnnnnnnnnnnnnnnnnnnnnnnnnnnnnnnnnnnnnnnnnnnnnnnnnnnnnnnattattccttatcccaggaggcaaggtacaccaaaaattgatacatttcagagtttatcaagcggaagcgtaaatagttaatttattacatgggctgcgaaggcccagcacacacaaagacaaacgagaaacagcggaagactagggcgacgaccacaggcgcttgacggcaggcacgagctaaacaccaaagccttcatcatccaggggctcctcttctgggtttggaaaaaattgggcaagactgagtacaaccaccgtactcaacaagacacacccataagtgcagaataaatgcaagggagtacaagggggtttataatataaagggttagggtttgcagtaaacagcattaaaagacacttagttgctcaaagctattttgtaaatacgatcctagagctatacaagattattaatcaaggccgtgaacccacacgaacctgctttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgaggacgcggctattcgaataggttatactctgatcagaggtgtacatctttacccacaagacacatctttctcacgtgtaaccacgtgccacataccaccacggcatacggacgaaagacatgacatagtttccaacccatc

SEQ ID NO: 26478 - DNA, 2291 bp, Oryza sativa
  unsure (1)..(2291): unsure at all n locations
nnnnnnnnnnnnnnnnnnnnnnnnnnnnnnnnnnnnnnnaatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgcgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtccgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctcaatcttttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaaggcaattttcccggtcgcgacaagcaattggaggatccgacttcatcaaagcaaattcctgggcatgatatttcgaactttcaattagcttaacagaagataaaagcatacttttgaggaaggctgaaatgtttgaatacataccggtggaggagggttgaaggcgttgtatggcaccactggtagcaaatgcgaatagctgaccatgatagcgtttgagaagattttgtacattctctccttcatgaccttaaaatcaagagagtctggatcttcacggttcgggtcatgcttgccatcaaactcaaaggccgtacgggatctctctttaattggagctagccggctcttgataaaatgccgggtgatctgttctccttgcaggccttgctccttcagtttcagcatacggtccattagggcaagcgcctgattctcccattggaagtgagttccaggtgtcctgataactggaggaagacaggagtactcggggagtgcaggctcggggttttgtacatagaacagtttgcatgccagcctttgtttgaggttttgaagggcatgaaaaaatatttttggctcaaagttcccctaagttggaaaccagcccccccaacaacacatggtttactcttgttcggttggggcttgaggaagaagatgcggcggaatagggcaaaatgcggcctgacgcccaaaaaagcttcgcaggcatgtatgaagttggcgatgtgaactatggagttcgggtttaggtgatgcaaactaatcctattgaaatccaaaatcccccggaagaatcttgaggttggaagagaaaatccgccatagaagaaatgagaaaataccacgacttcatgtgtgtcgggggtcgggaatgcttcaccgaacgccggatgtcatccaatgatctccttcgccggaagaacgccgtgcgccaccttctccttcagg

SEQ ID NO: 26479 - DNA, 1356 bp, Oryza sativa
tcggtgggtggtgatgtaaccatgctaggttgtttgcttaatcaacttgcagaataagtgaaacaaacaacacatcaataagaagagttagttcctttaaggtcttgtccctagttctggtctattctttccttgtatgctttccctctcaacctctaccttgcgacagatggataatactggtaacaaagtgtcacgaccggaaatcacccaacaggcgttcctgacgtgcgtgcattattccttgtcccaggaggcaaggtacaccaaaagttgatacaattcagagtttaacaagcggaagcgtaaatagaattattacatgggcaacgaaggcccaacacactcaaagacaacgaaaaacagcggaagactagggcgacgaccacaggcgcttgacggcaggcacgagctagacaccgaagccttcatcttccaggaactcctcatctgggcttgggaaaaattgagcaagactgagtacaaccaccgtactcaacaaggcacacccacgaatgcataataaatgcaagggagtacaaaggaattataatatagggattaagttttgcagtaaacagcatttaaaagtcacttagttgctcaaagctactttgtaaagacgatcctagagctacacagtattattaaacaaggccgtgaaccctcacgaacctgccttaacccaaggcctacgatgattcggaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacgcgagacgtaacatagtttgcaacccatcctagccttagacaagagactcgaaccaataccgcttacgcccgtaaccaccgggacagacaggcaggactgagcccctagcagcagggcaccaaccctctgccatatgacatctcgactcccggtccgcagctcgtgtagccttcatttgccctgaagaatgtccatggaccccggacttcatccatctccaatccgtgtacttttgtttatgactagactgggccacaaactaagccttacccactagacatgtggaagtacggtagtgctttgcaacagaggcccgagattaatccttatagtggccggggtgctacttcccacaactggcatgcacccaaaccccaccgaaaacaggtgggtaccgag

SEQ ID NO: 26480 - DNA, 454 bp, Oryza sativa
  unsure (1)..(454): unsure at all n locations
nnnnnnnnnnnnnnnnnnnnnnnnnnnnnnnnnnnnnnnnnnttttccgcgtcctcatcgacgagctctggtttgctagtgatttctactactctcccatctcgttgagctccttcagcggatggtgtgccgtgctcaaccacctcttctccgccctgatcgtcgtcggcgctgtcaccgtgggatggatctatcgcacgaagcaagtggtgattttcgacggctcgcaagcgttctactacatcgtcactgtcgtcctcctgctgtccgtcgtgttcatcgagatatgggagatcgtcgccgacgtgtgctccaactggaccaagatggccctgctcgcccactacatcaggcacgactcgccgtggcgccgattccgcttcgtccactcggcgctcgacgcggtgctgcggtggttcaagccggcgaggcggtggcgcgacaagatcgggca

SEQ ID NO: 26481 - DNA, 650 bp, Oryza sativa
  unsure (1)..(650): unsure at all n locations
nnnnnnnnnnnnnnnnnnnnnnnnnnnnnnnnnnnnnnnnnnnnnnnnnnnnnnnacatctctggatcatgcgttgataggttgctcctgcgttctttaatccaaaaggcatggtgatgtagcagtaggccccgaagggtgtgatgaatgaagtctttaagcagttagattcctttagtcggatctgatgatatcctgagtagcaatccaaaaagctgagtagctcgcagccggcggttgagtcaactacctagtcaatgcgaggcaacccaaagggatctttggggcatgacttgttgaggtcggtgtaatcaacacacatgcgccattgtcccgtcttcttctgaactaggactgggttggccagccagtcgggatgaaggacttccttgatgaagcctgctgctaacagcttggccagttcctccttgatcgcatccttcctatcctgcgcaaaacggcggagttgttgcttgattggtttagcgtcttccttaacatgtaaaaagtgctcaatcacctctctaggaataccaggcatatcggatggtttccacgcaaagatatctttattattttgaagaaaggtgatgagcgctttcctatttacaatctaactcagcgcctattacagcagtcttagtaggatc

SEQ ID NO: 26482 - DNA, 672 bp, Oryza sativa
cacttgctgaaccatccatttctgctagctcgattgatgagaaggttcctgagcagccgtccgtcaagaatgaagaaattcagactccggattgtgccgcaataatgttcagggatggttttgacgaagactacggcaataccctgaactactttagcaagaggaaaccacccgttcctttgtcaccttccgatcctatagaagttgggttcatgcgagaaactgtccgggagttgacatccataatgagcgacgaatggctaaaggaggcagagctttcatccgaagtaattcagataaataccgctccctgaatcattccttgccatctggaagggaacgatgtcggtattctctacagtccaactgtcggggtcaacctcgtctctgagtcttttgcattcgcttatttaagcaataaggcagtgaccccgacaaacaattcttcaagcatccgaacggaaatatcatcgaaggatttgggattgtgcaagatgtgcctgtctgctttgaagacagggaggcgatcttggatttccatgtctttgaaatccaagactttgatatcctaatcggaatgcccattgagcaactagtcatcaacacaccccgattaggtagcctcaaaataactctaggaatcaatgggtaccgagctcgaattcgccctat

SEQ ID NO: 26483 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnnnnnacatagcgtttttatttttgaaagtattactaaatgggaatttctcccttggccaacttagaaaaggggtggggcgccttttggtcttttcttacagtcgtatggctctgataccagctctgtggacccccgtttttataacaggaatcaattgtgtaaacagtaccatttccctggatcaagtagtctggtacacacgaattcatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaatattatatttgcaagggtgagtaccaaccgtactcagcaagccaccacagcaatgatgcacatgacagaggaattcaaaggatggctatggttcttttgcgcacagcaagttttgtaattcttttcacaagcctaagacctagcatagactgatcaagttttataccagtgttcatattaaacaatgaccgttctgtccaccatccattgtgatcccaaggatagcttcc

SEQ ID NO: 26484 - DNA, 713 bp, Oryza sativa
atcaactccgccaccatcgggaacgataacttggacgctgccgccacccgagaatgacgactcgaacgccgcatccacccttgctcatcttttctctcccgatcctacccattgtaggatcaaggaggccgactagagggggggtgaataggcgattttaaaacttaatggcacttaaacaaaactaacctaagttgctaggcaaggtaaagtgcaaggttaactaagcaactaagttaagttttgcaaacctaggtgatatgggctcaaatatgtctctatgaatgtaaatagcaaaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcactcggggtagttcttccttcactctgaaggtggtgaactccaaaccactcacaaacggcgccaggcctcctccacaatctcctcggagaggtcaccgggcaacacctatacaagctgtctaggaggcggcaacctccaagagtaacaagtctaggatgcttgccgaggatgatcaaggggcatactagctaaaacaataaagcaatgcacttggattgg

SEQ ID NO: 26485 - DNA, 1241 bp, Oryza sativa
  unsure (1)..(1241): unsure at all n locations
nnnnnnnnnnnnnnnnnnnnnnnnnnnnnnnnnnnnnnnaatttcaaaaaagagaaaaacggatcggttaggttagggctgttgttagctggattgcatttctaacataatcatgtgtttattctacttctctgttattctattcacggtattcaaaggccctaattagtataaaaatatgctgcattgatcaggtgaagggcagcaggattagcacaacaacactagaaaggagctagatagaggaacatcatgcatttgatgaatacaattaggcacgtacagcccacataacccggtggtgaaggcggagatttcatcatgccttaattacaaaacgaacactaaaacatttgatgactgttgtgccatgggccaatagtccgtactatctgcactaaaataacaaaaatttcaggctactatcttaatcccccatgactatcagctatctcaaattgtcgccgaatctgcaaccattttgctccgtgcgttctctagtgccctcttccgacgagacaccatgagtccaataattgtcccagtaatctgcgttgccctcgccattacccacactgcaatctgccaaagcaccaacaataataaaatgttaattaattgttaacctatcgacgaaaaaaaacacaacgataataacaaatccaagttgtacattacatatatacataccctgcatatgtgtggatccaaggccttgtcgatcttgtggacgagcgtgttcatctcggcctggaagtcgtcgtacaagggcttgacgtcggagttgaaggcgtactcggcgaggctatccatgggcgccctgtggctgacggcttccagggcgtcgtccagcaagacgtgggtcaccgccgcgaggcctcgcagcgctcgcaggtacgactccaccgtcttcttgctcaccttccgatcgtacgagtcgtccgcggccgccatcacgatgttcacgtacatcctcacagtctgttcattatatacaagagttaaaaagaatcttaggtcccgttcttttctcaaactaagagttagatgaagattttcgtggcacgttttttaaactgctaaacggtgcgtttcgtgctaaaattttctatatgaaagttgctctaaaatatcatattagtctatttttcaagtttgtaataattaaaactcaatcaattatatgttaataccacctcgttttgcataaaaacttaatcttcatcttcagaagaaaagaa

SEQ ID NO: 26486 - DNA, 482 bp, Oryza sativa
agaaaaaacacaacgcacaaagaagcgcaagaagggaaaggggaaagaagagacaataacaaaaccagaaggaaagacagagggaagagacaaagaaaaacaaggaggaaaggaggagaaggtgagaaggaaaaatgaaagggaaagaaagagaaccaaggaacaaagagcagaagaagctaggacccggagaccagggaagggaagatgaggcagatggaggcgagcaagaagcaaaaaaaaagcaaggaaaccgagaaaagacaagcagggaacgacgcaagacaagaaagggaaaacagggccgaggaagacacggaagagatgaaccaagagagagaggggaacggaagcaacaaggaaacaccggaaccgagaacgagacagacaaaaagagggaacagggccaaggcaggggaagagaagagggcatccgcaacaggaggacaagccaagcaaaaccgaaagggaaaaaataggcg

SEQ ID NO: 26487 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnnnnttcagatgactaattggcagtaagtagtttctttgtacagtgctcactcgttacactttggaagatcagtctcagaaagcgattttaagactgcattactggtcgtttatctaaattgacctcttttaagattactaattaagtaattgtaatatctgatctctttccaaatgcaggtattcagaatccttgaaacgatttcagcatgctttagaggcatgtggtgtcaacaaaactctaatcaaacgtggagttaaagagggagacacggtagttgttggtgaggtatatattcctatgtcataaacaaaacattggacagtcatcacacaaataaaattatcagatttctaagttaataatttctgcagatggaaatggtttggacagatgagcctagtaagaccaggtcatcaaagacaatgaactcaaaagatgactctgtcagatggcctgaatttggctagatcaaggctcaagcaatggttctgtgtcgcagcagaggcgattttcactgaaatgtttgcacatgcttacaataaaatgctgcactatgacaacaaaaaaactactagtcatcacaacagctagttacacccagcccaaataaaaggaatactattttgtgttaccttcagaatagtgatgtatcacacagct

SEQ ID NO: 26488 - DNA, 1345 bp, Oryza sativa
  unsure (1)..(1345): unsure at all n locations
gaaggcaaatattggttagttggaatatgcacaatatattagatcatctaaatatccaatggttagaaataatggtctaccgaattaagtaaaaatcaaaagtcagatttttttttcataacttccactattttctctaatttgtatccctatactttacacatattcataatttcctatgaggaattatccatcaaatagtaaagtcaatttttctacataaatcggtagagtcattaattatatatggttctatatgtaatgtcttttctaacttaagttttctctcttttcctatggaacttcaagagttatgtgtcttaggtaccatttagataccataagttaccaaccccaatttccagtacgttattttataaataacaattaaatttgtcatggaatggtaatgaagaaaattcattaaaaaatcacaattttgaatcgttgcaggtattggtccgctagtataccacccttataagtttctcaaatatatcctacgtatggtacatgcccgtgcgaatgtacgggctaccttcctagttcgctctaatgatgcttctcaagaatttataacgtattaccaagtgagaataatcaaccacctactattataaaagcaagagctttttttttacagctatgtgtaaacgttttgtgcggaaaatgttttttccgtctacatttaaattaaatgaaaggagtagtatttgataattttcaatccaacatcctctcaaactaaaaagcacatgaccaaccgaatataaacaccccgttattgagagtaattaaatttctttacaacttcagtgtctaacgatgaagaaattactgatctgaaccatttgatcatcgataagttaatggattcaccttttctttgggtgtgtgtaggggtgcacaggaagctcgtggctcgttagctcgctcggttcgtgacaagctcggctcgacttgtttgattttcctaacgagccgagctagaagtttagctcgctagagataacaagccagctcgagctggctcgcgagccctaacgagctaggctgccaggccacaaagcccataggcccatttatttagaaggcccaacagaccaaaaaccaaaaccctagcttcccttcccccttccctggtggtggcggctgagatccccgtctcccccacatgccagcgccacgtgacacggcccacgcccaacgccgctgctctgcgcctccaccctagcgaccgacgccggcacctaaccccagcgcccgacgccgccggcccaccgatctcagcctctcnnnnnnnnnnnnnnnnnnnnnnnnnnnnnnnnnnnnnnnntcaggaatt

SEQ ID NO: 26489 - DNA, 1758 bp, Oryza sativa
  unsure (1)..(1758): unsure at all n locations
nnnnnnnnnnnnnnnnnnnnnnnnnnnnnnnnnnnnnnnnnnnnnnnnnnncaatatcaatatttttgcacttcacacatggttcattgcttgggacaattttggagcacgatgcctcactagggagagagacactactctttaaggtttcgaacttctcttcaagggagaggtaagctttgtccaagtcatccactgtcacgcccagaaattcccgaatagaattccaagcagaatgtgcattaaaatccccatccaggaccggccgaggtacacaaacgacaatgttgacattcagatccatgtcttacaaacatcataaaagtcttacataaatgcagcggaaaaacgaaagacaacaggagctaagccttgactagaactgcagcgggaacaccactccacaggcatcctcgacggcacggacgaaacctactcctcggagaaacctccatttgacacatactcgtactctggggctggggaaaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgcaataattaattaatattgatcatccgctgtccaacgctatcccacgttgcaacaggcccaaccatccacctatactatccaatttcattagactaaactagggtaagactaatcacggtgaatctagttgaccgcccataaccgcgggcacggctattcgaatagttttactctgatcagaggtgtacaactgtacccacaagacacagccccacaacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccaccatgtgattcattttaattaaccaataccaaaacggtggtactaaaccaaccttaccaattgaacctaaagtctatattttagtgagctttccccattgtgtgctagtggaactaagcatggctaagcaattcctagtccaaaatctattcatgttataacccaagctaacaaaggagcatggtatcaaaaatggcatggctataacaataggtaaacaccccatagtaacattataaacaatgcaatatttgaagaaaaccaatagagcatttgcaatataggatcaacatgttcaagtgacaagcatgacttgccttgctctgctgctggagaaacctcggcgactatctcgaagtacaccggagcggcggaagaaccggaatctagcgacatacaaggaaaacattacaaacaggctataagactactgaaacagagaacaaacatttttaatggattctacacatttttcttgatttattgagacttgaatgggcttaaacggagcacggatgaattagttatgaattttag

SEQ ID NO: 26490 - DNA, 3537 bp, Oryza sativa
gaaaatcgaatcccggccgtctcaggagcgcgggtgagcgggagagagggggaagtgggcgcgggtgcgagggcgacgtggacggcgtggcccgggaggcgcggacgcgaggcgcggcggcggttgcgggcgcggcggcgagcggctggaggttaggggaggacccgataggtgggccccacctgtcggtgaccccgggagagaagagggggcgcgggctaagctggggcgtggcctccggccggcccagcaaggcgcagggagataggagggggaaatgggccggcggcccactaagggaaaaggaaaaagaaaaaagaaaaaggaagaaaggaatttccagggatttaaatattgcctgtgctcaattttaattgattaaaattatttctagggctctgaaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacatccactctctcttaaagttgagcgttcgccacctcaagattagcatgagactctttggtttgcttgtaaagccgtaccaaagcctcatttttctctctctccttagcaagttcactcttgagttcatgagaccgctctttctcacgaatgagcaattcctcttaactctcaaaggttgcatattgatcctcaattctcccaagcaactcactcaagtgtggtatggattccttggttatggatttgaacaactcgtcatccataacctcatcctcaacatcttcctccccatcactactaagatcaacattaaattgttggaattaatgaatgggccttagcccactcgaagattaattctttggaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggccgggcagggcaggcggcgcgtgtgcacgacgtacgcgtcgaatggtccgaaaaattggctcctcacccttgcgcagatgcagcctccttttgcagttttgttttgctgcaaattcggattcgattttgttttggaaacgttccgaaaaatccggggcgtgcaaatggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgccttctactctgtactgcgctgtcgctcgtaaactactccatcccgctcgccagcgtgcaccggcgatcgggagagcaggtctccggaacctctgccttcgacgtcctgcaccaggagaaggcggcaataaggtttttgggaagcgcttcgcgcgactactccctgtttgttcgcgacagctcgccttcctcttcgctcgcgtgtttcgtgccttcgtagacacctacgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagattagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgatgctaaggagttgtgggatgcactgaatactaaattcggtgctactgatgctagcaatgatctgtatattatggagcagtttcatgactacaagatggctgacaaccgttctgtagtcgaacaggctcatgagatacaaaccatggctaaggaactcgaactccttaagtgtgtcttacccgacaaatttatggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtggacagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatgttgttggcacggtagatctgaagtttacttcgggaaagatcgtgcagctgaagaatgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaatatgtctgtgaaccatatttgtggcagtgtggatgatgaggctaatgtttggcattcacgtttatgtcatattaatttcggcttgatgtctcggctttccagcatgtgtttaattcctaagtttttcattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtgaaaaacgatatttcatgacattgattgatgatgctactagattttgctatgtgtacttgttgaaaacgaaagacgaggctctagactattttaaaatttataaggcagaagttg

SEQ ID NO: 26491 - DNA, 1411 bp, Oryza sativa
  unsure (1)..(1411): unsure at all n locations
tcagatttttgtgaaataaatggggtgttgacaaagggtgataacgaattttcatgacattgattgatgatgctactagattttgctatgtgtacttgttgaaaacgaaagacgaggctctagactattttaaaatttataaggcagaagttgaaaatcaacttgacagaaagataaaaaggcttagatctgatcgtgatggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacaccgcgggactgcctaaagcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtcgactgtgtttttctgggatatgcttatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaatgacggctaagtcttttggtgatgatttcactgtgtacctcgtggatgacactcctaagtcaatttcagaagcatatgcatctcctgatgcagactactagaaggaggctgtccgtagtgaaatggattccattatcgctaacgggacttgggaggtgacagagcgaccctatgggtgtaaacctgtggggtgcaagtgggtgttcaagaagaagcttaggcctgccggtactattgaaaagtacaaggctcggcttgttgctaagggctatactcagaaagaaggcgaagatttctttgacacttactccctgttgctagattgaccacaattcgtgtgctactttccctagcagcctcacatggtcttcttgttcatcaaatggacgttaagacagctttttttaatggagagctggatgaggagatttatatgtatccacctgatgggtttgtagttgaaggtcaagaaggccaagtgtgcaaaatggtgaagcttttggatggtctgaagnnnnnnnnnnnnnnnnnnnnnnnnnnnnnnnnnnnnnnnnnnnnnnnnnnnnnnnnnnnnnnn

SEQ ID NO: 26492 - DNA, 6254 bp, Oryza sativa
gtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctattaccagataagactttgagtgaaacttgcttgcacaagacttgcaattcaaggcgtagtccattgttcaagttgtgagtaagtgttgcttggagttctaggtggatgttcaaccttaattggtctccatcgaaccgctagtatataaacagtatattggaaaaggcaaatctcagtgggattttgagatttggtgggggattgttggaattaatgaatgggccttagcccactcgaagattaattctttggaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcacgctcgctcgcctcgcctcgcctggctgggccgggccgggcagggcaggccggcgcgcgtgcacgacgtacgcgtcgaatggttcgaaaaattggctcctcacccttgcgcagatgcagcctccttttgcagttttgttttgctgcaaattcggattcgtttttgttttggaaacgttccgaaaaatccggtgcgtgcaaatggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgccttctactctgtactgcgctgtcgctcgtagactactccatcccgctcgccagcgtgcaccggcgatcgggagagcaggtctccggaacctctgccttcgacgtcctgcaccaggagaaggcggcaataaggtttttgggaagcgcttcgcgcgactactccctgtttgttcgcgacggctcgccttcctcttcgctcgcgtgtttcgtgccttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacataaataacttgaggggagaaggtatcttagcctcctttgccatgaggcaaatgggagcaccctcatcacttgagtaatcgaagagtctcggtagcgatgaaagcttgacggcgaacgtggcgactccttcttcatcacttgagcttgactcggagtcggagccgaagatcatcccaaggtgagcttggccataatgttcccgcttgctatgcttgtgcttctacttcttctcatccttcttctcaccctttttcttatcttccttgaggtgggaaccatccttgaggtgggggcactccgcaatgaagtgcccgggctctttgcacacatagcacacccttgcggagtgtcttccacttgacttgttggagtagtgcttggaagagcttcccttgaagaagccgctttgtctcatgaacttgccgaacttcttgacgaaaagagccatctcttcatcatcgatctccaccttgctcttgctcttgcggttctcttcttcttcttcctctgccttcaatgccaagtcttccttcttgatgcttgcggttgagctttggttgatatattggatgacatccttggaatcttgcacgagcatgtcatgggcaaggatacgcccgagcaaatcataaggtgtgagagttttgtagtccggacgctcacgaatgatggtcaccaaggtagagttccttggagtgattgcccgaaccatcttcttgaccacaacctcatcggtcatgtccttggagccaagtcccttgatctcgttgacgatcttgctcaaccggtcgtacatgtcgcttgggatttctccatccaacatcacaaacctctcaaattgccccttgagaatctccaccttggactcacgaacactatccgtgccttcatgcaggttccgaagcgtgtcccaaatcactttggcactttcaatgccatccacacggttgaactcacttctactcaaggcgctaagtattgcattagcggcttgagcgttcttgtgctcgttctcgttgtcctccttggtgggatcttcaggattctgcaaaacatagcctttttcgactattctccaaatagatgggttaatagacttcaaatgcatcttcatcttatgcttccaagcggcatagtccttaccattaaagtacggagctttgccactataggtactcacataagatgtagatgtagagggatagtcaaaaggaatcctagctcccttttcaccatcattaccatcccccgtgtgacccgacatgatctctccaagcggttaagcctaattaggagattaggctctgataccaattgaaaaggtcaattaggcctagagggggggtggataggctaatttaaaaacttaagtaaagcggaagctgtaattttcggaactaggctgggaattttcggaacttccgaaaatgcacagagcagcgcacacaaaatgaagtctctagatctagaagtctaccacatggaatcaaagacacatacaacaactagaccaatagtggcacaagcaagcaaagctagaggagagggatgaagagatattgccaaggtgaagcttgcaaacttgatcccggagttcaaatccttgaggggattccactctccgttgaggagctcactaagagccaggtcttagctaaccctttccttaaaaggttacactaagcactccttcttatatgtctatgcatcatcccccttaatagtacagctttcctacgacacaatgcgaggaaaaagatacaatataccatttgatcattgccgcattgcaacgcgatgtcgcattctcgggatatgcattgtattacaacacgtcgaggaaataacaaccttcacatttgcttgaataaaaatgttagtcatctctaatctcattgtaatcaatcattaaaatcattagggcctagatgcactttcaagcttgcagcggtgctcccggctcctccccatccccactgcatgcgcatagaggcaaggccagatttgatatgatggcagtgttttcccttcaaacttttaaaaattctgtcacatcaaatgttcgaatacatgcatagaatattaaatatggatggaaaaaaaacaattgtataatttgcatgtaaattatgccatgatttgacaatgtgacggtacagtaaacatttgctaatgatggattaattaggcttaataaattcgtcacgcagtttatcggcggaatcggtaatttgtacatttaatactttaaatgtgtgtccgtatattcaatgtgtcatactaaaacttttcatgtctgtaactatacgtaactatacagttcataaagtgaaatgagggtgaacacggctcctgcaaaacaataagcgacatgaatatctatgtcgcccaatgcagcaagataacttgtcagacgaggtcaacgatataatctataccacgcccttgacacgctggccctacagtattccgggcccacacaccagtcagagaccttttctcaaaccgtgagccaagccaccgccgctcccgtttgttggcagcagaaaggaccgcggggcattgacgacaccgattttttttaagcacatgcttaaccaccgttagtcttatttaaaatttttttataaaatatataatactatatgtatatataagtatatttaataatgaattaaatgataagaaaagaattaataattacttaaatttttttaataaaacaaacaattagatatatttaaaaaaatcaacggtgttaaatatttagaaaccgagattccaactccaactcaggtcggtcaggtgtgtgtggtcgttgggactacttgcgttggttgtatgggtccaccagcgaaccggtcgtctccgggtctgtctttcagtttgcgaggggcaaagccaaagccgctacgatgtcctctccgggtctttctttcagtttgacacaaaaagttttcaatgatcatgcaagcgtgttgatatatatatatatatatatatatatatatatatatatatatatatatatatatatgaccgtgaaatctaatactctctggttgttgtttgatgacttgatcctctatgaggtaatgaaagagatttatttaatttatttggccgtcgtgttttcccttatctcctacaatctgcagtagagcaagtacgccactgtcttctataatttagtgtggatgtgtgaatggtcgaaagagatgctactctctttatctaaaaatatatagtaacttttaatagacacatattagttacagagtagtatttgtactaataatctagatatatagattccctgttcaaatttaaagtaaataaaatatatcatatcaatttaaaatcatttatattttaaggtgaaatgagtatgtccagttaattttgacacatcaacgtcgcagagaagatgtgttctactgcgatacactactgctgcctagatgctagtaatgctactacgtacgtcctgtgtgtaggaaatgttccaatggatggaattcttttgaaaagctatatagagtcgagagctagctgctggtataatctatagcatcagcagccgaaagttcgatcctgttgctgtcgacggatcgagcacgtcaattttatgtacttctcctcttgttgtctcctcaagtcctgtttattccctttgacttcagatttttagcatgtgcgatgtctctcatattagtcatatatatataactccctccattatttttatataacgtgcactaaccaacgacaaacaaggagaatcaaagggagtattattttcatggaattttctccgagattcatttccttgtagtgatcgaccacctccctccttatccgcggtaattacccttttatttacctctcaccatcaagttatggcttgggtaattcgaggacatgtacgtcattgctggcgtggaaggactgagggcatgtcactaaatctattatatattattaaagaaatagaaaaaggagcctccacgttcgctctcatggtctagaaattatcacattaatcggagaaaaagaaaaaacagagtttatatagaaatacaatttagaaatagctgaaattcggaattaaaaaaacaaatattagaagaggagactagagtccatatagaaatacaatttagaaatagttgaaattcggaattaaaaaataaggaatattagaaaaggagactagagtccatatagaaatacaattaggaaataactgaaattcgaaattaaaattaaaaataaggaatattagaattagagtatagagtccatataggaatttaaaactaacta

SEQ ID NO: 26493 - DNA, 4115 bp, Oryza sativa
  unsure (1)..(4115): unsure at all n locations
nnnnnnnnnnnnnnnnnnnnnnnnnnnnnnnnnnnnnnnnnnnnnnnnnnnnnnnnnnnnnncttaaaaagggggaaagaattgctattcccacgcacatttttttttctgttttcttcatttttttcgtttcttttcagttttttctttccttttttcgtttttttatttcttattaatactatgtatgtatacaaactaatatatatgtatacaaactttatatacatttatatttttttatacattcatatataaactttgtatacatctctatcactactcccgtccctacttaaaaaattcacataaaaaaagtctattcgattccctaagaaagtggaaaaaaaaggttcgtaaaaaataaaaaatgaacgagaaaaaaaaaataaaaagggcggaaaaaagcgtggcaaaatgttcgatttctattcgtttatgtagtccgtatatatatctcttcactatctctaatataatttaactatttaaaaatagatgttttcatcgtactactaaaaagagaagttttcattgtacaactgaaaagaaaaaaatgcgtgagaaattaaaaatggttaaaaaacgtgtgagcaaaaatggccagagaaaagtgctaaaaaaggtttccgtcgtccgtaaaaaataaaaaatgtgcgggaaataatatttccatcatctgtaaaaatttttgaaaaaacatgcaaggaaaaaactcttagaaaaacacgccatttttcgcaagaaaaaacacagttaaaaaaacaagttgctctgaaaaaactgtcagaaaaaatgctaaattgatggacgcttgggtgagataggatccatcatttttttctatctcctacacgacttttgtttcgtcatctattctcctgtattggagaccctgcatgtctttatatgcaagtatagctattattattgataacatatgatatggatataatattaaaataaacatatttttaattattatttagagaagagtgtacagtgactctattttgtgtaggcttgaccatgcgaggcaatgtaggatttgattgatcttattattggttgcaagaatgagattcaaagagtattttagattatatgcatgttgtcacatgaataatccaattattttaggtaaagcaagcatcgatgatattgtcatcgtcgaggctgaaccatttcattgaggatgttccaattttttgattgtcttagctataaacgatccatacaaatattgtcattggcattgttatgtatgaaaaatgtatataagtttttcacccgttgcagcgcacgggtatttttgctagtaaatataataaaaattaaaagtagagtttagagtccgtataaaaatacaatttacaaataactaaaattcaatattaagaaaaacatgggaagaagagtttaaagtcaatataggaatgcaatttagaagtaactgaaattcgaaattaaaaattaaagtatattaatagatgagtttagagtccacatagaaatacaattaaaaataataaaaattcagaaataaaaataaataatattggaagaagagcatagagtctataaagaaatacaatttacagaaaattcggaattaaaaaaaatatattaaaagacgagtctagagtgcatataggaatatatataatttacaaataattaaaaattgatattaaaaataattaataactaacacgtatataaaatacaatatgaatattacccattagtagtttcgtaaagttattgcaaaatttaaattatgttgtcattttaatatatttgaataatatattgagaaaacatatatgctattatatgagaaaatataatgatgctagccgcacaagctgcgcgggccaccatgctagttttgaatgattctaatatcttaaatccctttgttggcctacgaaactttcctgttctacaaagtctaggaaagtgtatgtattggaaaaagggaaaattacataagattttaccttagagtaaaatttgtcagtgataaccgatggctacccaacaagaacaacatggggcagagctaggctgccatctatctccttgtgttccatcagcgttgacatcgttccatttgggtttgagaagattccatagtctagtcaatattcatatatgcgcgtttctttagtctatcaaggaaataagttttcataagattctatcatatgggattctagaaaaactctccgttccacttctcagaccgaagaggttctcttgtcttaataattagaaaatatagtacatgtttaggtcgtgtgtgcttaattttttttaagtatacggacacatatttgaagtattaaacgtagactaataataaaacaaattatagattccgcttgtaaactgcaagataaatttattaagcctaattaatccgttattagcaaatgtttactgtaacatcacattgtcaaaacatggcgtaattaggctcaaaagattcgtctcgcaatttacatgcaaattatgcaattggtttttttcatctacatttaatgttccatgcatatgttcaaatatttgatttgaagtgatggaatttttgaaggtttgaagggaactaaaccctaccattgaagactagaccattatatttgacctccaaaacttacacatcacttactgtaccctgtgaaatttcaaccatcgccgtccctaccaatccactattattgtcccaatggtatgcttgagggtacccttccgctttggcaaccagctagttgagccacctagctatgccatctggtgctggcactactgcagaaatgcataaaaatgatagtactatagatcctgaaaatgctaaaatcaacacctataatagttttcccaaccgaagcgtgtgcctgcggagcaccatcggctagaaccgatacctttgtggagaaataggtaccggttctagagaaaaaccaacacaaatattatagatgctgttttttttaaaaaaatagatacctttaattaattataggtaccaattaattaaaaaccggtacgtataatatattataggtggtttaaaacatcggcaccagtaaaaaccgagctgggccactctctccactcatgagcagataaagagagggaggggcggggtgggcgtccttattccctccacttgcctcccttctctcttgagagcggcggcggcgccatccctacccgcaagcggtggtgaagtcctccccactcttgagacccgacggtgcattcctcaccagtgagcaacgctcacggcggtgataacctcccacccgcgagcagcggtgccctccccactcacgagcggcagcggcagcaccgacgctacattcgataggcccgagctcgggggccgctggatatggcctccgtgcctgtcctcgagcaatctccggcttctctgtccctttacatagacaacggtcggcaacatctgttcttgtgttatagtgtgcttgttgtgcttgttgtaggatgtttgattctgtgataaacttgttcatttgtgttgttgaaatgttaattctatgaatgtgttcttggatgttagattgatcttaggggtgatggaatctgagagatgaaggtgaactgctcgatgcatcggcttgaatcaagtcttttttttttcattcttggaaccaagaaccggcacatttgagtcctcgtcaaaggtgccacttgctgggtgttggttacgaaatccggtacctatggctggttgccacctagcaccaatcaacttttctgtagtagtgtggtgagctcaaacagattcgatgccacttgcaaatgagcctcacttgacaatcgatgacttatatatacactaataagtgtgactagactataattcaccgagtttttgaatataccatgtgtagctaaacaagggacaattggatcccaacaaatcaagcaatcaattgaaatatagctcaaaacctctttatatttatgatagacagtgaatgacaggtgggtcctctcatcagtgaaagagagaccgtatacctagcaacatttttggcctgcagataagcagagagtgaaggaatctttgatgctgcaaacgc

SEQ ID NO: 26494 - DNA, 14820 bp, Oryza sativa
  unsure (1)..(14820): unsure at all n locations
gaatgaaatccatcaaaccatcgtcggacatatcattcaggcgtgggcatcgatcgactgatcatcctcgtcgtctatctcgttggattcatgctactagtattattcagagtttttgctccatcactattctttcagagtttcagacagtacagcaggcgatgcagtacaattaattaacgatgcataatagcttgggtttttggactcttgctgtctctctgtgtgctcgtggtagttaaccattcaatttgatcccacgtgtaatgctgaatgctgaaatgtacttcatcgagcctatttcttagcttgtttgtttgtttatttgttttacttatcagcaggttctgaagaggaaaaaaaagttgttttttaattttctagaggaggaacaagagttgttgaggatgattaagaacgaaaattcaggcaagattagtcaaacaattcttctaattgaccttctattggcttaatttacatgtgtgtttctagctaggcggcgtcaaaccatacacgaaacagtatcctcagatatcaccatcactgactaacggattaggtctcgaggttgtaggtggtatggtttgattcaaactattttattagtgtatatcatgattgtaatgagttcgatcctcttcgtattttgcatcatatgatacgatatttgttttatattccctccgggctgataatacttgtcgttttggacaagggtatggtcaaacactttagaatatttgattatgaatcatttttaaaatatttgtaatagtgactacatgtatagattggtcttaaaaagtactttaataagatcatatatttgttaacacttttttacatattacaatagaaaataatagtcaaagttgttttttttaagaccgtgcccttataaaaaacgataagtattatcaacccggagggagtacatgaaagacatatacatgtacagatcaatccatgcacacctccactccactcgccatgatttgaattctgaaatatattgcgtgtttcgttccttttgattttcaaacatacaatattttttactgctaagaattggtcattgccaaaattttatttggcaacgattagctggtatttcatttggtttgctatggatttgccgtgttggtcacttctctccatcatggcagtaattaaacagagaaaaaaaggatagattttaccaaaatattttagaatttggtcaagttaccatgaccttagtgacggtaagcctggttattgcgatggtaaggaacagaagcgtccaaattactgacattaaatcatttgagaattacaaaggaaataatcttggcctacagtggatctttcaagctcatctttgttttcagttgatctgcaccggacaaatcatttgatttgagtactctttaggtgaaaaatacacaaaaactgaggacctggttggaagacaatttttaattaggcccagacggtgcaaaggacgagcccaaaagtccaaaaacctgcgtggatacatgggccgaaatccatagcaaatttagtccagaggcccatccggcccacattaccaggggccatatccctctagcttttggcttcaattagcgttgctccaccaccattgctcagtttgttactgaaagtctgaaatcaaatctgctcgcaatctgccttgttggtagtcttaacaatgtagaatctttaagaatattgtgcaaacggaaatctgtgagctttgtgatgaataaatggaaacggcctttcacatatgcattgggtgtccttttgctcgttccttctggcaagctatgtaataggaataagtttactttgaatcccttaaaagtgacccgaatctaatccatgaccctcaaccgcaaaaccggacatgacgactccccgaactattaaaaccggtgcaatttgactttctcgacagttttggagggcagtttcgctgacgtggcacatacgtgacggtattgacctggtcttccttccacatggcgctaacgtggcagttatgtggcacttgaattttaaaaatatgtgtgggacccatatatcattcacacaaaagaaaaaatatgggacccacgtgtcatgcatcctgtctcttccctccttcctcctccctctgtcccttctctttctttctctcctcacgccgacgtcatggagcctcgattccccgtcgtcggcgcctccacctcgccactggtgacggcgtccacgtccctgccccccatgtgggggcacctttgcccctcgccgctgcagtagctgcaagccagcgctgatgaagtcacggcggtgtgatgaagtccgcttttgctgctccagatctgctgctatttgcttattgcttgatgaagcctagataacgatgaacgagcttgcggttgttagctcaacccgacaacaagctactgctgcttgtttgcttgagcatgaactaaaccaaaagaaggtttgttgtgctgttgctgctactacttggcgtaggaagaagaatagaaggtccacctcggcaccgccggcgccctcctgtcatcgtcctccccgacccctccttcatggattcacgccggcgacctcctccgcccctagtcccctcggctccgtgtgggtctccagcacccacgagcggatctgagacccacggcgccgtcttcggcttactccgctgtccacgccgccgctggcctctccaccgtagtcacctccaccggcaccgcgtagatcgaccttcttccttcggagcacagtcacggcctgtgtcaccgccatggggagcggcaggaggagcaccgtggagtgatctgacaccaacatgtagcgtcagctctgctaccagacgccacacggtggccgaacgggaggcgccgcacttggccatcttctgcccgagctagagcagctgggcggctagattcttcgccacgagctcgccgaacccctcatccaacgcggcggcagtggtggccgtcggcctccaccaccacatccgttcgcacagcgcgcacgaccaacaccatgcctggccactcccctcgacgctggtcatgagacgcgcgcaccgtcgatcggggaggacgacaccgggagggcgctgacggtggcgacgtggagacaccgacgagaaagggagttagagagaagggagagagagggaggaggaaggagggaagagagaggatgacacgtgggccccacatataccagtgggtcccatatttatttttttgtgtgaatgacaactgggttcgacacatattttttaaattcgggtgccacgtaaccgccacgtcagcaccacatggaagaaagaccagatcaataccaccacgtatgcgccacgtcagcgaaaccgttctccaaaaccgccgagggagtcaaattgcaccagttttaatagttcggggagtcgtcctatctggtttgcgattgagggtcacagattagattcgggtcacttttaagggaatcaaagtgaacttattccatgtaaatactagcagcgatccctgatatggcaaatctagtaagcttgcagtagggcgggcggcggcgacgcttttagcgtcgtttcttccttgaaggcgtcgtttagaagacctattcctcagaggtgttgtgtgctttttctgtatttagtagtagggacagacgtagacgcatggtgtggttgtttattttttcctgagtatagtttcccaagactatagacttgtattttattctttctttatcaatagaaattagaaatgtcacactttcttttacaggttgtttcaaaaaacagtgagcttacagaaaccccatggcgtcccaaataaacattttcaggtcttctaccttctgtgtttctgcggactatgcaatcaccaacactacatggtttttcgaggaatgcaaccatcactcagctgtctggtaaccaaatgcttggacgatgcaacgctttgggctgaaagactcgatactaatgatagaatagtggtttcctcttggaaggaagctctttcctcttctattcggcgttctgtaatttgacgaactacttgtatctttctctctgtagttgaatgaaattcaggtgaggaaactctccccatggcgaccattaaaaaaaaaaactgcccgctaatcaattttatcaagatttagataatatcaataaaaaaacaaatagttgaggatgtccccaaccctaatatatatatacaacaaattgataaacatgttggatgatgtactactaggtgaataacgcactatcacagttcttttcaggctacaatggatcaaactattattgactcttctgaccactatatattgcattcgcagactgtaaggctatattcactggtggagaaaccctttttagtcccaattcacaaccccctgtagtcccggttatgtaaccgggactacgaatctgggactaaaaatatctatttttagttccggttgtataacccggactaaagatatctttagtcccggttgatgttaccaaccgggactaaagatttagtatcttcattgtttagttcttcccaagctctgaaaatcatctagcacagcatatatatctttctttgcatcctgactcctgagagcagcatgaacgattttcatttatataaggaaaaaaaagtacaaattacccctgaactatcgtggtcgaccgaattaccccctaaactcaaaaatcagacattgctcaccctaaactttcaataccgaacaaattacccccctcgacctaatctaaagtggttttgtcctatgtggtgtacacgtggcaatccagtcagcattttattttttaaaaaatagtgggacccacttgtcataccatatcttcccctcttccttttcctctctctcaggctcaaagcgtgcacggcgagcggcggcgcgcgggggaggacaggcagtcggtgcgcgggggccggcgatgggcggtgacgtgctggggcggacgggcggtcggcgcgtgtgggccggcggcggaacacggggagggcgcggcgggcaacaggtggcgccgagcaggccaggagggtgttggtggcgacgggctacggcgacaagtccaccaccctctcgagctccacggctatggcgacgaggcgacgagtcctcggctcaggcgggcgccgtcgaggtcatcgttccagtcggaggcggcggagagaggtgcgaagaatcttctccggttccaacggggagtcggcgggatccatggcctccctctctctctctttctccgctcagtcaggcggcctgcgatgaatcctcctcggggagggcgtggcgagcggcgcgcatggcgcggaggacacggtgggcggcgccgaggaggcattggaggcggtgcgctacggcgacgagttcgtcgagttcgccgcctgtccacgtcgtccccatcgaccgtcgtcgcttgtcgaaacatgcattcggcaataataaaagggggtagcgcacgagacctaaaagtggatggatatggagacaaaggatctagacaggttcaggccctctcgatgagaggtaataccctactcctgtttggggatttgaatccgccgggtgtagtatagatctgacgatctagttgtctcatgccccctagagggcctcctgcccaccttatataggatggggaggggggcaggattataagatagaaaccttaactaatacggtatcggtttcctaaatctactttacaatcttatcaaaccaggactttaggccgttccataatatacaagaaaacgtaatacccaagtaatgatccattacatatttcatagatataagttatcccctatatcagtcagataaccacgccgtgtgggtatggggtacccataatctccacactagcccctgagaccttcacagtcgaaaagataatcttctctcgaaccagattactccaaagccgagtgcttcaatcatctttgccatggtctcccgagtacttttaccaaatctgaagactgtggagggctgaaaaataactgaatgtaaacttaggtgcatcgactagatgcacctaataggtgtagctcccgactatggggttaattgaataaaccaagcatatagtcagggaataaataatccaaccaactgagtggtttttgataaatatagtcaaccaagtgacttgataccaatatatagcatatgcggtgtgaaatgctgaataatatgatccaagtgatataccgactgctttgtagaatatgatgcgtgcaacctaaagttgacaacatctttgaaaattcacatagcaaaatgctataaagaagcttgtatgttgtgaataaagaaatttccaaagtattgggcatacgccatgcgcacactgctttaacagatgtgcttaagtccctaaaagacacatggcttcaccacaccaagaaatatacggcatatgtggtgtaaaatccaagtaaataaactcataaaggatttaccatccgcctggaaaatgaccaagatatataatcagcctaagccttaatattggtcaataaaaatgcacacttacatggcaaaaagcaacgatattatatccaatcaattgcttaaaaacccaaacagtaccttaacctatataaaaaagtcagcggggcagctatataaagctttactgtttgacaccttttaagatgcattgtaccaactactaaaaagttgagtaactacggtacaaaaggattttaaggtattgggcacttgatcacgcacactttgccctaagcaaaaagtgcctaagtccctaaaagaacgtgataggccacacctaaaaatatgggttgcagaacatattagccctaggccaaaaaatatgccttcgacaccctttaaaggatgacgcatgtaacatgctcccgagtaatatatcttccgggtgatatagaccaagtgtagctcatatgaatagcttatgatctgagtgattatcccttatgggatactccaaaatagatataataattgaatcccgactagcgcaagtattcggttgataacccttacgagaaataataaatagtccagtctttgagcatagaaaatagacccatgatcatgaattcatgttgcatgtatccggaacaagtccaaattgaaggtatgatacttgtgtttgagctagtaagcccctgagcatatagcttgtctttctgtcgtagtcataattgtccattgatggtagccgacgcagttggcatagagacaagatgaccaatatagagataatattgcccaccagaggtggcaaaaatattggtggtagtgaagatagtgataccaatcaaaagtgatgaagttgcacaaccgtggaggcgaagaaaccagtcggcagcagtcaggtcagccagcaatgaagatgaaggcgcccagcgattgagttgtgtagccatggcagcgaaataatcagtcggtgacagacgaggcagctggtgaagaagatgaagatgcccattagtggcgacataataagccatccgtgaaggcgaggataccgatcggtggtgacgaaagtaagtcgatggtgatgatatagacacgcattaaaggcgatgacgaaatccaccaatcatgaagatggagaaaatagttggcaaggacaaacgcaaccgacagtaatgatgataagtaacaatcatagatgatcgactatgataacgaagttgcccattaaacagcagtagaataggctatgttgaagaggcttgacaggatattgatgaagatgacgatgtcggtgatccagtcaatagcagtgtagcaaccgatgataatgacgaagacgatcatcagcgtttgcatagtaggtcaactgtgaaggcgaaataacaagtcggcaatgacggaagcaacctgaggcgaagacgtagtcatccattagcaatggcagagatgtcagggccgatgaagtagaggtgctggtgatgaagtccatgacaataatccatcaaactgttgagaagatatcgaagctcaagtagttttcttgatgtgtgcataacaaagattgatgcaacaccccttgatctgtaaagatggcagtagaacttggaattgtagctgttgcagattcttcacttgaaggaaagtaaatgttgttgtccaacttatcgaaactgagctgattggttgataactctaaactcccggacatgtagatagaatctcaaacttgatacttgaaaaatttggagtagattatggcagcgtccagaaaccaaaattgccggtgaaataattggagttgctgaagtagaatgtctgctccgaagcaaagataaacataatgactcctggagttgactcgttgactgattaattgatttcttcagcttgtcgaattttgagagtcttgtatttgtgtagcccccgactctttggttagttggaaagcaactgaacatagagtcgagaactatagcttcttgtcatcgagtagccatcacttgagtgaagatatgtattgaggatgtccgggtagaaatcttgaatactggaacaccatttgtggtaataacatggcatcatatttagtgatgcatgccgaaatgtcgaagctcttgtagaagtcatggctagtgaagtaacaaaacttgcgaagtagcggcaatagagtttgccggtgctgaagacattgaagatgaagtagctccaccatggtgacaaagttgcacagccgtgataaagtgaacacgagtcggcggtgacagaagcaaaccggtagtgaagacgcgcagttgtgaagataataacaagtcggcagcggaagaagtagaataatgatgaaaaggaagacgtccttgagtggcggcaaaataggccagccgtgaaagtgaagacaccatgagctgcggcgaaggcaaaccagcgattacgatgacgccagtcaatgatgacgaataagccagtcggcgtcagacaaggcgaccagcaatgaagatgatgacgtccatcaatagtggtagcggtataaaccagccatagaggcgagggctctggtcagccgcagacgagacgaccagcggtgaagacgataagaccaatcaacactggcataatcatgcagccgtggaagtgaagaaaccagtcagcagcagacgtagacaggttgcgttgaagatgatgatgacgcccatcaacggaggcggagtccactgtccttataggcgagaacaccagtcggcgacggcgaaacgggccaacggtgaagtcgtagacccccaacaaaggcggcataataggccagctgtgcaggcggagacaccagtcggcggcggcgaaggtgagccggcagtgaagacgtagaggcccaacaacggcggtgtgaccaaccaaccgtataggcgaagacaccagtcggcggcggacgaggcggctggtcggtgaagacatagacgcccaacaacggcggtataataggccagccgtgcaggcggagacaccagctggtggtggcgaaggcaagccggtcggtgaagacggagacgcctaacaaatggcggcataataggtcagccgtgcatgtagagacaccagctggcggtggcaaaggcaagccggtcggtgaagacggagacgcccaacaaacggcggcataataggtcagccgtgtaggcggagacaccagtcggtggcggcgaaggcaagccggtcggtgaagacgtacacgcccaacaacggtggtgtgaccaaccaaccgtataggcgaagacaccagtcggcggcggacaaggcggccagttggtgaagacaacaacgcccaacaacggtggtgtgaccacccaaccgtataggcaaggacattagtcgatgacgacgacggcaagccggtggtgatgttctgactgatccattcctggagcgtaggagataagcttaaagccatgaatcccttttatgcatatctggatctggatcctgcagaacaaacatataggatgagtagtatctgatgtaaatataatactcgatgaaaattcaagtattttaaaatgtttataaatatgtatttctcctctcgtcaattttgatttccacgagcagatgactcattacgtttaaacactctgcccgactagtcatagccaccaagcaccgggagtcggcctaggcacttcccaaacatgcatatgagtgacatgagttcatcattaatggaacaaagtttcacggatcagaatttactactcgggtacttttgcaattattaagagcagaaaataaatttatcttatctctatgcttatgatttatttcgagtaatacttagcaccttgagttactcggtccatccaacgagcccccgggtgctaggaattggcccatatccattgacaaaccaaacggaaagcataggaagatagaactccataactcgatcgaaactttattgttactcggattattttgccagcaatcaagataaatattatgaaaaattgttaaaaaatatgatatagtatctgtagcccccgactcactagtcaacggcgaaccatttgatgtagtgaggcagaggaaaaggaaaatatcatataaagaaaagtaatgatgacttagcttttttttatctccctcggtgacgatagaggtgaccgatgtgggaaacaaagtcatccatcaatagcaatgaagaaaccggacagcagtggtgaaggcaagccggtgtagatgacaaggcccatcaacggccgcggagtctgtcaaccgtataggcgaaaacaccagtcggcggcggaagcaagccggtcggtgaaagcgaagatgcccatcaacgatggtgtgaccaaccaaccgtataggcgaggacaccagtcggcggcggcggaggcaagccgacggtgaagacatgtacgcccatgaacggtggtgtgaccaaccaaccgtataggcgaggacaccagtcggcggcgatgaaggcaggccggcggtgaagtcgttgacgctcaacaacgatggcataatagaccggctgtgtaggcggagacaccagtcggtggcagcgaaggcaagccggcggtgaagtcatagacgcccaacaacgacggcataataggccggccatgtaggcggagacaccagtcggcggcggcgaaggcagaccggcggtgaagtcgtagacgcccaacaacggcggcataataggccggccgtgtaggcggagacaccagtcggggcggtgaagtcgtagacgcccaacaacagcggcataataggccggccgtgtaggctgagacaccagtcggcggcggcgaaggcaagcctgcggtgaagtcgtagacgcccaataacggcggcataataggccggccgtgtaggcagagacaccagtcggcggcggcaaaggcaggccggcggtgaagtcgtagacacccaacaacagcggcttaataggtcggctgtgtaggtggagacaccagtcggcggtggcgaagacaggccggcggtgaagtcgtagacgcctaacaacagcggcataataggccggccgtgttggcggagacaccagtcggcggcggcgaaggcaagccggtcggtgaagacgtggacgcccatgaacagtggtgtgaccaaccaaccgtataggcgaagacaccagtcggcggcggcaaaggcaagccggtggtgaagacgtagacgcccatcaacggcagcataataggccaaccgtgcagacggagacagctgttggcggcagacgaggcggctgatcggtgaagacgtagacgctcatcaacggtggtgtgaccaaccaatcatgaaggcgagaacaccggtcgataacgacggaggcgatttgataaacaaccgccattcgggagtacatgcaaacgatcaacaaaccattaatagattagtacaatatatatcggtgcatgcatacatgtttgaatgtagatgattcgatataagttaatcgtaggcttttgggctgattctgattggcgtatacatgtactccagatgcagatccatgtgttcgtatgccagcccaagcatatatatatttgtacatatatccatgtacagcttgtaatgacttgatgacgtggccgttgagcctccatagccgaggtggagtacgcacgagtactgcccaaaaataatctatcgcttggcatcgacggtactgtcaaaaaagtattgctagaacaaaaaagtaatgctagaacagatcaatctgcaattagaaataaatataatatatatggataagaaacgaaaaactcggatcgagcaatgaggctgaatcacgagtgacagccgacgacgcgccatgcagcgtatataagcccctgtagccgacgacagcttgatattcagcactgctccgcgtgcagggacagctgctggacaacatgatggtgttcggatcggcggccggacgtgcgaggtcgccgaccgcttcgccttgatctcatagttgcaaatagtaatgaaaaattaatctgataaaagtttgatcggaacggcaaacccgagtggaaaattgaaaccgtcgaacttatcgagatcaatctcatcacatctctagaaaaattggttccatcgcacttctcgacggaaaactcgacgcaacccctacctagtgcgccaactgtcgaaacataaattcggcaataataaaagggggtagcgcacgagacctaaaaatggatggatgcggagacgaaggatttagacaggttcagaccctcttgatgagaggtaataccctactcctgtttggggatttgaatccgccgggtgtagtatagatctgacgatttagttgtctcatgccccctagagggcctcctgcccaacttatataggatggggggcaggattacaagatagaaaccttaaacaatatggtatcggtttcctaaatctactttacaatcttatcaaaccaggactttaggccgtttcataagaaacgtaatacccaagtcatgatccgttacatatttcatagatataagttatcccctatatcagtcggataaccacgccgtgtgggtatgaggtacccataatctccacatcgctgtcaaccggagccacacagccgtgccatcgatttcccctccccggccatcgcgcccgccgctgctcgccgccgcttaagatgccacctgattcttctcctgctcctggtgttccccgcttcgttgctgctcctgtaaaactaccccgtcacaccggcaagcagcacacatctgtacaacctgtacatgcatgtacaccgttcgtcgattcaatttctctcagaattcttccgtgacattgccacgggtagatcgcgtcatcgccgcgagcagcgtgccagcgtccggccatgccgatgccaccctcgtctggtgggtggcgtgtgatggcgacgcccgagcgagctagccgagccaagccgagccgccgcttgccgccgcacttcttgcccccgccgccatggatgaggctactgtggcggtgcatggggcagacggaagggtcgtcgaggaagggttggcgaggatggacggcctcacgctcgagctctgcaatttttccccttcccttctctgcttctctcgttgacgcggtggaggcggcgaacggtccgtcgtcctggtcgtcggcattgtggccgtccaaccatgtccgccggcgaacgcaaagcaagctcgggcgactggtggtggaggcggcgagttcgggcggtcggcggtggaggcggaggcagagcgcgtccttggctcgccacagccatgtgttctctcctctgctcacggagagagaggcaaagaaggagagaaaaaaaaacactgacaagtgggccccactggtttctttatttgtttttgctggctgtatcgccatgtgtgtgccacgtaggtagtaaaccgctgcgatccgtgttaggatggtaatttgtcgggttttaagagtttggggtgtcaaatgtccggttttcgagtttaggggggcaaatcggttgaccccaatagttcagggagtaattcgtaatttttcctttatataataataatccttgtaagaggctggcgtagcaatgcccgctagctgcacatgacgtgatagagttatttggcatttggccacgccaggcggccaaaaggttcagatttacaaatacgttttggaatggtctgttaataaaattaaaaaaaataaaaaagtctaaaaaaaaagttttcagacataggtgggtggcgctcaagtaaatccatctctggttaattactcgtcgccccaacgtaacagaaagaatgcaaggaccaggcacaacatgagccccaggctagtaaagccatttctaaccattcactgttggcacatgattagcaagccatttttttttagaattacacagtacaatgcaaacactcacaacgcacgcgcactcacccctatgagcatcttcgaagactgggccggcaaattctggaatttgctgttaaattctagaaaattcattcccatgagaagtcgaacccagaatctcaggtgctactgagactcttgtaaccagtatgctacatgccttttcgcgaatagcaagccattttgcttctcctagaaatgagcataaaatgtatttttccccacctgcatgttctcaagagactattactagaatacacagagtaagactgatactgatgaaacaaaaataacagccacacaacacaataatttgctgcctnnnnnnnnnnnnnnnnnnnnnnnnnnnnnnnnnnnnnnnnnnnnnnnnnnnnnnnnnnnnnn

SEQ ID NO: 26495 - DNA, 2774 bp, Oryza sativa
  unsure (1)..(2774): unsure at all n locations
nnnnnnnnnnnnnnnnnnnnnnnnnnnnnnnnnnnnnnnnnnnnnnnnnnnnnnnnnnnnnnnctagctgcacatgacgtgatagagttatttggcatttggccacgccaggcggccaaaaggttcagatttacaaatacgttttggaatggtctgttaataaaattaaaaaaaataaaaaagtctaaaaaaaaagttttcagacataggtgggtggcgctcaagtaaatccatctctggttaattactcgtcgccccaacgtaacagaaagaatgcaaggaccaggcacaacatgagccccaggctagtaaagccatttctaaccattcactgttggcacatgattagcaagccatttttttttagaattacacagtacaatgcaaacactcacaacgcacgcgcactcacccctatgagcatcttcgaagactgggccggcaaattctggaatttgctgttaaattctagaaaattcattcccatgagaagtcgaacccagaatctcaggtgctactgagactcttgtaaccactatgctacatgccttttcgcgaatagcaagccattttgcttctcctagaaatgagcataaaatgtatttttccccactgcatgttctcaagagactattactagaatacacagagtaagactgatactgatgaaacaaaaataacagccacacaacacaataatttgctgccttgcacatcgatcacatagtacatagttttttttagacaaaaggcccagggcccggctttttaaagaaagccaaatacggcatcttcctgctggggttgccagcaaacatttttgtatcctccacgcagggaggcagaaacagggaaacaaagttcacaattaaaacatccaagagactgggcagataaacaacaagaaactctaagtaagctacaggagacaagcaaccccaaaaaccaactcttcggaaaccaaacagaaaacagcagcttcccagggacttctagtatcagcccacacccgtcctggaaggtctaagagtcgccaccatccgcttcatctcctccgctagtgtttccagtttagttgcctccccaggacgacaaagcttcttccactgcacaagattagaagttatttgaaaaaggatagcaaggggggaatacaccaacttgtccctgaaaatcatattattcctagtaatccaaagattccaacaaacagcagctaaaagactcagggtgattctaacagagcaaagatcaggagccccatcacacatcaagaaaaactcatcagagtttcttggtataaaattccagcgcaaagtgtctctacacacgcaccagacaaatctagccatgggacagttaaagaggatgtgattagttgtttctaactccccacacaactgacaaaattcagacccctcccaattcttcttttttagctgttcagcagattggatcctatctctaagagctaacgaaaggaaatgtttatgtttcatagggcaagggcaaccccacatcttagcattcacatccccaatgcctctgaaagttagtgctctgtagagtgatctggtagtgtatttcttgtttgcattcagaccccaattgagcttgtcatgtgtatcagagagaacaatttgatcaattatctctttaagatcattccattcctctaattcctcaggaccaaaagacctcctaaaggataggcagcctgggcccccctgacccacctgactaactaaaatctcttgttgattacaaactctatagatcgcagggaaaagggtcatcagtgggcagttaccaaaccaggtatctttccagaatttgacactcagcccattcccaatactccattctgcccccagcatcatccatcctctgatgttcagaaggcctctccagaactgggaaacatttccaattttacaggaaaagaaactctcattggtcaagtattttttcctcaacaactctatgcacagactcttgtcctctgaatccaccttcattatccattttgctaggagagcaatattcatcttcctagtttctgtaaaaccaagccctccaaaatcctttgggaaagccatatcttccaatttgaccatatggtatttccctctaagtttgttactagcccaatagtatctacctctaattttatcaaaactctgatggatcccctcaggaagatgataaaaacccatggcataaaaggggatggaggagaggcatgcattaatctggactgctctaccagcatgagataaattgcttccccatttggtcaacctcttctcaagtttctggcctaggaagtcgaaacccacatttaggatcttatcaggactaataggaagccccaagtatttcataggaaaatgacccacaggacagttcagcatctgggcaactctttcagtgtcaagctcactcatcccaatagagaaaacctcacttttatgaaagttaatctttaaaccagccatctcctcaaagcagtataagatgaattttgtggttacaatctgatgcatatcattggcaatgaaaaggactgtgtcatcagcatactggagatgagtgatccccagggaagatattagggactaaaccactaaggacacctctcttcttagcactatcaaacatggcagccagagcatcactcactagattgaaaaggaggggagagagagggtcaccctgtctaagtcctctaaaagttctaaaaaagtcagtcctctccccattgatgttaacac

SEQ ID NO: 26496 - DNA, 933 bp, Oryza sativa
aatgtggtttttcagattttcctttgatgttagttcagtgtcaccatccatcaaagaagtgatactacatctcttcttcctctcattagctatcctatgataatagtcagtgtttctgtctccctctagaatccattgtcctccacttctattatgccagtaaagctcttccatctcataaagttgttctaggttattttccaaagcatatctctcctgccattcatcaggtgataactcattttccaaagctttagcctctatcatttctaatttcttctgcagaacctgtttccctctgactctctcacagtgtgcattaatcccccaacccttcagaaatctccttaactcagcttgtttcttgttccaaaactccaaaatgtaggaatcatctcttgttggcattttttgggtaaccatctctttaaaattttctgcagctagccaagcagactcaaatttaaaatatctagatctctcaatgttaccctcacaggtatctagcaaaatgggaatatggtcagaacccactctcagaatagaggaaagaacagagttgggatacttattgtcctagtcatcagttactaaaattctatctaacacttcctgggtggggttatcttgtttgttagtccaagtaaatctaggaccaattctgtgtaattctctcaaatccaaaccagtaataaaattaatgaacatattcatgcatctgagatctaaattgccattggatttctcactagcaaattaatacatgttgaaatctccacccagcaggacaggatgtagtctgaactggatatgccaggacaactcatcaaggaaaccatttttcaaggtgttatcaacaggaccatagacacaaactatctcccaaacgaagttgtcctttttaatcttcaggacacaactaagaaaaaaagc

SEQ ID NO: 26497 - DNA, 863 bp, Oryza sativa
acgtgtctcatgtgttgggacgaggctcatgtgttgggcagtcacggagtgcgggtaaagtgtacatccactgcagtgtgagtaaaccaaatctattcgaatagccgtgctcgcgttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgagttttcgagacaaa

SEQ ID NO: 26498 - DNA, 2856 bp, Oryza sativa
ccacgtggcgcctggggtagcctcctccctctagttcggctagggagtggccaccgccctacctcgggcccgacccctctcgggggagggccacgtggcattggggggcagcctcctccctctaaacatgatacccccgggcccatatcaccgacagtagcccccggcgttagtcctaaccaaaacctttcccaggtagtcagggttgacgccaatctgctagtcagttgacatgtgggcccgatctcctttcctatcattctgggagttgggcggtgggagtttaatcacgttcatacgtcgccttaacttcccactttcctcccggtttccgaggcgctgtgggatcgggaatttagcccgcaccttaggccgtgaacttattacctatatatactcagcaaacgttcttatattctctcgggcccatgaccttacgccgcgtacctcgtttgcccttgccttttgttaacctctattcatgttctactttcgcgtgagtgtgaggactgaactttccatagccagcaatcttcacccgcgatcaagccaagctgggcgccgtagccagccggcggggccagagccaattgctacggaagagccagcacaggggccccgggcgtcgaggcgtccagagctcaacgcaaggctaggatagagctaggaatcgtagccccctcgcttttagcaaagaatcgtttgaatggatgaaccgaatacaaactttttgttaccaaggggggcaaacgagcgcgcgacacgtgggtacgcgggaccgcgaggaagagatgggagagagataaatataagcaataataattctatgcaaacgattatcttcgcgcgagtgcgaggactaaatttccatagccaacaatctttacccacgatcaagccaagctgggcgatgtagccagccggcggggccaaagccagccgctacggaagagccagcacagggggccccgggcgtcgacggcgcccagagctcgacgcagggctaggatagagcaaggaatcgtagcccccacacttatagcaaagaatcgcttgtatgaatgaagcaaacacaaaccttgcttgcatgtcacgacctttcaaacctttagctcgaagagggcctcccaccatgggttcctaacaattttgggaagcctgcgaccacttagcaaatgaggtgaggttcccacgaggctgtgtccccacactacacattctgtttgctctttcctttcagtggcctccttccaatatctctcccttttacacggacgactactttcgcacgagtgtgagagccgaaaaactctagagccagcgatccccgtccacagttgagacaggctgggcaccatagccagctggcgggaccaaatctagccactacggaagagccaacacagggggtcccgggcttcgacggcacccggcgctcaacttaaggcaccgagggagcaaacaaatgcgtaacacgcaagcgtcgcagggccatgagaaaagaacgtggggggggggaaataaatataagacttcaagctatattaagttgaagaattgaaaaattgaaaatacttgaagcttgaaaggacgattagttgagccgggccaggcaccgcagccagccggcgggaccaaagctagccgctacggaagagccagcacaggaggtcccgggcttcgacggcacccggagctctactgcaagagccctcctaggagtagaccgaggcgggtggcaggttcatgagcgatacccgcgcttggccctggagggccatggggaagaaattcgccttggcccgatcgtcacaccacaccgcctctatgatcatcgtgtggatttggagggactcgaaggggttgacgctaccgtggtacctttcggtgaggctaggccgaaactttgggagtcatcggacattccgaagaatcgccacaaagacctggccgccagccatacccggtgaagatgtggggggcctagccccctgcttagggtggcgcggaactcctgaggaggcgggcgccttcccccgcatttgcggcgcgacgcttatctcatcggcgctcgaaagaacctcaaaaatcacgaacgcgccccctacctggcgcgccagatgtccgagggtgatctcctccatcagggaaccgtgaggcccccctttttttgttcgaccgggggggcagcgggtgagatccgaggttttcgagacaaaagagacacaaggaatttatacaggttcgggccgctatgaagcgtaataccctactcctgtgtgtatgatgattcttttgtgcttgcaaagcctctgaatctccgatgtacaagctagggttagagaagctttggctcggggatccagagttcgatcccccttcccgctaggtatggtcctccttttatactctaaggggataccacatgtgctgcgagtgctacctaggaagaagggaaaatattctctatattaatgacatgtcttgtgccttagcttggaagccgcatacacgtcgtctcggtcgtggggcctaccacatcatgccgcctaacacggggggcgcccatgtcattcactatttaatgggtgaagacttccgggttctcgttcgcaccaggaaacgggaacccgggtcagttctgaccagggtaagaggctgtgaagcccctcattattatgatgggatgggacggagaacgccgcacgccgcctgacaaactgacagggcgagggtacacagccgccgtcccatcggtcattcgaccggtcacggacctgtcacagatcggtcacagatctgttgagtgcactgcacgccacattaaatgcggcgtggcgcaaccgctcaggtcgc

SEQ ID NO: 26499 - DNA, 12001 bp, Oryza sativa
  unsure (1)..(12001): unsure at all n locations
nnnnnnnnnnnnnnnnnnnnnnnnnnnnnnnnnnnnnnnnnnnnnnnnnnnnnnnnnnttgtttaaactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgaggttttcgagacaaaagagacacaaggaatttatacaggttcgggccgctatgaagcgtaataccctactcctgtgtgtatgatgattcttctgtgcttgcaaaagcctctgaatctccgatgtacaagctagggttagagaagctttggctcggggatccagagttcgatcccccttcccgctaggtatggtcctccttttatactctaaggggataccacatgtgctgcgagtgctacctaggaagaagggaaaatattctctatattaatgacatgtcttgtgccttagcttggaagccgcatacacgtcgtctcggtcgtggggcctaccacatcatgccgcctaacacggggggcgcccatgtcattcactatttaatgggtgaagacttccgggttctcgttcgcaccaggaaacgggaacccgggtcagttctgaccaagataagaggctgtgaagcccctcattattatgatgggatgggacggagcacgccgcacgccgcctgacaaactgacagggcgagggtacacagccgccgtcccatcggtcattcgaccggtcacggacctgtcacagatcggttgagtgcactgcacgccacattaaatacggcgtggtgcaaccgctcaggtcgccataaaagcgggtaggtgagcgcctggaggcggccagctaacccatcgcacgtggcgacctagagaggtggtcgagggagcccgacccctaatcacaggagagggtggccgccgccctacctcgggctcgatcccccctcgggggaggttcacgtggcgcctggggcagcctgctccctctagtctcggccagggagtggccgccgccctacctagggctcgacccctctcgggggagggccacgtggcattggggggcagcctcctccaactagtctttgggaaggagtggccaccaccccacctcgggcatcactcctctcgggggagggccatgtggcattggggggcagcttcctccgactagtctttgggaaggagtagccgccaccccacctcgggcctcactctcctcaggggagggccacgtggcattggggcgcagcctcctcgctctaaacataatatccccgggcccatatcaccgacaacacgagttctgttttatagttttcttgagggaaaccacacctattttatgttattttgttccacttttctctatttctcgatataattaatgaatcatgtatatttcatttttgtgttaactatgcactaataattatattactactactcgatataatgaaacatgacgtttcacttaccaaacgcatgagcagttaaagtaagtttgtttgagacttgacacttatatttcttttcatcttcatcatcaggtttgaggttaacttttaatttcgttaaaagttttcggtttttgaagttcctaccattcatgcctttttttgcaaggcttagttttggtttagtttacattctcaaatatcataaaagcaaaactcgcactagtatttagttgagaacgtacgtccatactccatattcaatttcccatgtatcatgtcgtaccaaggtggctgaatgatttactagcttgtggctaatcaatgcatttaggttgtgttctatattatatttcccaacttttacccatttgttttccgcgcgcacgctttctagatggctaaatggtgattttctttagaaaaatagttctataataattcatattaatctatttttcaagtttttcttacctaatactcccgcagttccatattataatatgccttttgttttctaaatcacaattatttaagttttatcaagtttatagaaaaacatataacaatatttttggcaccatgcaaatatactattaaaatatgtccagtattagatttaatggatctaattttgtatcataagaattgctatattttttataaacttgatgaagaagtttgacttagaaaaatatgaatgtcttgtaatataaaacggaggaaatgagtagctccattttaactgtggggatattatgcattaacttgtcttgcaagcatgtcttagttttacagctagaagaaacaaaggttacacaggtgtggcccgaactgctagtgatggcccgacagtgatggcttgttttgtggtagtgcatcatccctaggttccaaaaacatatttgtcaaaaaatagttactcgttcatccgcagttttggagtcagactgaaatccgtagccgatcgtgtgagcagcctgaaaataatttatgcttggaatgtcccaggtttgccaaatggatgtcgtcttcatgaaaaaggcaaaagcttgtatgccatatagcacaagggtgagtatcctatcttactataaagttatcccccactaactccttaagattaacatgcaaagatgccatatcatcatccactaacaagatgccacattatcatccactaatccactaattaacaagatgccacatcattatccactaataatcatcatatttaaacatcatgcaaacatgctatgtctttatagtttttataatttaagagcttttcaaatacaaacatgttaaattatcatccaacataattcacataatgtttcaatatacatctttattatgttttatgatatcctatatacttatatagttcatcctcacttagttagtgcttaaatgattaatctatggtccatattatctttctccttttttcctctaattaagtcatatcccatcaattgttttcagcctttagataattaatctacggtccacacacccaaactatctccctatttttattcttctataaagtcatactaccttactttttatgtttgaatcaccattctacatactatttaaatttaaattatcataaaccatattaatttacttaatctggtgttatctagctatcatagctatcttacacgttatttttttttattgttatcatattaaattctcgcagcaatgcgcggggtttcatctagttatctaaaaataaaagcacacgggtgggtgttgccacactaatggacatgatcactacatgtcaatgccacttctagttacgaactgttactaatgaaaatttttgtcatgaaatttttcaatttcggttggggggggggggggatgcgggggcttactagtttcagttccttgctcgaagccgtactaatgagttatccatggttatagcatgaaccaaccataatgactctgattgtacaaattgccagtttcggatatgaaaacatatagctttttttttacacgagagtatgaaaatttagctgtcgatgtgatttatggttggcagccttttatttgatgtcatttaaatgcctgaatcagtggttcaaatctcgaatagggagggttaaaagtaaacaatgtacatatcatgatagaattggtggtaatcacacatcagggagacttttcgggttcaaatcttattgcaacaaggtatgtgtttcacttgaatgaaaaaataggtaccaaaacttagagcctatctagctcatatagatggagcagtaatcgtggttttgcttgcataagcagtggtttagacaattggaggctcgaagctgactcctgaagctctatcttgtctgcaccagggggtatgctccaagtgaacccttgtagaagccttgcgaatagcatcattgtaattgaagtgccaagtgacacggcagagggcagccacgcctaccagcaccgaatgatacaaaccgcaactctggctcagctagcaccatagtactagtagcattgttcagatgtcgctctggtcgaaattcaagtgggttaacccatactctagggttccggccaagcccaattcggcttagcattacatggctatcctttggtatcaagtatccggcgatgatcgtgtcagatatggcaacatggggtggattgaacgggtggtaggggtgaatgcggaacgcctcccggatacatgccttgaggtatgtgaggttctgaatgtcggattcctcgacaagtctttccttaccgacaacgacatcaagctcgtccactgccttcttcataacatttggattgtttaccatctcggccagtgcccactctacagcattcgatggattgtctaccgttgcaataattatttcctgcagccataagattaaatcacaggtgtccttactttgcatcgtggggacatcattacttatcgaatacaatccaaacttttggaaaattggaaaacaatattgattatactgtggcgtctaacgagcccacaacaattacgtctatacctaccaaacaaattaaatataagtgtaatccagtgatgaacaatgcgatattgttcatagttttgatttatctcttcgtttctcgatgcacgcgcatgggttaagttcagaatgagacagtaaacatgcattatactagagttatctgttttctttccaacattgtcataagtatttaaagtgttatctagatgaaatcattgattcttaacttcaaaatgaatgaaaccacaccataggatcatgattaggtataacaagccagcacctcactgagttatattccatctatgtcaaaatataagcatttctcgactatgacatttataaaaatatacaagcatttcatgaatactatttgttgttttaaccaagcagcattcaatttttttcccatcttattccccaaccatcccatattcataagagaaatcaaagtttttttctactcaaggtttcctcaaacctataagtgcttatattttactacctctgtttcatactataagttgttttgattttttggaaaaaatccaaataccaccctaaactttggataaatccatctagcactctaaactttaataccagacatctaactccccgaactttgtaaaatcgctcatattaccccctaatatggttttggatggtgattttgcatattttggtagcttaaacaaagaactttaaataaccaatataacatatttggatatcatcagttgtaagtcatcaatttatacttatacggtgataatatattattattatgtaggtacttgtttataagagctaacaaaagctaacaattgaaaaaaagaaagatttaagctgagattttaatatatatgtctaatgtgtatatcacgtgatcaaacttatccaatttatatacaaaaccatcttaggaagtaatatgaacagttttgcaaagttcaggggggttggatgtccggttttaaagttcagggtgctagatgaatttgtatctaaagtttaggggggttatttagactttttccttgattttttaactaagtcaagttctttagctttcacaaaacttataaaaaaataatagcaatattattaacataaaacaaataaactatcaaaatatatttaatgttagatttaataaaattaatttggtgatacttttttttatattttctataaactttgtcaagttttcaagaagtttgacttaaaaaatcaaaacgacttataatataaaatggagggagtataacacagtaagcaatacacaataatactaacaaataagaaacatgatacgccaatcatttagcgtgcgcagtactacactttgaacaaagctaaccgtaagcccgcaccatttgttttttaataaatgacgctgttaacttttgaatacattttgaccatttaatatataagatataaatcatgcttaaagtactttaagtaataaaacaacttacattatagttatgtaattttttaataagacagatagtcaaacgtgtgataaaaagggtagtactacataaattggtgacagtgtaatagtatcctttgttataacgaatcaacacctcactaagtaactaatatgccctccaatccaaaatagtagcacttctagggtttaatgtttataaataaatgtaagcatttctagaataagtctatgtctatgaataaatgtatgcatagtagcactcatatcgggtctattgaagaaagcaatgaggttgaaccatagtcactaaataagtctatgtgaacatggaagttcagaattaataggaaatgaagtggtgaaaagcgacggtttatttggtcatgggaaagactgatattcttctactatgaatgtattaaatttggctatatatattgctggcaaaaggcatgaatgaataaatgatatgcagtttatgggttatgaaaatccatatgaagttttcgctagaaagaaaacaatttcgcaacatatatgtaaatctcataataatcagtgtcatgaagcacactatattatcatgaagagaattgcaagactcgtagaagagtttatgatgactcacaaagagtttttctcctagaagtgagaatatttctcatagcagagaaattgacttccggaagaacaagttgatccttgtaggactacgctaatgtatgaatcaccggttaatctccatataacatcgataactcttactcccataaagtggacagacccgttcaaacgaatgaattggaaaatcacatccactagcatgcaagtggattggtagttttctacatactatgaaggtgtaagaatttatatatcatgaagatatactaatcaatggtatttggcaatcttattaattcccctaatgccaaaatatagaccggtttatgtcactctaagtggtttaagctaattgttgaagattagtgaaacaatcaaattggtaatgattgataaatccactaagagaaagttgcataatatttaatttcttgtattgagctaattattttatacataccgcatatgtgtatcgttgcaacttattttcccatagtcctccgtaaggataaaactttgtttgtactgcacatttgaataagtggttatacatattgctcctatacgttgatttatttctcatgttcatagtagaacttatgaaataagtaaacgaaagattaaacattgtggtaattttattttcattattttacacattaataaaaatgtggttatgacattggaacatggaagtttcaacggatctcttcttgagggggagcatatatgctaaacattgattatcatacttaagacttggaagtcttatttttgatttaccaagaattaatcaaattaatcattgttttgataatttaccttgaaggttactaccgctatattgttgtgttaatccaagttgattaatataataaagcatatagatcattagctatttatgaagaatagtcgatcttaaagattatgcgatcaagaatatttctcacgcaaggtttttaatgaggcaacaagtgcaatatattctcctatccttttctcccactaggtttttggatggagtttttaatgagacatgtgtatagcgcggtattcgtccaagggggagtgttatgaaactattatctcctgccagagataaatatgggctcataccaaatatatggatacgtatcctaataggtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaatgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttcccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaactaggaattatccattccatactaggagtcaaattaattatcacattattaacattgatgagtagtgtgaaactaatcacgaaaaacattgctcaacccgcccataaccacgggcacggctattcgaatagttttactctggccagaggtgtaccactgtacctacaagacacgatttcgcacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttcttgccacttctcagtctggcgcactataatgaatcacgctatacaaaagataaagccgttgcccatcctggcttgtggttggcacggtaaatgtttcacaacagtagctcgcgagccggtccttaattgccatgagcacaactatcaaaaccatatgctcacaacccaccttaaccagattttaattatcaattaattaacatcacacgattaatcatcatgagctaccattaaatataaccataattaataagaataatataatataatttatatttaatcccctttaattagctaatgtttctaagcatagctaagcaaacttacatatagcatttagctgaaccaatccaatatataaggttcatgctaatcaaattataacccataggaaaataagatcatcttcggccattaattaacggggaaaggttcaccacccgatgacattcaaaaataatgcatagttgaaataaaataatagctttaaatgggttcaacatgctcaaagggttgtttgggatctgtgtgacttgccttgggcttccgcaaacacttccgaaccttgctcaacgaaaacgctctcctccagaacgtcggaaactaaagcgaaagaataaaaatcaacaaaacagtacaaaaacaagcataaacagtacatgtgaatatttttaacatatagatcttgattttagaaaaatttagcaacttgaaccactcgaatcggatctacagttatttagttatgattttccgaagatttaatctattagaaaaaactggaaaaggagaagatgatgatgtcatgctgacatcatccatggcgaccggctcggatggcgacctcgccggagctagggtggtcggccgggaaaaaggagggcatgtacacgtagaggacgacgagacgaacccaacggtactcaccacaacgacaaacgacgttggacgacgaccggcgacgagaggggcgacggcggcggctcggttgaccggcggcggaggagctccggtggccggcgacgacggggaaggggcggccgggctagccctcggtcacgcgcacccgccggcggcgagaggaggcagcggcgacggctagggcgacggcgcagcgcggctgcacgttgaccggcgacgacggcggcttgcgcgacgcggcgacgaggctacggagcacgagagagcacgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccaattcttaggggtaaagatagaggaggataagaggaatatttcccctcaactaattttgcaaacggagctccggatgaggcggatttaacggaggaagcggcggctgcgcagggcacagcacgggcggctcggctctgtccagagctgtaagatgaacagtgccagggaggtaaattagacttttggttggctgagaacagaacagggcacttgacttgggccggcttgggctgcacagcacgcgcgcgacggagagagaagaggaaggaatgggccgaaaagggcccaagctgaggaggaggatttttattacttttccaattaaaataatcacttaaatgatctttcaattgttaaaaatacttcctatgctcaaataattccaagaaaaatcttgaaaatacttggacactcaaagtacttaacaaaattataactagaccatttaattattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacaataaaacagttaggtaataattaattaatattaatccaacgctatacaacataccctgttgcataggcccaatcattctgaacaaccatcccggctgtacagttctatctccaaaccaggagctaatcaaattattaccagttatatcatcttttattatgatgagaggtgtgagactaaacacgaaagacattgttagacccgcccataaccgcgggcacggtattgaatagttttactctggccagaggtgtaccactgtacccacaagacacagccccacaacatgtcaccatgtgccttaataccaccacggtacctcggaaaggagctgtgacagtacccctcgcacaacacaatcaccacagcgcacctttctggatcataatcaccccctttataacaaggcatggactccccaccaaccccggtggcttatcttcgccacttctcagtctggtgcttcccaatgaaaccatgctatacaaaaagtaaa

SEQ ID NO: 26500 - DNA, 14148 bp, Oryza sativa
  unsure (1)..(14148): unsure at all n locations
cctcaattgatttcaccggagaaggaaagttgcggccgaatttggaaaccgccggcggcggcgcggtgctagggtttcggccggaggaagacgacgactccgacaggcgggacccacctgtcagcggcggcgagctcgcgcgggcggctgctgctgcggactttgccgacttgggcctgggagagagagagaaggttttgggccgactttcggcccaaagccaaaagagacttttaaaaatctttttcaattaaattattcatgaaatgcatttccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacaaacctaccccccttaaacagaatctcgtcctcgagattcggaagaactggcgaacaaatgcggatgagctgacttcaattcatcttctcgttcccaagttgattcttctttcgagtgattactccattggactttgcaaaaacggataactcgatttctggttcttctctcatctatttccaagatacggattggtttctccacataggtcagatcctcttagacttctatctgttcaagattagtttcttcggtaggtactcttaaacacatcttcaattgcgacacatggaacacattatggactcctgccaaagattgaggtaacttcaactgataagcaacctctcctcttctactgacaatcttataaggtcccacaaaacgcggtgccaattttcctttggtgtgaaaacgatgaactccttgaagaggcgtgacacgaagatacacataatctccttcgtcaaaactcaaatctctgcggcgattgtcggcataactcttatgacgagactgggccacacgcaatctttcttgaatggttttcaccttttcttctgcttccctcaggatatccgtcccgaaaacctgacgttctcccgtttgatcccacaaaagcggagtgcggcacttccaaccatacagtgcttcgtaaggagccatctgaagactagcttgataactgttgttgtacgagaattccgcataagtctaaagcacaagctctcaacatgtcttccaaaatctgatttaccctttcggtttgtccgtctgtctgcggatgataagcagtactaaagttcagcttagaacccatctcttcctgaagcttcttccaaaactttgaagtaaactgactgcctcgatcagacactatcttcttagggacgccatgcaaacacacaatcctggccatatacaattccgccaaccgacttccagaataagttgtctttactgggatgaaatgagccactttggtaagtctgtcgactatcacccaaatagagtcatggcctgatgacgttctgggtagaccagtgatgaaatccataccgatttcctcccacttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacattttggtactaccagggtgaatggagtataaagtatcatgagcttctttcagaattgcatcttttaaatctttgttgtcggggacgcagattctctcacccaaccatacagttccttgctcatcctacaagaaaccgatagcttttcctcttctcatattctttttgatttcttgaatatcagaatcattaatttgggcttctctaacttgatcaattagagtgggcttcgcttctaaggctgcaacgaaacctctactgacaattcccaaatttaacctttcaaattccttgcataactccaatggcaactgtcatccttccgtagcattgcaatagcctttcctgctaagagcgtctgctacaacattagcctttcccgggtgataatgaattcccatgtcataatccttaattaattccaaccatctccgttgtctcatgttcagatccggctgagtaaagatatattttaaactcttgtgatcggtatacacctctgtacgagtaccgaaaagataatgacgccaaatcttcaacgcatgaactactgcagctaactcaagatcatgagtagggtagttcttctcatgcggacgtaactgacgagatgcataggcaaccaccttcccatcttgcatcagaacacagcctaatccaagtttggatgcatcgcaatacacttgaaaacccttctttggatcaggtaaaatcaaaataggagctgatattaagcgattcttcaactcttgaaaactctgctcacattcttctgaccacttgtacttcacatccttttgaagtaatcgtgtcattggcttagcaatcttggaaaaattctctatgaacctctgataatatcctgcaaggcctaggaaactgcgaatctctgaaactgtctttggttgtttccagttggttacggattccacattactaggatcgacggcaactcctcctgctgagatgacgtgaccaaggaacttcacttcagacaaccaaaattcacacttgctaaacttggcatacaactgatgttctcgtagcttctctagtgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataccagtacattcgaacaattcatacctagtggtaaaagctgtcttaggtatatcttcctcgttgattctcaactggtgataccctgatcgaagatctatcttggagaaaacggtggcaccttaagctgatcgaacaaatcatcaattttgggcagcggatacttattcttgatagtcacatcatttagtgcacgatagtccacacacatcctctaggtatgatctttcttttccacaaaaataaccggagctccccatggagacgaactcggtctgatgtatcctttctgaagcaaatcgtctacttgcctcttgacttctgccaactcattggctgccattctataaggtctcttatggatcggagttgttcctggtaccaaatctattctgaactctatatcccttttgggcggcataccaggtaaattgtctgggaacacatcaggatactcccggactacaggaatctcatccaaagttatttggttcagtcttgaccttaaagactcagaagacaatgcatgaacagttacaactcgaccatcattactggtgagagttacttttctgttagcacagtctatcacacctttatatctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgaagcaccagaatcgaaaagcactgttgcaggaactaagttaacaagaaacgtacccaaaatcacatctggagcaccttgagcttctgcagcagcaacatgattgacacgggcctttgatgctggtgcggtagagttgctctgggtagggacaaccttcacgcgtcggggcttcggacacttgtcagcataatgtcctaggtctccacagttgaagcacaccccgggcttgctgccttgctccttcttggcaggttgttgctgtgtcgaagctgcaacagggcgtggagcttgattgcggatgttgttgccagcattgtggttgaagaactgacgatgcggacgaacaacagacgaagaacctccctgtggcatagactggggtcctaaagtaagacgcggcctttgactattcccctgttgtgccttgaattgagcaatccggcgtttcttttgctccatgcgattgtacttgtcctcctggcgaatagccttatccactaacttctggaaatcatgataatccccagtcatgagtgggtaagaaagctcatcattaagtccttccaagaacttctcctgacgctcttcatcagtgcgcacatcttccggagcataacgagccagacgattgaactcgtgcagatactccgtaacagagcgagatccctgggtgagcgacctgaactccttcttgagagacaccactcccgatggtatatgcgtcttccggaaagcagcggtgaattcaagccaagtgataggttcagcagtagtcctgttcaagcggaagtgatcccaccattcagaggcagggccatgcagctggtgtgatgcaaatgagaccttctcctgatcggtgcactgaagcaaatccaacttcttctctatgtcatgcagccaatcaccagcttcaacaggattggtggtgctagagaaagtaggcggcctcacacgaagaaattctgctaacttgttctggggaggtgcatggttatttccctggttctgctggttctggagttgctgcatcatcatgttcataagctgtgcctgttgagccaggacctgggcaagtgtgggattctctccattgttgttgttgttattgttgttgttagggccattcccgttgctgcgagtgagcaccatctggcatgggcaggagcacaagaagagaaaccggggaaaactacttaggacagagaattaatttaagttttattgatcttaagtgagtttcattattacaaaactgaagactctcacaccactaaactcaccaactaccaaacactcgaaagcaaacaaacgcatgcacttacatcccaccactggtgtaaatcacatgcgagacacacacaaccaaacttaaaacaagcaaactaacacaacgatctaagacaacggtttgacaaggcattctagttcttccgggcatcggagttggttgaaggctcgttcggctcgtcttcatcatcttgagttgctccccactcgatcttggaatgggtgtgcttggattcttcttcttcatcatcacttacgttgacgaccggaggatccgctagggctggggtaacttctttttccaccacacggacctttggcgccaattggtagcgagggacaaatagagctctcttccttgcggtaagacgaatcctggccttctgcggtggtgcttctccctttaacgcggctagttccttctccaaacgatccaccttgtcttctagcttgcaaatcttaccacgattccgatcttcacgatcttgagctgctagcacaacctccgcacgggtttcatccatagcccgcagcatctcaaccaaatgccttgtggtagcatcattctcaattccctcagtctcaaggtagctgccacgatcacttccctgtggttggcgaggatggtagcgatactcagtgtcggccaactgatcactgtagcgatcgcggagctctcctatggcgatccttgccacctcctgacatgcatggatgtagtttcttcctctagcttcgaacatcactgaggggatatcttcactattactgttcaaggtgactttgactcggcacttttcttcgtgacgatcatgaggaatctgggcgtaaaaaggggcagtcccaaatcctatgacaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaaataaaccaagcttgcaagataagttgaaatagttggaaacaaggtcacaaattttgtacttttgaacaacaggttccaaaagaaataaaagaaagttataaaatcaatatgctaaatttatttccttgcagcaagattaaattaaacaatattgtaaaacttttgctggaaaaaggagccattagtacagtaatagatgtacagtactaataatgctgaataaattttgaacgaaaaccactaaaagagattatgaagtgcatgtgctattagttgggtttaattaaaagataagggggaaagaacagttctactttttcaatatttttagagggcttctatgggtaaccatctggcataacctagggtcaagtcggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaggtaataattaatcaatattaatccaacgctatacaacataccctgttgcataggcccaatcattctgaacaaccatcccggctgtacagttctatctccaaaccaggagctaatcaaattattaccagttatatcatcttttattatgatgagaggtgtgagactaaacacgaaagacattgttagacccgcccataaccgcgggcacggctattcgaatagttttactctggccagaggtgtaccactgtacccacaagacacagccccacaacatgtcaccatgtgccttaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcatgaaccggtccttaattgtcatgagcacgactctcaaaaccatgtgctcacaacccaccattatcaggttttagttggcaagtaattaattaaccaatcacgattgaccatcgtgaactatcattaagcaatcattaaataatagtgaatcataagttatcccaatagtgtgctaatgtttctaagtatggctaagcaattatatctaatacatctagttgaaccaatatatatatagcccaactagtcaagttataacaacccaaggtatcaaggaataaagtaatcaagaacaaaagggctataacaaacaataggttaattccacccaatgacattcgaaaataaatgcaatagttgaatagaaacaatagctttaaacgggatcaacatgcttaaaggattgtttgcgatctgtgtgacttgccttgctggccttggaactcttcaaattcttttcctgcgaaaacggactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggttagcggtggaccgggcgcacggcagcggttcacgggaacgaacggccgagatcgatccatccaaaacggacggccgagatcgaacaggtctacggcggctcacggcaaacggaccctgatgacatcagcggtgacgtcatctccggcggcggctcggcggctcaggcgcgcaagctcgccggcgaacgacggcgcttcggcacgaacggagggcaccaggacgtagagcacgacgcggcgaacttaccgatgaccaaagcaacggcggaggagcaacggacggcgtcggcgacgaggtcgaagcggcggagaccttcggcttgacgacgacggcggtgctccggcggtctacagcgacggcgaaggggcggacgaggaacgatggcgacctccccgagcgacgacgacgaccgggacggcggcggcgcacggctggagcggcggcgacgactgcggcacgagatccacggcgctagggctcttccgatggcgagagacgaaggcgagggtggcggcgggtagaggagacaccggggatccttttataggggttgaaaggcggcggcgaaggcccacggcgaccggcgacgcgaaggaaaggtttgggttcggagagagggagaccgatccgaatcgacctcgaatccacggatttccaaacgaaattagccgatgattccaaaagagaaatggtagaggagatcccgaagatcgtttcccctcaattgatttcaccggagaaggaaaggtgcggccgaatttgggaagcggcggcggcggcgcggcgctagggtttcggccggaggaagacgacgactccgacaggcgggacccacctgtcagcggcagcgagctcgcgcgggcggctgcggctgcggactgggccgacttgggccggggagagagagagaaggttttgggccgactttcggcccaaagccaaaagagacttttaaaaacttttttcaattaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacaataggactcttcctattatgggtatatataccgatagagaggtagggagatctgaatatatccacatatgagaaagtaataaagctgtgatgcctctccctatatccgtgttcattgtttatctattatgtgcttgtatgagagatcgttgtcgtctactccggatcagcaaataggccactagttattcaatagaaacaatgaaaacaggttgacagtgatttctctctagaatcttgtcgcccatctcggctaatcttctggttgtaatattctcactacacccttcacagatctactgccatctggcacatgatcatctcttcccttatcttgttgattaccctgcttttgaaaaccaatcaatctgtttccctctttccaaatatcccacaacacaaagatgaattagatcggataccttttctttgtgttgctcatccggcccattcgactgtccgcactagtttcaattagtgatctgttccctgatacagcggctgaaagaaaattctgcccaattcttttgccaaatccctgctccaactgctagtgagtatgagaaatctttcaaaaggtgttgcatcgtccccatgttccaaaacataaatatcaaacacaatagttcttgttcggtcatcctcgactttgtagtcactctgaaatccatagccgattgtagtacagcagccaagcaaagaatctttggttagattgtcctaggtttcccaaacggtttatcattttccttggactaaatgccatattacacaagggtggggtttgtagtatctaactctaaggtgcttagccagcttctatcactatgaactggccttgatacatgttgcggcctacaatacatgttgcggcttaaaaaccagtgctaattataaatattagtgccaatacgttcttagttataactggcactaatggacaagactacatcatgccagataaaaaactacaaaatggtcttagctacctattttattgtatctacctcatatagaaggagtaataatcgtggttttgctttcatacaaaacggtcttagctacctaatttaatacatccgcctcatatagatgaagtagtaatcgtggttttgcttgcataagtaatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctagggtttcgaccgagcccaattcggcttaacatgacatggctaccctttgggatcatgtatcccgcgacggtggtgtctgcgatcgcgacatggggtgggttgaatgggtggtaggggtggaggcggaacgcctcccggatacatgccttgaggtatgtgaggttgtgaatgtcggattcctcaacaagcctttctctaccaacaaccatatcgagttcatccactgctttcttcatgacctttggattgttcaccatctctgccagtgcccactctacagcatttgatgggttgtccacggtagcaaggattatttcctgcggccataagatcaaattaaaacagtgttggattttcatccttcaaggggcaacctctaatatgtctttaactctttatacaatcaaaattttcatgagaacttttggaaaattgacaacaatattaagtatgtactgacatctactgaggtcacaacagtcaaatctagactggacaaatatatagaaaacagaagaaatccagagatgaacactacaatgttaatgttcatatatagttttgatctgtcccttttgtttcttgatgcgtgggttgagtttagaatgagataatagatatgcattatactagacttacaattcttttcaaacattttcatagctatttttcaaaaagaaaccatagatattttgcacgttcactatcaaatcatcgtaacggttaattttaacttcaaaatgaatgaaacccaccatagtatatctttacctataacgaaccaaaggcctcactaattatttctaaaatataatcacttctagcattagaaatttggaccaaaacataagtacttcaagcatactatttttcttccgaggacatatctatatagtccaagtttgaaaaaaaaattatgtgacggtgtaataaagcttattaccagcgtttctgccttgatctcatctactgacaaaaacggtttcccttgtgcatcctccaaggagatcaacacgtccagaaaatcggcaacttctctcctcttatcaccttttgtcctgagagatttccattcttctatcctctccattatgataggatcgtgcagcctattgaatgtgttcatcaggccattgacaacctcctcatggccatccaagtcaagcccaaccagtgtcgggaagtagtcggagacggagaaggcgccgtggtagtccagcgccgtgaagagcgcgtcgatgtgagcctcctcatcacggccagggccgatattgccatcgccggagttgaagtgtctccggccaaacaccagcttcctgatgatgttgccacagaagtgtctcgttacgtgccggacgtctacagtgccatcattacagtggctgtagacgtaattgacaaggtggtcagcctcctcgacgcgccggccgagcatccgccgctccatggccggcgagaggatctccgacgtgagcacctgcctcatcttcctccactggtcaccggccggcgacatgatggtgttcttgtacccaaagctgaacgtccgcgacacgaacgacgatggccgggaggcgagcatggcgtccttcttgcgcaggacctcccgggccatctccggcgaggcgacggcgatcacgtggacgcgaccgaaacggaggcacaggatctcggtgtccatctcgtcgagcaggcggtggatccacctgaacaccggcttgttcatcagcatttggtgcatgttgctaaccaccggcatggtagctagcccgggtggtagcttgggttgttgcttcctcttggccgccatggcagctgcctgcttcttgatccgatagaacaacgcaacgagcaagaggatggccatggctattgacatcagaaaggtgaggacatatgcatggtcattttgggcgatgagttgtgatggcatgatggtatcgttgttcttgtgcatgattactgatttttttttgggagtgcagatagcctagctagatatatcactgattctgtggccaattaatttatagatggaattctaaacacgtgtggaatgaaacttcatcacgttttccttttcaataaagaaagaactattgcttttagtacgaaagagtcttgtacttgggtcgatgaacctcctggttatattctaagcgctttggcaaacgatgtaacaatgtttaatgtttaatgatcaataaagctagccgaatggcatttcctaaaaaaaaagaagaaagaactattgctagtgttcgcgtggtgctcggcttttgttgttccattcaaatattgacaaatgtcctggaaaaaggtgtgctctgtttgtcgccaactaattgacactagtcgatcgctattcatttttagaacttcaatcatctattctttaaattaatgtaaatgttccaaaatattgtatattatataaacatttttttgataaatgttatattttttaataatgtttttgtaatttagaagctatatactcccttcgtcaaaaaaagacaaaccctaggttttcgtgtttaacgtttgaccatccgtcttatttaaaaaaacttacaaaaaaaattaaaaagacaagtcacatataaagtattaattatattttatcatctaccaacaattaaacgttggatacggaaacccagggtttatctttttttttttgacggggggagtagtcgttacatttggaatagtaccattcaatactctcaaaatgataggaaagaatactaattactctagttcggtaatactagcaaagtgcccgtcgtctcgccggccgccaacctggcgagcacgctggcatgaaccagctcgtcgttggtgccactgatctgctcccactccccctgacatccgcgcttctccccaatggcagcccgatgaggagcggaaggaggaagatggggcggtaccgatctgatggacgggaaagggaaggaagacaagaaatataagggtctctgaccggatctcgatgtccatctcgtcgagaaggcggtggatccacctgaacaccggcttgttcatcagcatctggtgcatgttacccaacaccggcatggtagctggccccggtggcagcttgggttgcttcttcctcttgttcttggctgccatggcagcctgcttcttgatccgacagaagaacgcaaccagcaggaggatggtcatggctattgatactattatggtattattttgctcgcgcatatttgcagtactgggaaagaacatgtttatgtgtgactgaagagaggatagctagataactgattatgnnnnnnnnnnnnnnnnnnnnnnnnnnnnnnnnnnnnnnnnnnnnnnnnnnn

SEQ ID NO: 26501 - DNA, 7934 bp, Oryza sativa
aggatacctagataactgattatgtggccaatttatagatggaattttataagtgatttgttcccgtccagcagaggtaggcgtaccaaatcctagccgtcaattgggacatatcagacggtgattgagatttctcggtaccgtgcagtaccattttagcccatatggtggtaccatcttttgaagagaggtgaaagggtagtatagacttttcatatgtaagggcgagatgttggcctctagggtgggcggtggggccagtgttgacggcggcatcagcggaaggcgaggtccggggccggcgttgatggcggcagcggcgagctgcggggttcgatggttcggggatgtgtgcggccggcggagtccagccccggcttcgatggtggcggtgagcactgagcagcagggtgcattgcattgccagcgacatgctgcaagattcgatcccggcgtcgacggtgacggcaggcaataggtgcgtcgacggcacgggctgcagggtccacagcggcgtgcggcatgctcggcgtcgacgaccatggcgagcggcggggtgtgacaccagacgaggtggtcgtggagagatcggacaccaagcaatgcggccgcggtggagttaggggcgttgccggccacgacgtcgaggtggccgtggagaggtcgagccagatgccacagcagcggcagcagcggcgagtcgttggactaggcgccggcgccggtggcaaggaagaatgcagtagcatcgatgaaggatattgggttgtgcatgatctggtttctgctaagatatgcatcgtcggtggcgtacggcgaagaagtacagatgaggaaggaaacaacgggcgcaagaatgagattttttcttttttgacgagaacccagaaacaagattgatttagtgttggaagaggtttcttactcattcccaatcctacccctaaatattggatagtcagatttgttttagtacgttgtggtactgggaccttgggttgggccgggtacaagtgctggatggtagcaaatcttatttcttaaagaaccttgctaatgttacatgtagtgctcgtgtttttgttcttccatttaaatatgcagaaatgtcctgtaaataaaaggagtgctctatatttgtttccagttgattgatcacaccagtcactatttatcttttaacatgaaaacaatacatagattgattgacggccgcctagacggcgactcatcgctagtccgtagcaagacgtccagattacatcctagtcagaggattttagtcgttttgctgcctaaatggtcccaatcaatcctaggcggcttggatggaaggatactgggcgtatttagatggcggagggtagcgattaggcaacaacgacttggcaatgagcagtggccaaaagttttggtgcaaatgtgcaatgcacggcgatgaaatatggaagcgtggggccagctgcattatagaatagaatggcattacgttatcttactacattcttacctgcttgtgaaccattctttagtgctgccacactcttcccctctacgcttaaagcgagagaaagctccccttcgtagataatccctcagtttcaggttacaagacgttttgactttagtcaaagtcaaattgctttaagtttgatcaagtttataaacaaaaatagtaacttttttaacctaagacaaatttattattaaaatatattcaattattgatttgataacactaatttaatattataaatattactatattcgtctttaaacttagtcaaacttaaaatagtttgacttgaaccaaagtcaaaatgtcttataacaggaaacggaggaagtactatataacatgtgttattttcaatcaatattttgtatttctatggaaaaattagaaaacacgcctagaccgtctaatctgcctagtcgtcgcctaaacagcctattctctaatcagtggctacccctgaattttcaccttttggtccttttaaaaaacttattttacaaatatacactccaaaatttattctataaatggccctttccgtaacgccaacgtcattggcgccgtgatctaacggaacaacaccaatgaagttgacaccatcccctccacccctggatggaatctaagtcactaatgtgatgtgggacgacgcaaatatcgttggcactgaggacctatttgtaaatttatttaacaagacctatttgtaataaaaatggttttatttgtaaaatatttacaaatagttcctcagtgccagcgttattggcgccaaggacctatttgtaaatattttttaattacaaatatgtttttttattacatcagtattgagtttttcggcccaaagcatcattgtaattgaagttccgagtgatacggcggggcagccacgcctaccagcactgaatgataaaaaccgtaactctggctcagctagcaccacattatcagtattcttcaaatgtcgctctggtcggaattcgagtgggttatcccgtgctctagggtttcgaccaagcccaattcggcttaaaatgatatggctaccctttgggatcatgaatccagcgatggtgatgttagcgatcgcgacatgggaagggttgaatgggtggtaggggtggatgcggaacgcctcccggatacacgccttgaggtatgtgaggctgtgaatgtcggattcctcgacaagcctttctttaccgacaaccatatcgagttcatctactgctttcttcatgacctttggattgttcaccatctctgccagtgcccactctacagcatttgatgggttgtctaccgaattaaggattatttcctgcagccataagattaaattaaaacagtgatggattttcatccttccaggggcaacctctgatatgtctttacttcccaaatacaatcaaaatttccatgaaaacttttggaaaattggcaacaatattaagtatgcactgacatctactgaggtcacaacaatcaaatctagattggagaaataaatagaaaacaagagaaatccatagatgaacactacaatactgttcatatattattttgatttgtctctttgtttctcgatgcgtgggtggagtttagaatgagataatagatatgcatatactagacttacaatttttttttcaaacatttccatagctatttttcaaaaaataaatcttagatattttgcgcgctcactattgagtcatagtaaccaacggttaattttaacatcaaaatgaacggaaccacaccatagtatattgtttcctataacgaaaccaagacctcactaattaattgtaaaatataagcatttctagtattagaaatttggaccaaaatgtaagcacttcaagcgtactatttttcttccgaggacatatctatagtcctagtttgaaatatatatatatgacggtgtaatagagcttattaccagcgtttctgccttgacctcatcaagtgacaacaacggttttccctgtgcatcgtccaaggagatcaacacatccagaaaatcggcaacttctctcctctcatcaccatttctcctgggagccctccattcttccatcctctccattatgattggatcatgcagccgtctgaatgtactcatcaggccattgagaaccaacgacgggaagtagtcggagatggagaatgcgccgaggtagtctagcgccgtgaagagcgcgtcaatgtgggcctcctcatcacggccagggccgatattgccagcgccgaaggcgaagtgtctccggccaaacaccagcttcctgatgatgttgccacagaagtgtctcgttacgtgccggatgtctacagtgccattattacagttcctgtagatgtaattgacaaggtggtcagcctcctcgacgcgctggccaagcattcgccgctccatggccgatgagaggatctccgacgcgagcatccgcctcattttcttccactgatcgcccgtcgacccaacggtgttcttgtacccaaagctgaacgcccgccacgcgaacgataccggccgggaagtcagcacggcatcgttcctgcgcagggcctcccgggccatctccggtgaggcgatggcgatcacatggacgctgccgagacggaggcacaggatctcggtgtccatctcgtcgagaaggcggtggatccacctgaacaccggcttgttcatcagaatctggtgaatgttacccaacaccggcatagtagctggcccgggtggtagcttaggttgcttcttcctcttgttcttgcccgccatgttacccaacatccgacagaagaacacaacgagtaggaggatggtcatggctattgatattattatgatattattttgctcccgcatatttacactactgggaaacatctttgtgcagtgtgagtgcagagacgatagctagataactgatcaggtggccaaatttatagctggaattcttaaagaacgttgctaatgtgacaagatatgtcatatgtcactctaccaacatgcgagtttaaattaaatttctacaggttgtaatttgttatttttgttacaatttatagaagttggatttgaacttgtatgtttgtggagtgatatatttcatattaatctactttgtcgattttttgaattgttttcataatcatttagttgatatgtaaaaaatgggtgtacatccatccaagtaattaaaatccatatccacatgtggggctcattttttttcttccatttgaatattctaacatggaaactagacataggttgatagtaatacatcacaaccttcacaacatccaatctgcacaatcagcatgaggaagacgtcgtgcccaagactatcttcattaaagcaaaaaaaaaaccctctctaaggtgaggacacatgttctttttccagttttaaataaattctttttcaaatctataaattattgtttaacttcaaaaattcataatttcctatccgtgactctgatctactccgttcaagtctttatttctaaattgagatccaccaaatggcactagtagttataataataataataatattttctttttaggagtttatttggttttctctgttttgcgcatagttgacaccgacggaatttattttggatgaggatttttgaagattttaagatgaggacagaggtaattaagttaacatttcatcatattgcttctactttccaaaatggtttgtttgcgaaattgcattgctagcgcgtatgttaatttgactggcctttgttcgtgtgacaaatcgacagatgtacccaataattgcattactactgtaggatattgatgaccccaaccctttgtcgctttcgggcgtagtaccaatggtcccactcacaccaaatttgtttgtcgatgtgggaaaatgggttgtgaaaccattttaaaatccaacacgtagtgtttgcatacatggaccgattccaaggattggtataagaaagagagtctcaccctaaatctcagtgtctccactttactattagattatacaacgtcgtcagactactctgtagcgaggctgtaggggttgtataatactccatcgggttttatatttcttgacgttttggataagattgaggtcaaacaattgtaactttgattattaataactttaaaagtattttctttaaaggaactagaatagcatatatagatttgtccttcaaagtaatataagaaaagtaaacatgcattatatattataataaaaacaaagtaaaagatatattttgttgaccgtatcattatcgaaaacgtcaagaattatggaaccagagtgagtacattattaaggacgaagctttactagagatcaaggtagaagaagggtaagaaacgtcaaaatatatttacgcttgaatactgaagtgtaaagaaaataatttcttgcatcttggaacaatgttgtgtcagctgctaagttagacaggggggcgtaccaatacttatgacttcactgatactgataagtctactgagaaccatgtgtgccagatttgcactatagtgggtcatacagctgatcggtgtcgccaccgtttttactaaaattataagccccaccgcctaagcatcttgctgactatgttgaggcagcttttttggaacttacaggggcgctgcgaaagctaaataaagcgagcactcggcaacttcaatctcacctctaccccgcactgaggtcaaaaccatctctcattcggggctatactactgagttgaccgattcctcgccgcccttctctgtctttacctgccgggagaagagtttgaggagcatccttctcgttccatttttgtgactctagacgaagagcaccactgccaacttggagtcggtggtggctagccgatttggggtttctggcattctccatggcagagaaggttgcaagcatggatcggacacgaccagaaccacgacgccggtggccacactcgcaccgacgacgttggaacaaatttaacaagagagttgtccccacttgctagaagtttatattttggggtcgagaggctttgtcatagaaaaaagtataacttccgacatgtacaccaactattagatttaagtatttggattgtttaaaccgatgaacccatcaaatctatatatataagaaaaacactttcctaactttgaatataaatcatttttctttgcttgacaaccaaaaaagaacaaacattaaaaatgacaatatatattacagagtaaatttcacaagcctagagagataaatctatctatctattattatatactaaaagtccatcaaatatactaaaactctcctaagatgacacgtggtgctctagttaattcctagaaaatctaaggaaaaaagagaacattggttttatttaatttgatggacccaatatcttttaccatcatataccgttacatttatctttaaaaaaaagaacttaagaacaattagaccgtacgagtctgcccaacgcacgtacgttcttccatccacctgcatgagaagtgcatgcgtgctttttccttgctcgtggctatctaatatcttctatattactaacttaatttcatcgcactccaaagactgcatgcacttgcaaatatggacaagacaatatccctcatgcatgttgatcttggtatgttttataaataaataaagaatcttcaatagttgtaaatattaaattatatattcaatttatgatctgtttgaaccattgtatacttaaagaaatcctaaaaaaatctcattaaaagtcaaaatatccaacttattttttgtaataaaatcaatggacccatacctataaaccgcattaaccataattatagcatcaatggacctattgactctcaaccaacttaattatatctctcaacatgtatgtggaggctatttacttaatcctgatgctttatgcttgcataaagatatgatttttttatgggtaaatgaacaatcttaggctgtgttcagcgctgagggttgggaaaccttaataccttggaagttgaacattaaattatagcccaaaatacctatatcacagaattaccgggaatgctacctaactttgctcaaatccaaataattcaccaagaaaagaagaagggaagaggggggtctacagggggtgtccttatggatattctactaataaaaatttattgcagatacttatttgtatgttatttattaaattatctaatcattagaaaaatgaacatactatctatggagtaaacaaattggggggctagccaggtgcatcccagtgtgcatgcatgctgggtatataaattttttcttagatgaaaagatcgggcatgagatagttacatgtattatgcctatatatgca

SEQ ID NO: 26502 - DNA, 1525 bp, Oryza sativa
cgtcgctctctgcccctcccctgtgcctgacgccgtcggcaagctcgagctcgtccgtcatcccctccaccgccaagttcctccccgtggtcgtcggcgagctcgagctcgtcccctcaaccgccaagctcctccccgtggtcgtcggcgagctcgagctcatttcctccgccgtcaagctcctccccgtggtcgctggtgccggcgaggttgagctgcttccgtgcctccgtggtcgccggctgcccccaaagctcacgagcctaacgagctggctcgagctttcaaacgagccgagccgagctgggtttctagctcgttaggataacgagccgagccaagccagctcgacatccacacctaggtgtgtgtggcaagagtacatttcctagctgtcactttattcgttagctccaggctcaagcgaagaacaaaagagcaaagaccaatgcatatctttaacacaagttcagtagctactagctacatcaaattccttcttgcagatcagcaaattaaatagttccccttaaaataccctcttttcaaaaatttcaaaaaaaattacaagatagattgatatgtaatatgtcactccccaaacaagcgatattaaattcaacttctacaagttataacaaaaataacaaatttttaactctaattagtatacatatactcacagttgaatttattatttttgttacaagttgtagaagtcggatttcaatttgcatgcttgtggagtgatatatttcatataaatctaccttgtcaatatttttaatttttttcaatcatttagttgacatgcaataaacgggtggacatccacctgagtgattagaatccatctacacatgtggggctcatttttgttcttccatttaaatgttcattcagaaatgtcttgtaaaaaaaggagcgctccataatcgtttccaaatgattgacgccaatcactattcatttttgaacatggaaacttgacatagattaatagtaactataccacaaccttcgcaagatccaatctgcacaatcagcatgagcaagacgttgcgcccaaaacctatcttcattgaagccaaaaaccctctctaaggtgaggacacatgttcctttccagttttaaataaatccctttttaaatctaaaaattatgtttaacttaaaaaattcataatttcctatgcgtaactctgatctactccgttcatgtctttatttttttttctatattgagatctaccaaatggcactagtagttaataataataatattttctttttaggagtttgcttggttttttctcttttgcgaatagttgacgctgacggaatttattttggatgaggatttttaaagattttgaagatgaggacagatgtaagttaccatttgatcatatggcttctacttttcaaaatgttttgttgggaaattgcattgctagtgtgcatgttaacttttgactggcctcggttcgtgtgacaaatcgacagatctacccaataattgcat

SEQ ID NO: 26503 - DNA, 24398 bp, Oryza sativa
  unsure (1)..(24398): unsure at all n locations
aattagtatacatatactcacagttgaattttattatttttgttacaagttgtagaagtcggatttcaatttgcatgcttgtggagtgatatatttcatataaatctaccttgtcaatatttttaatttttttcaatcatttagttgacatgcaataaacgggtggacatccacctgagtgattagaatccatctacacatgtggggctcatttttgttcttccatttaaatgttcattcagaaatgtcttgtaaaaaaaggagcgctccataatcgtttccaaatgattgacgccaatcactattcatttttgaacatggaaacttgacatagattaatagtaactataccacaaccttcgcaagatccaatctgcacaatcagcatgagcaagacgttgcgcccaaaacctatcttcattgaagccaaaaaccctctctaaggtgaggacacatgttcctttccagttttaaataaatccctttttaaatctaaaaattatgtttaacttaaaaaattcataatttcctatgcgtaactctgatctactccgttcatgtctttatttttttttctatattgagatctaccaaatggcactagtagttaataataataatattttctttttaggagtttgcttggttttttctcttttgcgaatagttgacgctgacggaatttattttggatgaggatttttaaagattttgaagatgaggacagatgtaagttaccatttgatcatattgcttctacttttcaaaatgttttgtttgtgaaattgcattgctagtgtgcatgttaacttttgactggcctcggttcgtgtgacgaatcgacagatctacccaataattgcattactcctgtaggatgttgatgaccccaatcctttatctcgctgcaccccgtggttccacggtaaccattctctcgggcatagtaccaatggtcccactcacaccaaacttgtttgtcgatgtaggaaaatgggttgcgaaaccattttaaaatccaacacatagtgttggcatgtttgcaaaataaaagttgtttgcgaaaacttgtgatgcaaagggagaccatctgtattcgcttacaaggaccgattccaccctaaatctcagtgtctccactttactattagattatacaaccctattggagtactctatagcaggggttgtataatactcgctccggtttcatatttcttaacgttttggataagattgaggtcaaacttttgtaactttgattatcaataacttcaaaattattttgtctaaaggaactagaaaaacatatatagatttgtccttcaaagtgctgtaagaaaagtaaacatgcattatatattagaatagaaaaataaagttaatgatatattttagagaccctattattgttcaaaacatcaggaattatagaaccagagggagtatgttattaagcacaaagctatactggagaccaaggtagacgaagggtaagaaacgtcaaaatttgtttgcacttgtacatctactaaagtgcaaaaaagaatgtcttgcatactagcttgtatactgaaatgcaaaaaagctgcggagtatacaactgcactgatgcctaagctattacatcgttaattaactgtactgcatcacctgctgttgtctgaaactctgaaagaatagtgatggagcaaagctctgaataatattagtagcacgaatccaacgagatagacgacgaggatgatcagtcgatcgatcgatgcccaggcctgaatgatatgtccgatggattgatagatttcattcctgtcctggatcgagacgtttgtttttgttcttgtttctactgctgcaagctgctagctttgtttaaatatcatgatccccttttcttttctgatcggtgtttgtttaattgatagaggctatagctagtaacatgcatgattagagcgcgcaaggacgattgtgctttgcatggggaccaagcgtggctaatctctcatgtctcatctctcattgcgtttggagtttttctctacttatcttatccttgcaataatgatgatagatggtgcgacatgaaagattccttctctctgctgcttatctgcaggccaaaaatgttgctaggtataaggtctcttttactgataagaggggcccatctgtcattcactgtgagttgaaaatataaagaggatttcagctatatttcaatcgattgcttgattgagattcacttgtcgcttgtcagctacacatattcaaaactcagtgaattatcttctagctacactaattagtgtatctacaagtctcttatagatttgataaatggaactagtttgccattaacaccgagcctgtctggggcatggctagctggctgacgctcgtttttttggcctaagtagttatactaatctactagtatattagataataacaatttaggataatgatggtagtagataagatttttttaactaacaaattaaaaagaaatctacatatgaagtcacagtttcaaaattttaaacctagatttgaaaactttcaactcgaaatttaaatttttttaagtcaaatttgaaaaactttcaactcaactttgaaaactttcaacccagatttgaaaactatcaacccagatttgaaaattttcaactcggatttgaaaacattcaactcggatttgaagactttcaactcacacttcatttttaccattagctaccatagggtagatgctaatcacgttggagtgactagatgggaactaatattttattgcttaattgtactataattatactataatatatgagatcaatattaattagaaaattcctatggtttatatattcctgtattccactacaagaatcctgttaatccatgatggaaaatttccatcacggatcactgaaaaaccgtcaccaaacaacatctatgatggtttcagaaatcatcacggattgagcgtcatggattgacttgcgtgacggtttgtcgaaaaccatcacagattaacagaatcggtgacggttttaaaccgtcacgatagagcccgaggcctagttagtccagccaagcgcatttcctgtgacgaaaaataaccgtcacggatagctgccacataggatgtttttccgtcacagattatctgccatgtaggatcacggattcgaatcaccacgtatgtgccacatgtttgccaaggtggacaatgatgtgtcatcgatgccacctaggatttagcccatgtgtttttggtccaattcgggttcctagagctttcggcccatttatgaccaactggattttttttgttttgggccaatttgtttttttgtggtgtttttatggccttttagttatcattcatcccagttcaaattgggctactgcaatatttcagcccaactaaaattcggctgatgctaaatttagcaaaatacaaatatttcatccataattttagcaaaatcaattacctatcatcaatttacattctctcatcatcagcagcacataaatattctaaaaacacattacaaccttcacatctcatacaacattttttttagcatatctcatacaacataattaaaacctgttcaaaagcacatgacaattcccagcagccaccaaagcattttggccactcctccatcaaagtttcagcccagcaacctgatagtacaataccaaatgttagatttttttttatgagctagagaaacaacaagaaacaatctacagatacgatattagtttttgaatgatagggctactttgcaacaccaatctgtgtccccataatatattgcgctaacagaactcaatgtccctatccccaacccacctcatttcattggccaagcaaacaagcaactgacgctagactaaaccaaaaaaaatatgagagcaagtaaagtggtacaggaaagtgaactagaatgcataggagtatagcactaaatttagacactaaagttatgatacgagtaacttcctatgcatgcttcatttctacggactataggcatatagtatttaaacatatagatttgtatgcatgaccataaagatgagaatattggtcatggatgatagcatggtatactaattaatagtccgttccactgagtatatagacagttcctaacttcctatacggcagaaatcatgtgatgcttctacacatgtacaagcagatttacctaaaaaaacacatgtacaagcagaaggcaacaaatgataagcaatatgtttaatttattacttcatatggtgtcttattagatgcagtatatttggtaataaactgataatcctagctgcctctcccagcagaagtgcacaaatgaagtgttcctagcatgcatgtttgttacaatgttttgatctgaatgtcaatttgtagagaaaagaactacatatacaaattacaagtacagaatgtagatcagtaggggaaagcatgctaggatccacgggtggaaatcgacctcgaggttccacgggtggatcttcgagttgatctcgtggtcgacggggaaccgcgacacgccacggcccccgaccacatcggccatgccgtcgtcagcgaacgagaggaaggacgaggcggggctctcgtcgaatccggcggcggtgcgggaagaggaggaggagaggcgctggtcggggtcgctccaccgcggcacctggtcgagcgtcacggccggctccaccccacccacgcccgtcgccgccgccgccgaggaggccgaggccgacgcagctgttggcgagcgctggatcagagccgcgagcgtgagggtttggggaaagagatctggacttagatttggaatcggctagggttgaggggagtagcaattttgatgcgattttactagaataaccctggtatctgaaaacctattatacaagttacttggacaaaatggtcatttaacctggaaattttaaaatattaaaactttgaatcgaattttatcatattaaatgaatttatgtgaaaaaattattaaaaacaaagttgtataacttatcaagatctataacttttgttttggtcattttgctatatgactttgtttcaataatttgaatttcaatttcaaattatgacaacttcaaataatattttcaaaactaaatgattttaactaaaaaagtcatcaacaacaaagttgtatagctcatcaatatctacaaattttgttttggtcattttgctatatgactttgtttcaataatttgaattccaatttcaaattatgacaacttcaaataacattttcaaatactaaatgatttcaactgaaaatatcatcaacaacaaagttgtataacttatcaatatctataacttttgttttagccatttcttcatccaataaagtgatagtaacattgttcacaaaatttacacatctcccatatggtttcataaactataagagacatatgtaaaatttgtgaacaatattaatatcactttgtcggataaagaaatgaccaaaataaaagttatagatattaatgagctatacaattttattgttgataactttttcagttgaaatcatttagtatttgaaaatgttgtttgaagttgtcataatttgaaattcaaattcaaattattgaaacaaagtcatataacaaaatgaccaaaacaaaagttgttttctattttaatacttgatccgaaaaaggcccaagtgcagagagagaaattttaatttgttttctatttattttaatagagtaaatgaactttgtggtattaaaattagttattgagcttcgaaaattcacggtaaatttcaaagaataatttagatcacgtagaatatttaaaaaatatttcctttttgaacttctattttaccaattcgagttcttttttcctttttgaaacgccaactctgagttgctgggccacgctatgggcaacatcctgggcctactcgagtgacatttggacaaataaaaggcaaataaaaatattttaagtacacattgggaccaatagaacaagtggttcaaatggtaagacgcattcctaccgtcagctaagtgtgggttcaaatcccacatgttgcagatttttacccatgcgcaccatatttttttagtttgccatattatgcatcatatacatataacatattaacaaaactattttgttcaaatttaacaaatcgtattttgggtttgattcttcttgcaatcacatttttttatttttctttgcgctaaatatgttttatttttttattgttttgggctacctagagtatgacgaatttaaaatcatacattgtgacagtcctgataaaactgtcacgagttagtgtgccatgaatatccactgggctcatccgtgacaaaaaacaaaatatcgtcacggattacgtttgtcagtgacgatctgtaaatccgtcaccgagaatccgtcatggattaacaagtttcttgtagtgttccgaatgcttattaccatcaaattcctttgtttttcaatcctacgttttgtatatgcaatcctatattattcatgtgtttttcctattcctatgtttttcctatcctgtgatccgaacaagccctcggtgtctaacgatgaagaagttactgatctgaaccatttgatcatcgataagttaatggattcaccttttctttgggtgtgtgtggcaagagtacatttcctagctttcatctttattcgttagctccaggctcaagcgaagaacaaaagagcaaagaccaatgcatatcttcaacacaagttcagtagctactagctacatcaaattccttcttgcagatcagcaaattaaatagttccccttaaaataccctcttttcaaaaatttcaaaaaaaatgacaagatagattgatatgtaatatgtcacgccacaaacaagcgacattaaattcaacttctacaagttgtaacaaaaataacaaatttttaactctaattagtataaatctattcatttaactcacagttgaattcaactctattcatataaatctaccttgtaaattttttttgaatttttttcaatcatttagttgacatgcaataaacgggtggacatccacctgagtgattagaatccatctacacatgtggggctcgtttttgttcttccatttaaatgttcattcagaaatgtcttgtaaaaaaaggagcgctccataatcgtttccaaatgattgacgccaatcactattcattttcgaacatggaaacttagacatagattgatagtaactataccataaccttcgcaagatccaatctgcacaatcaggatgagcaagacgttgcgcccaaaactatcttcattaaagccaaaaaaccctctctaaggtgaggacacatgttcctttccagttttaaataaatccctttttaaatctagaaattatttttaaattaaaaaattcataatttcctattcgtaactctgatctactccgttcaagtctttattttttttctaaattgagatctacctaatggactagtagttattaataatactattttcattttagtagtttgcttggtttttctcttttgcgaatagttgactacaacagaatttattttggatgaggatttttaaagattttaaagatgaggacagatgtaagttaccatttgatcatattgcttctactttccaaaatgtcttactgcaagattgcattgctagtgtgcatgttaacttgactggcctcggttcgtgtgacgaaccgacagatctacccaataattgcattactcatgtaggatgttgatgacgcttcaccccgtggttccacggaagccatgctctcgggcttagtaccaatgatcccactcacaccaaacttgtttgtcaatgtggaaaaattggttgcgaaaccattttaaaatccaacacgtagtgttggcatgtttgcaaaatataagtggtttgcgaaaacttgtgatgcaaaataaaaggctttgtttgttgccctggttcccaactccccttctcgttttccgcatgcgcgtttttcaaactaataaatggtgcgtttctttgcaaaaagtttctatacgaaaattgcttaaaaaatcatattgatccattttttaaaaaaaatagctaatacttaattaattacgcgctaatggacctctccgtttttcgtgcgggggacatgggttcccaacccaacttgccgaacagagcctaaatctcagtatctccactttacttttagattatacaaccctgttggagtactctgtagtaggggttgtataatacttgctccggtttcatatttcttaacgtttcggacaatattgagatcaaacttttgtaactttgattatcaataactttaaaattattttgtttaaaggaactataacaacatatatagatttgtcattcaaagtgttgtaagaaaagtaaacatgcattatatattataataaaaaccctgtttctactgctgctagctgctagctttttttaaatatcatgatccccttttcttttctgatcggtgtttgtttaattgatagaggctatagctagtaacatgcatgattagagcgcgcaaggacgattgtgctttgcatggggaccaagcgtggctaatctctcatgtctcatctctcattgcgtttggagtttttctctacttaattatcttatccttgcaatgatgatgtagatggtgcaacatgaaatattccttctctctgctgcttatctgcaggccaaaaatgctgctagattgagaggggtccatctgtcatatatataaagaggttttgagctatatatttcaattgattgctagattgagattcacctgtcgcttgccagctacacatattcaaaactcactgaattatcttctagccacactaattagtgtatctaagtcatagatatgataaatggaatcagtttgccagtggcaccgagcctgtttgagctcaccagcacccggttgccaaagcagagggagagaaaccccaaacataatattggtacgatggtactaccaccatcccattttaagcacagccatgagttttcatattcaactttaattgttcgtcttcagttaactgcccagcatgtaccgagctcatcgctcgattcacacagtacagccaccacggagctcgtggtcgcgggaggggagatgcaagaggatatcgtcgccggggcggggaatatggcagaggtcaagcggcgttcagtagtcaagaggcggcgatggggagaggggagaggccgcatctttccttccccaaagatacaatgcaaaacaaggggataacgggcccttctagcactcaacatattgtcggatcagctccacaaagctcatcaatcatcaataattgcatgaataatcgacaaatctacctaataatggcattactccagtaggatgttgatgaccccaaccctttgtcgcttcaccccgtggttccatggtaaccatgctttcaggcgtagtaccaatggtcccactcacacaaaacttgtttgtccatgtaggaaaatgggttgtgaaaccattttaaaatccaacacgcagcgctggcatgcttgcgaaaacttgctatgcaaagggacaccctttgaattcgcatacaaggcgtgattccaaggattggaagaagaaagaaagtactaccctaaatctcagtgtctccactttactataagattatacaaccccgttggactactctctaatagggctgcgggggttgtatgatactcactccggtttcatatttcttgacattttggacaaacttttgtatctttgattgataataactttaaacgtattttgttttaaggaactagaacaacatatatagatttgtccttcaaagcactataagaaaagtaaacatgcattatatattataatatttttttgaaaagattatttattatagagtaaattgcacctacagtacaacaacttgacgggtgtgtgcgatatagtgaaagaacttgagaattgaacgttcgagtgcaacaacttgacaagtgggtgcgttctagtacaagaacttgacaattttacatccaattatccttaagaatttttgttttcttcaccttcctaaatctcaaccgaaatataataatttctacatccagtttaattaactttcagttattagttattagaataaaaatataaatatgcttatatataaatccacgctagtatattgtcaaaataagtacttaaaaattgaatatgtataaaaaaagtgctccaaataattaagttgtcgtataacttcttaacttattgtatcaaaatcgtacgtatcatgcaagttgttgtatgtatgcaatcacttataaagtttttgtactaaattacactttcctgtcaagttgttgcactagaacacgtatttttcaagttcctgcaccaaattgcacccacctgccaagttaatgcaccgtgggtgcaatttactctatattataatatctaccaaacatctaagagatgtactgctggaattcccgaagttgaagcacatccacctaaagcatctccccaagctacaacagttatgcgagatcagcacaagatgtttgctcgtgaacttgagacaatcaagttgagggtatgctggagcctcaggagtatcccagctattgccgacagtcgtcatcaagacagtcgccctgtcgtggactaagaaaaggactggtgggaaaagttggagtgggatgggctagagggtggccaccacccttccctgcgtgggccatgccattcgatgtacaacaagaagaccctacccagagtttcaattctctggtgaggcgacatatatatcaactgctaacttatcaaggtacatatgaatatatagcttcctctaccttggtattattctttaattaacttaattccatgtttgtatcacactactacaaaaatcgtttttctgtacgagggggtcggtaggttccatgcggcccgcttgtggcagcgcctgcaaaaaccgcccccctggggcgggttgattagccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagtatctaaatttattgatcaggctaaggtgcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcggagaattttataatcgaagacatgtcgcgtgaaagaatggttgtcgatgtttccaccgatagtgatgatttcgatggtggttttgatattgaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttataagaatcactgcatattataccgtaaagaatatgcggaattggaatgttgcccaacgtgtggcacaagtcggtataaaacggggaatgggcccatagattcagagtgtacagatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacaactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagttgcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcgttgacatttgaagagaaaaaagccttctgtaaatgtttacaaggggttagagtgcctactgatttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcaaattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttctttgataatgattacaaaaaggtgtccgcggcacacaatagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatcctgatccccgtgctccgttgtgaatgggttaaagacacaataggggtttctgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcaatgaagcaaatatgtcgtacgttcaagcagatggtgttgccaaggttattaagtcatagttatttcgtaacctttagttctcattatatttcaaatgtatgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatattttttccatgcggtcccttaagccgcccgtatgcgatgatctgcgcctatatatagggagcgcggggagccaaaattttctaagtcccggctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgcctttgccgtcgccgccgccaggacctctcccccctcgccgttgccgtcgccaccgccaggacctctcccccctcgccgtcgccgtcgccgccgccaagtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccaccccgccgtcgccgtcgccgccgcacggacctctcccccctcgccgttgccatcgcctccgccagttcgtccccgccgtcgctcggtaacatttccttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattaggatttatgtataattgtgattttcgttaaactgagatttatgtataattgggacttttgttaaattggcacctatgtcaaatggagatttatgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctccttaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattgtgtgcagatggtagtccgacgccgctcgaaacgtaaagccgggaggaacaggacagagcaagaagttgagatggacaccgctacgtctgcacctgaacgtacggagacatctacaagtgcagacgggagtgggaaaaaaagacgtggtgagagaagcaagaataaattacccaaggaatcttacaacgtgattgctctcgatcaggatgggaagcccgtcgaaccaccgatagtgcggtccaagttcagcaacgcctgtggcactctagtcaggacgcgttgtcccattaatgtcaagttctgggaaacagtggacgacaacatcaagacacttctctggaatgagttgcagaagtattttgtgttccctcctggatcagaggtcagggggagagattacgcacttaaaaagatgggagatcgatggcgacattggaagtccgatctaaatcgggattatgttcagaagaatctcccaccgtttacggattatggacatatatcgcaggctgactgggacacgtttgttgcggatcatacaacagctgaagcattggctttgaggaaaaaaatgtccgagctcgcgaagaagagcagatatccccatagattggggtcgagcggatacgctggtcacgtcgatcaatggcgggagatcgagcaaagatttgccgtggccggtaagcccctgctggtagaccccatggttgaacgtagcaagaactgggtttgggcgcgcagcacaggtcaagtctcggataagggagacatactattcgagactccagacatagaagaagtgactactaatttgcagcagatagtcgagaaagaaagatcaggacagttcgtcccacggagggagcgagatcagcttactgcggcgttggggacggttgaacactctggacgtgtaaggggtttgtcctcaaagacaagttggaaggtcgggtttccacaagacgcaccaagttataagaagagagacaaatacaaagaacaactatcggacaagatctatacacaagtgaaggaacacttctactcgttggcagctgaaaacccgacagcctttccaaggttattccctgatagccagcaacccacacaatccgcacagcaaacaactaatgtacccagcagtgtaggctcagtgcagacaactatcttccatgtggatagtataactggaccaactccgtgtagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattcaacttctcggtgatgcagtgaatcagtttatcttgtggcaccgcagagacataatcctgagcgcggccgttcttgcagtaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggtcccgcaaccagttcaagcctctcccacctccccagctaaacagcatgctcccccggctccgccctcagttcaaacctctccacctacaccccaatctgctctggtagaacaagtgcacataccagatggtacaacatccgaaccgaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctaaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgataaagatgtcttaatggtcccctaccagttcacgtaagctctctcttctttttgtttaattaatttatcttcttcggaattttctatctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattattgaacagtacatatatactaaatatatctactaagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgcaataacatgatgaaaaaactgtgccacttgctattatatatttgtatgtaaattacgattgaattaatggttatgtattacatgtttgttactgcggcacttgtcttatcttatatgctactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcaaccacatgggaaaatatatcttcgcatgcggcttcttatatggaccgcatgtgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgtcatgtgcaatatcatctacaaataagtcatatatatagtatgttcatctctgctaattgatatttaaaatgtaactaataactaaaaacgatgaaaattgaagtttaatcactagtatagaaccggccatcccaatcaggctatccatgacggaggcaagaggcctgtcacaaagaaagtcatgtttgtcgggccgcaaaaagcctcgtcaatgatggcccgagagaggcagaatcttagtcccctagggtagggcccgtcacggatggccatcaaccgtgacggggtgcggttgaagcctgttaaggtcatccatgacgggccgcaataaaggaccgttaccgatgaaggtcatccgtgacggggcctagtgttgaggcccaacaaagatgaagatgaagcccgtcacggatgaactatcgggctttacttgagacccatcacgaatgacccatactataaatacccccctagacttcggagtaacagtagttgcgacccgacacagatgagggaaaattttccgaacaacctcatacgaagacttaccctatatgaaagttgtagatctcgatgagacctataactttaaaattgacaatatttgaattagatcgtttatatgcctaaatatgcattataagtaatgagatatattctgagaaacataattttgaatttttcaaatgatctccgatggaaacatgccctatagcaaagtcaaagggtttgatgagatctacaactttgtaattgacaatattttcaactttgtaatatgttttataagtgatgtgatctatttctaaaatattttttgaatttttcaaacaaacttggatatgagacatgccatacacaaaagttgtgaaactcgatgagatctacaaagtactttgtagtagaaagcattcttatttgaaatcatctaaagtttcaaatttgtgtttcatattaggacgacaatagtcaaaagaataaaatctgaagacctatcaacatgtagttatagttgaaatggtgagattagtttgcttgtgttgagaggtcctaagtttgaatcctactattggcatgaatataaaagtcccttgaaaaatcataaacttctagttggtgacgtgtgagttgtgccatggttggaatgtcctagtaatacaaaaaaaaatatttttaggtctttgtttgcatttaaaattaaaaagttgttcattctcatccatgaaggttcgtaattacaagccattatggatgagtcatctgagacgggtggtaacttaccacccgacaaagatgagtcatccatgtctggctggagaacctatctgtgaagggtttgatttggggcccgacagaggtatatatgtcatccgtgttggaccatggcccgacacagatgatagcttcacatcacttaccaataatcactgaccatgcacattttcgacatagatgagggtattgccccgttatggatgaccggtttcgtagcagtgaatatatctctttgggcactgttagctgtgttccttcatttgatgcaccaatcagttgtatacctccgtggatttagtgacggatcgatgacgtactgtgtctggctgctttctccagcatgtttcagttattgcatttgttttctaaagaatgaattggtgtttcatgcgcttgcatgcatgcacctttaagttgcattgtacgtgcttgatactatgttaatttgtctgtgtcctaatgacgcaccatacatctgtgtgtgagatttagtttgtcaattgatgtatacatatgtgctttgtgttcctacccaccagggcctagaactccacagtgtgagagactgagagcattttgttgcaaaagaatattggagataaactatgtactatgtgctggggggggggaattgacggatggcgactgagtgcttagggtttcaagagagggcgactccagtgggagagtcctcgtcggtcctcccccgccggcgatcgccggagaagggtctgcctagaggatacacccacgcggatatcctcacggtagctgcccgtggtccagttagttctggcgcaaaaatttcgggtgaatttgcacacgaattccggcccgagagacctagcaatggcggtgggagcccgatggctacagtgcagcccagagtcgcgagaggcccagcgagttccacgatgatgaattgcggaaaaaaagtgggtgagattaatttggaggatattttccccaaatttcgccccactgagccgcaaaagtggatctggatcaagcgaggtgaggttcgccctcttctagggttcccggcgagagacgacgagatccggcgttttggcgacggagctcgtcggatttggaaggtgcccgagaagaggtgtgatcaccgcaccttcgcccaggttgtgatggagcgtcgtcctcccaatcgcctggattggcaagccaacaagcgacgagcgacagagcaaggcggcggcgattggggtgcacgaggcggaggtgactggggggcgtgcggagctcgcgaggaggaggaactgcatcggcaactccttgctcaaaaccctagggcgaatcaaggtgctcaatggaaacctcaagggctccctggtaccgatggagagaggggggcaagagctcctaagatcaagtgcttcaagtgtggtcgtgagggccatcaccaggcggcgcgccctaacccttccctctgctactcgtgccatagctcaggtcatatttcttcccaatgccccttgatgatgagaaagggtgttaaactttgtggttttggcattccgggacaggggttctatagtttgaatgttgagttgtctgatatgagattgctaaagcccctgtgagaggtattttgactgtgcttttgggatctggatctgttgcaaaagtcattgctgaattgaaacacctgtttgtgggtcttaattgggattggcgtgtgaaacaacttaatgagaaagagtttttaatcaacttcccatctgatgaagtgagaagtaaaatttcaacatgtaagagttttgatttcgaaacatctgtgatcaaagcaagtgtagttgagactggtatgactgaggaggctgtagatgagctggtagcagtttgggtcaaggtgtttggaataccaaaaagtttgctaggactgaagaatctgtgaaagctattgtggagctagttggggagtttgaagctattgatggggctagcttaagaagggatggtcctataagagagttgcttgcagggatcctagagaacttcacttctccatccacctgtatatcagcaaagttggttatatggtgagatgggaacctgaaggatannnnnnnnnnnnnnnnnnnnnnnnnnnnnnnnnnnnnnnnnnnnnnnnnnnnnnnnnnnnn

SEQ ID NO: 26504 - DNA, 1091 bp, Oryza sativa
gtttggaataccaaaaagtttgctaggactgaagaatctgtgaaagctattgtggggctagttggggagtttgaagctattgatggggctagcttaagaagggatggtcctataagagagttgcttgcagggatcctagagaacttcacttctccatccacctgtatatcagcaaagttggttatatggtgagatgggaacctgaaggatatcttccttatgaaaacagacagaatcctccagatgaggggatgacagagatgataaagatgatgaggggttaggagaggacatgaaccttgatgaggaatttaaacaaaataccccaagaggtagacaagctgcagatggacgagcccaacaggggagtaggttaggtgctcattctgctccacctgcttttaaggggaagtcacaagtaagtcagggaggaaaaactatgaagaaactagcttccaaaaaagactccttgctgactgtgatggaaggtacagagatatctattatcacttcagagaggaaggctccagaggtatgtgccaatatacctatggtgaaggaatgtaccaccatggtcctttggcaggaagagaacttgcaggaatcccaagaaatccaagatccagtggtgcaatctcaggaggatgttggggggtttgctgctgatatccttgtcttagagagctttcttttggatgatgataatgagaggtgccagataccaacagactctgacattgagagaatcagagaggaagaagaaaaagaagaagaggatagttttcaggaggtttcacacaagaagaagcacagggagaagagatctgaaccggcagtgacctccaggatgagtctttagcaaaacagagatggttgatgtccctataacaaaaagagctgatttttggattttaaaaaaaaatttgaagcttccagatactttttctaacccttttgctatattttaaattttagataattattgagttaaataaacattgcccatagtttctaatatagtgcttggtagctctccttaagagatagataacaccatagaaactttgaaagctaaagaggtggtgcaagct

SEQ ID NO: 26505 - DNA, 529 bp, Oryza sativa
  unsure (1)..(529): unsure at all n locations
nnnnnnnnnnnnnnnnnnnnnnnnnnnnnnnnnnnnnnnnnnnnnnnnnnnnnnnnnnnnatgctcctcaaactcttctcccggcaggtaaagacagagaagggcggcgaggaatcggtcaactcagtagtatagccccgaatgagagatggttttgacctcagtgcggggtagaggtgagattgaagttgccgagtgctcgctttatttagctttcgcagcgcccctgtaagttccaaaaaagctgcctcaacatagtcagcaagatgcttaggcggtggggcttataattttagtaaaaacggtggcgacaccgatcagctgtatgacccactatagtgcaaatctggcacacatggttctcagtagacttatcagtatcagtgaagtcataatttttggtccgccccccttgttaaacttaccagctgacacaacattggttcaagatggcaagaaattattttcttttaactttcatatttcaagcgtaaatatatttttgacgtttctttaccctttttctacc

SEQ ID NO: 26506 - DNA, 1509 bp, Oryza sativa
  unsure (1)..(1509): unsure at all n locations
nnnnnnnnnnnnnnnnnnnnnnnnnnnnnnnnnnnnnnnnnnnnnnnnnnnnnnnnnnnnntttttgaaaaatagctatggaaatgtttgaaaaaaaaattgtaagtctagtatatgcatatctattatctcattctaaactccacccacgcatcgagaaacaaagagacaaatcaaaataatatatgaacagtattgtagtgttcatctatggatttctcttgttttctatttatttctccaatctagatttgattgttgtgacctcagtagatgtcagtgcatacttaatattgttgccaattttccaaaagttttcatggaaattttgattgtatttgggaagtaaagacatatcagaggttgcccctggaaggatgaaaatccatcactgttttaatttaatcttatggctgcaggaaataatccttaattcggtagacaacccatcaaatgctgtagagtgggcactggcagagatggtgaacaatccaaaggtcatgaagaaagcagtagatgaactcgatatggttgtcggtaaagaaaggcttgtcgaggaatccgacattcacagcctcacatacctcaaggcgtgtatccgggaggcgttccgcatccacccctaccacccattcaacccttcccatgtcgcgatcgctaacatcaccatcgctggattcatgatcccaaagggtagccatatcattttaagccgaattgggcttggtcgaaaccctagagcacgggataacccactcgaattccgaccagagcgacatttgaagaatactgataatgtggtgctagctgagccagagttcggtttttatcattcagtgctggtaggcgtggctgccccgccgtatcactcggaacttcaattacaatgatgctttgggccgaaaaactcaatactgatgtaataaaaaaacatatttgtaattaaaaaatatttacaaataggtccttggcgccaataacgctggcactgaggaactatttgtaaatattttacaaataaaaccatttttattacaaataggtcttgttaaataaatttacaaataggtcctcagtgccaacgatatttgcgtcgtcccacatcacattagtgacttagattccatccaggggtggaggggatggtgtcaacttcattggtgttgttccgttagatcacggcgccaatgacgttggcgttacggaaagggccatttatagaataaattttggagtgtatatttgtaaaataagttttttaaaaggaccaaaaggtgaaaattcaggggtagccactgattagagaataggctgtttaggcgacgactaggcagattagacggtctaggcgtgttttctaatttttccatagaaatacaaaatattgattgaaaataacacatgttatatagtacttcctccgtttcctgttataagacattttgactnnnnnnnnnnnnnnnnnnnnnnnnnnnnnnnnnnnnnnnnnnnnnnnnnnnnnnnnnnnnn

SEQ ID NO: 26507 - DNA, 841 bp, Oryza sativa
  unsure (1)..(841): unsure at all n locations
nnnnnnnnnnnnnnnnnnnnnnnnnnnnnnnnnnnnnnnnnnnnnnnnnnnnnnnnnnatgggctagagggtggccaccacccttccctgcgtgggccatgccattcgatgtacaacaagaagaccctacccagagtttcaattctctggtgaggcgacatatatatcaactgctaacttatcaaggtacatatgaatatatagcttcctctaccttggtattattctttaattaacttaattccgtgtttgtatcacactactacaaaaatcgtttttctgtacgagggggtcggtaggttccatgcggcccgcttgtggcagcgcctgcaaaaaccgcccccctggggcgggttgattagccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacataccaggtacatggaatggtggaattttttttgggaagccaaagccatttaaccttttgtatgaaatacctgcggtc

SEQ ID NO: 26508 - DNA, 792 bp, Oryza sativa
  unsure (1)..(792): unsure at all n locations
attatgttgtatgagatatgctaaaaaaaatgttgtatgagatgtgaaggttgtaatgtgtttttagaatatttatgtgctgctgatgatgagagaatgtaaattgatgataggtaattgattttgctaaaattatggatgaaatatttgtattttgctaaatttagcatcagccgaattttagttgggctgaaatattgcagtagcccaatttgaactgggctgaatgataactaaaaggccataaaaacaccacaaaaaaacaaattggcccaaaacaaaaaaaatccagttggtcataaatgggccgaaagctctaggaacccgaattggaccaaaaacacatgggctaaatcctaggtggcatcgatgacacatcattgtccaccttggcaaacatgtggcacatacgtggtgattcgaatccgtgatcctacatggcagataatctgtgacggaaaaacatcctatgtggcagctatccgtgacggttatttttcgtcacaggaaatgcgcttggctggactaactaggcctcgggctctatcgtgacggtttaaaaccgtcaccgattctgttaatctgtgatggttttcgacaaaccgtcacgcaagtcaatccatgacgctcaatccgtgatgatttctgaaaccatcatagatgttgtttggtgacggtttttcagtgatccgtgatggaaattttccatcatggattaacaggattcttgtnnnnnnnnnnnnnnnnnnnnnnnnnnnnnnnnnnnnnnnnnnnnnnnnnnnnnnnnnnnnn

SEQ ID NO: 26509 - DNA, 804 bp, Oryza sativa
  unsure (1)..(804): unsure at all n locations
nnnnnnnnnnnnnnnnnnnnnnnnnnnnnnnnnnnnnnnnnnnnnnnnnnnnnnnnnnntgaatatatagcttcctctaccttggtattattctttaattaacttaattccatgtttgtatcacactactacaaaaatcgtttttctgtacgagggggtcggtaggttccatgcggcccgcttgtggcagcgcctgcaaaaaccgcccccctggggcgggttgattagccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaagg

SEQ ID NO: 26510 - DNA, 774 bp, Oryza sativa
acgccgcctagctagaaacacacatgtaaattaagccaatagagggtcaattagaagaattgtttgactaatcttgcctgaattttcgttcttaatcatcctcaacaactcttgttcctcctctagaaaattaaaaaacaacttttttttcctcttcagaacctgctgataagtaaaacaaataaacaaacaaacaagctaagaaataggctcgatgaagtacatttcagcattcagcattacacgtgggatcaaattgaatggttaactaccacgagcacacagagagacagcaagagtccaaaaacccaagctattatgcatcgttaattaattgtactgcatcgcctgctgtactgtctgaaactctgaaagaatagtgatggagcaaaaactctgaataatactagtagcatgaatccaacgagatagacgacgaggatgatcagtcgatcgatgcccacgcctgaatgatatgtccgacgatggtttgatggatttcattcctgtcctggatcgagacgtttgttcttcttcttgtttctgctgctgctagctgccgctttgtttaactgatcttgacacccttttttttttctgatgggtgtttgttttgattgataagaggctactagtaacatgcatgattagggcaaggacgattgtgctttgcatggggaccaagcgtggctaatctctcatgtctcatctctcattgcgtttggagtttttctccacttaccttatgcttgcaatgatgatgatcggcgtttg

SEQ ID NO: 26511 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnncgtttgttgcggatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgtggccggtaagcccctgctggtagaccccatggttgaacgtagcaagaactgggtttgggcgcgcagcacaggtcaagtctcggataagggagacatactattcgagactccagacatagaagaagtgactactaatttgcagcagatagtcgagaaagaaagatcaggacagttcgtcccacggagggagcgagatcagcttactgcggcgttggggacggttgaacactctggacgtgtaaggggtttgtcctcaaagacaagttggaaggtcgggtttccacaagacgcaccaagttataagaagagagacaaatacaaagaacaactatcggacaagatctatacacaagtgaaggaacacttctactcgttggcagctgaaaacccgacagcctttccaaggttattccctgatagccagcaacccacacaatccgcacagcaaacaactaatgtacccagcagtgtaggctcagtgcagacaactatcttccatgtggatagtataactggaccaacttcgtg

SEQ ID NO: 26512 - DNA, 684 bp, Oryza sativa
cctattatgccgctgtgttaggcgtctacgacttcaccgtcggcctgtcttcgccaccgccgactggtgtctccgcctacacagccgacctattaagccgctgttgttgggcgtctacgacttcaccgccggcctgcctttgccgctgccgactggtgtctgcgcctatacggttggttggtcacaccactgttcatgggcgtccacgtcttcaccgaccggcttcccttcgccgccgccgactggtgtctctaccaacacggccggcctattatgccgctgttgttgggcgtctacgacttcaccgccggcctgccttcgccgccgccgactggtgtctccacctacacagccggcctattaagccgctgttgttgggtgtctacgacttcaccgccggcctgccttcgccgccgccgactggtgtctctgcctacacggccggcctattatgccgccgttattgggcgtctacgacttcaccgcaggcttgccttcgccgccgccgactggtgtctcagcctacacggccggcctattatgccgctgttgttgggcgtctacgacttcaccgccgccgactggtgtctccgcctacacggccggcctattatgccgccgttgttgggcgtctacgacttcaccgccggtctgccttcgccgccgccgactggtgtctccgcc

SEQ ID NO: 26513 - DNA, 716 bp, Oryza sativa
  unsure (1)..(716): unsure at all n locations
nnnnnnnnnnnnnnnnnnnnnnnnnnnnnnnnnnnnaatctagtagcatcatcaatcaatgtcatgaaatatcgtttttcacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatgaaaaacttaggaattaaacacatgctggaaagccgagacatcaagccgaaattaatatgacataaacgtgaatgccaaacattagcctcatcatccacactgccacaaatatggttcacagacatattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacattcttcagctgcacgatctttcccgaagtaaacttcagatctaccgtgccaacaacatgaacagaagcatgtgacccattccccattaggacggtggaaccccgtgcgacctgataagaagaaaacaatgagatgtcagcacaaacatgtacattggccccagtatcaacccaccaattagtagattg

SEQ ID NO: 26514 - DNA, 593 bp, Oryza sativa
  unsure (1)..(593): unsure at all n locations
nnnnnnnnnnnnnnnnnnnnnnnnnnnnnnnnnnnnnnnnnnnnnnnnnnnatacccaatcggcgatggactttattctcggcgcggataataaagagcagcagagcaaacttacgggctggctcggtgaaatggcgtcctattactcagctgcgcctgttcgcctgggtggggcaagttccacacctgttgccgggtgattctctcaaccttcagtcggcgcaggataccgataacggctactcgactttgaacagtcacctgctgcgttatattgccgctgggcttggtgtgtcgtatgagcagctttcgcgaaactattcgcagatgagctactcgaccgcacgcgcaagtgctaacgagtcctgggcgtactttatggggcgtcgcaagtttgtggcatcccgacaggcctgtcagatgtttctttgctggcttgaagaggcgattgtccgccgcgtggtcacgcttccttcgaaagcccggttcagtttccacgaggcgagaacagccttggggaatgccaactggattggctctggtcgaatggcaattgacgggctgaaagaggtacaggaggccgtcatgctcat

SEQ ID NO: 26515 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnnnnnnnncaaaatgaccatgcatatgtcctcacctttctgatgtcaatagccatggccatcctcttgctcgttgcgttgttctatcggatcaagaagcaggcagctgccatggcggccaagaggaagcaacaacccaagctaccacccgggctagctaccatgccggtggttagcaacatgcaccaaatgctgatgaacaagccggtgttcaggtggatccaccgcctgctcgacgagatggacaccgagatcctgtgcctccgtttcggtcgcgtccacgtgatcgccgtcgcctcgccggagatggcccgggaggtcctgcgcaagaaggacgccatgctcgcctcccggccatcgtcgttcgtgtcgcggacgttcagctttgggtacaagaacaccatcatgtcgccggccggtgaccagtggaggaagatgaggcaggtgctcacgtcggagatcctctcgccggccatggagcggcggatgctcggccggcgcgtcgaggaggctgaccaccttgtcaattacgtctacagccactgtaatgatggcactgtagacgtccggcacgtaacgagacacttctgtggcaacatcatcaggaagctggtgtttggccggagacacttcaactccggcgagggcatatctggcctggccg

SEQ ID NO: 26516 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnnttcttcatcaagtttataaaaaatatagcaattcttatgatacaaaattagatccattaaatctaatactggacatattttaatagtatatttgcatggtgccaaaaatattgttatatgtttttctataaacttgataaaacttaaataattgtgatttagaaaacaaaaggcatattataatatggaactgcgggagtattaggtaagaaaaacttgaaaaatagattaatatgaattattatagaactatttttctaaagaaaatcaccatttagccatctagaaagcgtgcgcgcggaaaacaaatgggtaaaagttgggaaatataatatagaacacaacctaaatgcattgattagccacaagctagtaaatcattcagccaccttggtacgacatgatacatgggaaattgaatatggagtatggacgtacgttctcaactaaatactagtgcgagttttgcttttatgatatttgagaatgtaaactaaaccaaaactaagccttgcaaaaaaaggcatgaatggtaggaacttcaaaaaccgaaaacttttaacgaaattaaaagttaacctcaaacctgatgatgaagatgaaaagaaatataattgtcaagtctcaaacaaacttactttaactgctcatgcgtttggtaagtgaaacgtcatgtttcattat

SEQ ID NO: 26517 - DNA, 705 bp, Oryza sativa
  unsure (1)..(705): unsure at all n locations
nnnnnnnnnnnnnnnnnnnnnnnnnnnnnnnnnnnnnnnnnnnnnnnnnnnnnnnnnnnnnnatatatgtactgttcagtaatgagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgttatcacttacaaattcaaaatagtgaggaattccataaatgtctccttgtcatagtgtgcggggtccaatgatatgatcaattggtctttcggatatacaaggaataatatgtagtggtctctacatataagataggcttattggagatagaaaattccgaagaagataaattaattaaacaaaaagaagagagagcttacgtgaactggtaggggaccattaagacatctttatcggcgtgcgccaacattgctattgccaagtatgttgctacttctagcttcttcctcttgtgcaatgtcttcacatattcttccttttcttccggggtcttgccaaccaattgctcgcagtcctctctcagctttacggggggttgtggtttgcatattctttttgggatccacgtatccaaactttgctccagttcta

SEQ ID NO: 26518 - DNA, 7429 bp, Oryza sativa
gcaggttctgctgctgctgctgtgcttgctgatgcacctgctacaacacctgatggtgctgtcgctgcatctgttgcatcatcattgtcatcatctgagtctgattgtccaacacctgagcaatcgttgggttctcgggcggtggagatgaactgctgctagatgcatcgcttgcacgtgctccactgatctgctcttcgctgccactggcgttgttggattcccgggaaccattccttgtcttcaccatctgaagggggataggtagaaatatgagaaaaggaagaaaaacagggggctcagaatctaatctttcttataaatttaggtacaattatcttaattttgattaaaacaccgaaaaggaagcaaacaactcctaattaaggcagccataccactcacacatgatatcgaccgccgactaacccacaagcagcagacctaaacacagaaactagcaaacaacaaactaagaaagacgataaagctaagggcggcgactctgaagctcggagcggcgcttgcgatcggagaacaggtctgacatctaaagatggacaagggataggaaccaattcatgctcaaatccaaattaaacaaagcaacaaatgactcaaataaataacctagcatggctgatttttatgcatagaacatttttcgtgaactcaaatgaagatactgatgcaactggctaatcaataaattaatgcataaaatagatgcatagctataatgatacgcataaaattgccccatcgaacagagacacgacttagtgcatatcacccgttagatttccgactgactgtcgaataaacctcaaataaaattttactaaaaccctagactgagctaattttaaagatccgatccgaatgaactaccaagatttttcccgcaaaccaaagaggcaaaaccccaaattttcccgaaacaaatccaggtgcaaaaggcatatgcagatgaaaagcggttcagagggctcttaggtttccagttggcttgtcctacggtcaaggctggctctgttaccaacttgtcacgcccagaaattcacgaaccagaatttctaagaatttttcctgggattaaatattgcactttggtgatttttaattggttaaaattatttccaaggctctgaaaattccactaaaaatcttgttaatgcattagagcatggggaactcaagaaaaaatccaccacgccgaattcgattattaattgcatttattaattagggaattagctctatgttaatttgaacaatttcttcggacgatttatttaacaaatttttaaagcaaggaaaaaagggggaaacttcagggcgtgacattacacctccaccaatcagcctaacccattggcaccagaacagaggaaccttgagaggtccatagtaaagttctcatatgtcctcaatggcaccgtaatacgtgccagttgtaccatcgtgtcccatggcatccatacgaacagcactgttctggttcgtgctctttatgtcttgggctctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatagacaacaaataaaacccttatgcttgttagcttcggccactctcaaaaaataatgcaccctgtcgataaactatttggaccaccggtcagcgtacatccattgccgatccacctacatgaaatgaaaaaaagtcatacataaataaatattcataaaataatgacagccatacaataatgatcaaacaattaaaaactctttcaatagtcatacaataatgacatatcattattcatacaataattataaaataatccaacaaacaattcttatttattatttttgaatttttaaactaatattaatgttgtacttcttttaattttcaatttagtttgttttctatttttcaagattaattttcattatattttaaactatgagaataaaacttttttaagtaaacaaacaaaattcctatatattcttcttccccacacaatttgtttctctcatcaacttacgacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaacttcaccatacctctcatcttctcataggaaacatctaaatggggccactagacagccactcatacttggttgagtgaagtacaagtgggatcacagcctcaaaccactgccaactcctttaaatcgtttctacccctcatgttgacaactagctctcactttccaccttcacttttaccattcactactacaaccaagatttttgtgtgagggctaaaacgatttttgcgagcgggtaggcggcccgcacgcacctaggggtctaggaaaatgatgatttttgcgtgcgggtggcgcacccccacgggaaaacaaaaatccgaaataacataattttttttaaaaaaaacgaaaccctagaatccggcggcgggcttccgcccgatagccatagtgccggctgcctcccgccggcctccgcgccacccaccgtcggatccgcgctcccctccggctgcaacgtcgacgacgcccctcccctccgccggatctagggagggaaagaaggggagaggaggggagctggatcccacgcggggagaaggcggctggctgccggatccatgcggggacgaccgccaccactggattcttgcgttgacggccaccaccgttggatccgtgtagggactaccaccgcccgccggatcccgcgccctccaccgcagccacatggaggaggccggcgcgctcctactcccaccaccgccgcgccgctgctgtcgccgcgtgccgccgctgctgccgccatcgggaggagaggagaggagagtggagagaggagaggagaggcgtgagagagagagtactgagaagagaagctctgcgtggaaattttaaagtggaaaaagggatagaggggaggggagaggagagaaagaggggaaattttaaagtgggtgagagaggaaagagggagctagtatttttg

SEQ ID NO: 26519 - DNA, 2935 bp, Oryza sativa
ctcgtcggcgttcccggtgtccagagcgccaccatcgtcccactttgtcattcccgtcaactcgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactctagattagatagatggtttaattctatagcaaaacattagagttggctcatcctatagcttctatagtaatagttagccacaatcttgtaaatacccaattattttatgtaaagaaatttccattggagccttaatcaaatgtatgcgatgaagattcagattgttgaacctgtatcaatctactgatccaggggttgattgtcacgcccggaatttctatccaaaattccaaacgcttacatgtgcgttaaaccctcatccaggaatcagccgaggcacacaataacaaatgataatagagtactatcaaatatctaattaatgtgtgcaaaataaattattacagaggtggatagttcctctcaaagaataaagttctacgcagcggaaaaaaaaacaaaagactaaacatctatggcgactccactccacaagcaactcgacccgaacaaagcctaatcctcctgatcatcaccttcattgaagcactcctcctctgaagaatgaatattgcaagaatgagcatatgacatactcaacaagccacacagcaaatatgcaaatgcataggataacaaaggatggcataattaagctcattcgcataaacagcatttaataaacatttgagagaatagtaaaacagttaagtaattaagcaatattaaataaacactatacatcacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaa

SEQ ID NO: 26520 - DNA, 37596 bp, Oryza sativa
  unsure (1)..(37596): unsure at all n locations
ggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcactgaagcactcctcctctgaagaatgaaaattgcaagaatgagcatatgatatactcgacaagccacacagcaaatatgcaaatgcacaggataacaaaggatggcataattaagctcattcgcataaacagcatttaataaacatttgagagaatagtaaaacagttatgtaattaagcaatattaaataaacactatacaacacacccatgttgcataggcccaaccttatctgaacaaccaacccctaggtgtacaaatcaaacctccaaactaggaaatataccattccaaaccaagagtcaatttagttatcacagtattttcattaatactgagtaatgtgagactaatcacgaaaaacattgttagacccacccataaccgcgggcacggctattcgaatagttttactctgatcagatatgtaccactgtacccacaagacacaactccacaacatgtcagcatgcgcctcagtaccaccacggtaccttggaaaggaactatgacaatacctctcacacaacacaactcaccacattgcaccgttcctgatcataatctccccctcataaccaggggcaatggactccctcgcgacccccacggacttctcgccgcttcacagtctggcaccccgtaatgaatcatgctatacaaaaggtaaagccgttgcccacgctggcttgtggttggcacggtaaatgtttcacaacagtagctcgtgaaacggtccttaattgttatgagcacgaccatcaaaaccatgtactcacaacccactttaatcaggtttatgtatcaattaattatcataacacgattaaccatcgtgagctaccactaaatataaccataagtaatatccttatatgattaaccccattaatgagctaatgtttctaagcatggctaagcaattatacctatatagcacctagctaaaccaaaccaatatataaggtccaagctattcaatttattacccatagaaaaataaagtcattgtcggccattaattaactgggaaaggctcaccacccgacgacattcgaaaataatgcataagttgaaataaaacattagctttaaacaggttcaacatgctcaaagggttgtttcagatctgtgtgacttgccttgagcttattcaaacacttctgaaccttcctcaacgtaaacgctctcctccggaatatcggaaactaaagcaaataaacaaaatcaacaaaacagtaaaaaaacaagcataaatagtacatgtggatatttttaacaagtagatcttgattttagatgaatttagcaacttgaaccactcgaatccgagttacgatgatttagttatgaatttccgaagtttaatcgattttcaacgaatagaaaaaactaataaaaaggatttatgacgtcatcgatgacatcatcgccggccatggtacggctccacgcgaccaccggcgatagagagctcggttgggctatccggggacacctacgagaagaggacgacgacgcgaactcatcggtgcaagaaactacgacggacgacgatgtacggcgaccggcgatgaggacgaacggcagcgcggctcgggtcgacgacggcggcggcattccagcggcttgcgacgacggcgaaggggtggccgaggtactcctccaccgtgcgaacccggcggcggcgacgctagcggcggtgtggcgcgactggatagtcgccggcgacggcggtggcttgagctacgcggcggcagcgctacgagcaacggcgggactcgggacttggggcaaatggaagaggacgactaggggatgctttatataggcttggattagagagatcggactccaaccgagaggaatcgagctgggaaaaactagggttagttttttttaccaggaaaactgccagggctttgcccaacagtgtaattttataaataaagaaaatatttacaaggttacaaatattacatgcggttcacacagagatactataaggtttgtacccaattaaaaacagtttgctttaaaggttcattcattatgcacatatgcagaagaacttctttgacgaaaagagatctccatgcctgaaaagagggttggatgttctgaaatatgaagccatttctttgtttccagatgtgccaagctgccaaaaagaaaatttccaggaaacccttgtgagcaaatttgattcttgctagagagatcatttggaaaaactccaaattgttattccactcaattcctaggtattgccaacacctgatgctgaaagggcataaaaagaagaggtgcagtcttgtctctctgcagttcgcattgcacaaaacacatgtgagatcatcttctttggtacaatgtcttctatccagcatatctcttgtattaagtctatcacagaacattagccaggcaaagaccttgatcttcatgacacattttgttttccatagccaaatcatgtgtctggggggttgcaatgcagaataatttcttagcagtgtacttatctgagccccagataaaattccaagcatcccccatccctgattgtaagttcaaggtgtccagaaccccctgaagttgcaagaattctgaataagcctcatccgagagggatagagcaaaagaatcttctaggggtagctggtagacatggccttgactgaatcagacttatacaaagtcacagcaaagagattggggtagctggtgcacttaaaatcatcattccatagatcattccagaaaagggcagttcttcctgtcctgatttcacattttgctatccccctgaatatgtctgcaagagttgtgatgtccctccaccaaaaagaacccttattcatcgtcaggtgtggaactttagaaacatagtatgattgtgagattaatttcacccatggtaaatcagcaccattatagaacttgatcatatgctttaggagaagggctgtgttttgaactctcagattgatcactcctaagcctcctttctccttaggcatgcacaccctatcccaggacgctagagatttccttgtcgaagaagggttattacctctccacaggcaattcttacgagctgtgtcaatgaccttgatgactgtaactggtagctgtagtgaggacatgtaataggttgggatagaggacaggactgagttgatcaaagttaatcttcctccttgcggtaaaaaaattgagcttgccgtcagcctcctttcaaccctgtctaccaatgtagcaaatcaaccactctaggcctggtggttcctaaaggtagccccaaataagtgaatggaagagaaccgatcttatatcccaagacgccagataataagatagctttgtcttgagacatattaagtggatacaggcttgatttattatagtttaccttgaggcctgtggattgagcaaacatatttaaaatagccttgaaacagaagacttctttctgagatacttttaacaagatcaaagtgtcatcagcatactgaatgattgggaaaccatcctcactgctttcattaattggttttgacaaaagtccttgatgaaaagctttattgattattctttgcaacagctctgcccccaagacaaaaagcagaggtgagagaggatccccctgtctgactcctcttctgcatttgaaagtattccctggcaccccatttaataacacagcagtagaagcagtagagaaaaccatctgtacccactcaatccattttggagaaaaacccatatgttgcataactgagaaaattgcagaatgctcaatacattggtgaatatattcaaaagaccaggtaagacaatcctgtatggtttttcctttgatgaaaccatattggttatcactcaccagtgtaagaattaccccttgaagtctatcagctagcaatttagttaagattttaagactgatacccgtaagggaaataggtctgaaatcattaacagtctctggggaggttttctttgggaccagggttatgaaggaggtattaaggatttccaaatcaacatttccgtcagtcgataatagtcctgagctatgataggccaacactttttcatgaaaaatccattgaaaccatctggccctggtgctttgtcagctggaataatagagatgagactatctacttcttgagttgaaaacatgtcaaccaagctactcaagtctatatgtctgccaaaaagggagtccaagtcaaaagccatctgtggggaattagatacactcaacctattctgaaagctgcgatgaaacaatgaagccttctgctcatggagatgtagaatctgtccatcatgatcaagcacctatgagatagtgtttattcttaacctttctatggctattgactgaaagaattttgtattttcctcccccaacatcatccatctactagtacacctctttttccaatagatcttcctgaattccaatagtttcaaaatctataccttaactatttctctgaaattccactcatagactgatagcattctgttttcttcaactaagtcaagaaagtccactactttgttccaattttttagcaatcccatcaactttgacagattcttactccaggcaaggagctttttcctaagcactttcaatttgaaagaaatgcaaactagggttagtttggagagataaactcaaaacgaattcgatttggttgatccgggcaaaattgatctccgaaactctaggggaaaaggaggagatgatttcccctcaagcaatcggactcgggggcgaccggttgaggaggaatcggaggagaggctgcggcgctcgggctcagctcggcccggccggaggtaggggatgaccccgacatgagggccccatatgtcgacggctagaggagaggaggggcggctcagcttggattgggccggcgtgggccgcacggctacgcgcgagggagagtgatgttgggccggaaacggcccaacgggctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagctcaattttatgttgaaatttttcctagattattagagtttaacttgtaggttttaaaataatttctaaaaatgcattgaaaactgaattattaaattaggctattttcagggcgtgacattgatatagtttaaacatgtatgttaccgaatctttaattttaggacccgacaaggtgtgtgggtgggggcccctgcgatttgggagcctagagcggctgtaccgctccccccccacaccaagcttgccctgactacatgggccttgaaaggccacatggcatcttatgacgatttctgggcttgatggcgacgaaaatggacgtcatagactctatgacgacagaaggatcgtcactagattagtaacaaaaagataagctttctttatagaacgccattagagacgcatgataggtaacgaatgatattcgtcacacgaatgtcatagatttcacaacatggtgaatcatctatatatgggcctatttgtcgtctaaatacctgcaaacaaccttggtgaatcatctctttgatcgtaaattatattttcaaagagacaaagaaagagagagagagggagttaaagtccaatcttgtcacaccctgaaaatcccaaatatataaattgttgtttaattagaattattagaaataattttaaaagcctagaagagaagatctaattttaaataaaaaattccaatataaaagtgggccagataaaattttattaaatacttctcttgattctatagttcctagatttttcagggatttatttgagccaaggaactatttttaataaatggaattgcatttcatgaataatttaaattgaaaaagttttaaaaatcctccttttggctttgggccgaaagttggcccaaaaccctttctctctctccctcagcccagtcggcccagtcagcccgcagccacccgcgcgcgcgccctcgcccgctgacaggtggggcccacctgtcaggcttcccgagccgcgccgccgtctccttccaaattcgatcgcgtctttccttctccggtcgaatcaatagaggggaaatgatctccgggacctcctctaccttttctcttttggaatcatcgtctaattttgtttggaaagcgccagattcgatctcgaatcggattcctctctctctcccgccgaaccctaatttttccatcgccgtcgccggcagccatgggcctccaccgccgcccctagcccctttataagaacccccgagacctcctctccacgctgccaccctcgccttagctcgcgccgcctgtagcgccgcctccgcgttcaaccgtgcgccgccgtcgccgccgcgagttcagccgagcaccgccgtcgctccagtcgtcgtcgtcgctcgggaaggacaccgtcgggatcaccaggtcatcgccgaggatcgccggaagaccgccgtcgtcgtcaagccgaccgtcgccgccgcttcttcctcgtcgtcgtcgtcgtccggtcgccgtccgccgccgttcgtgcctcggtaaggatcgccgcgtcacccgctacgtgtagatgtcctccgtttgcgccgccgcgccgtcgttcgccggtgagcatccgtgtccgagccgccgccggtgatgacatcaccgctgatgtcagcgctgacgctagccgtggaccggcggtagatcgataagatctcggccgttcgttttggataggatatatctcggccgttcgtttccgtagaccgccgccgtgcacccggtccatcgtgaacccgagccgctgacgcaataatccctttttccttttcaaaaataattcattattgcgtcataattcaattaaaatctatataaatgatttaatccgatttaaactttgaaaattcataactaattcatcttagctcggatttagttggttcaagtctctaattttttctaaaattgagatctacgtgttaaaaatatccgcatgtactgttcatgcttgtttatgtgctgttttggtgattttgctcttttctctttagattccgacgttcccggagagtccgaatttgcaggagaagactttgaagagttccaaggccagcaaggcaagtcacacagatcccaaacaaccctttgagcatgttgatcccgtttaaagctattgtttctattcaactatctacctctgtaatgacattatattcacttattaattagagttataattgtactctattatcaatttgttattgtgtgcctcagttgattcctggacgagggtttacacacatgtaagcgtttggaattttggataaaaattccgggcgtgacaagttggtatcagagccacctagaccctaggttatgccaaatggttaccgatagaagccctctaaaaatattggaaaagtagaactgttctcctctctttctcttttaattaaaccaaactaatggcacatgcagtttatagtctcttttaatggttctcattcaaaatttatttatgattcctgtgttgttagtactgtacatctattactgtactaatggcccatttaccagcaaaagtttcacaacattgatttatttaatcttgctgcaatgaaataagcttagcatgttgattttataactttcttttattttatttcttttgaaactcgttattaaaaagtgcaaaatttctaatcatgttttcaactgtttcaacttatcttgcaagattggtttactttatttatttaccttttactttgattttctaactttaatttaatccaaaaacttgtgctattaattggataaatgtcttaactctgtcctttcacttgtctttagatgccgcgctacaagcctgagtacttgtttggcactaagggatttgtccaggagttgcgtacgatgtcctttgccataggatttgggactgctcctttgtatgcccagattcctcatgatcgtgatgaagagaagtgccgtgtcaaagtcaccttgaacagtaatcgtgaagatatcccatcggtgatgttcgaggctggttggggaagctacattcatgcttgtcaggaggtggcaaggatcaccataggagagctccgcgaaagctacaatgatcggttggccaacactaagtatcgctaccatcctcgccaaccccagggaagcgatcgtggcagctaccttgaacctgcagggattgagaatgatgctaccacaaggcatttggttgagatgctgtgggccatggatgagacccgcgctgagattgtgatagcagctcaagatcgtgaagacaggaatcgcggcaagatctgcaagctggaggacaaggtggatcatttggagaaggaactagccgcattgacgggagaagcaccaccgaaaaaggccagggtttgtcttaccgcaaggaagagagctctattcgttcctcgctaccagttggcgccaaaggttcgtgtggtggaaaaagaagctaccccagccccagcggatcctccggtcgtcaacgtaagtgatgatgatgaagaagaatccaagcgcacccatttaaaggtcgagtggggagctactcaagatgatggggacgcgccgaacgagccttcaatcaactccgatgcccggaagacctagaacgccttgtcaagccgttgccttagatcgttgtgttagtttgcttgtttaagtttggttgtgtgtgtgggtcttgcatgtgatttacatcattggtgggatgtaaatgcatgcgtttgtttgctttcgagtgattaggtagttggtgagttaagtggtgtgagagtcttcagttttgtaataatgaaactcagttaagatcaataaaagtcaagctagtaaaaaaaaattaatttcctgtcctaagtagttttttcccctgtttctctttttgtgctcctgtctatgccagatggtgaatactcgcagcactgggaatggccccaacaacaacaacaacaacaatggagagaatcccacgcttgcccaagtcctggctcaataggcacagcttatgaatatgatgatgcagcaactccagaaccagcagaaccagggaaataaccatgcacctccccagaacaagctagcagaatttcttcgtgtgaggccgcccactttttctagcactaccaatcctgttgaagctggtgattggctgcacgccatagagaagaagttggacctgcttcagtgcactgatcaagagaaagtctcctttgcttcacatcagctgcatggccctgcctctgagtggtgggatcacttccgtctcaacaggactactgctaaacctatctcttggctagagttcaccgctgcttttcggaagacgcacaaaccatcgggagtggtgtctcttaagaagaaggagttcagagagctcactcagggatctcgctctgtcaccgaatacttgcatgagtttaatcgccgggctcgctatgctccggaagatgtatgcactgatgaagagcgtcaagagaagttcctggaaggactgaatgatgagctttcttacccattaatgactggggattatcatgatttccagaagttggtgggtaaggctattcgccaggaggacaagtacaaccgtatggagcagaagaaacgcaggattgctcacttcaaagctcagcaggggaatagtcagaggccgcgtcttgcttagggacctcagtcagtacccagggaggttcttcgtctgttgttcgtccgcagcgtcagttcttcaacaacaatgctggcaacaacaaccgcaatcaagctccacgtccggtggcaactccgacacagcatcagcttgccaagagggagcaagggaacaagctcggagtgtgcttcaactgtggtgaaccaggacattattctgactagtgtccgaagccccgccgcgtgaaggttgtccctgcccagaacaactcctccgcaccagcgacaaaggctcgtgtcaaccatgttgctactgcagaagcccaaggtgctccagatgtgattttgggtacattccctgttaattcagttcctgcaacagtgcttttcgattctggtgctacacattcctttttatctatgagttttgcaggaaatcatgggatggaagtagaagatcttagacgtcctttgatggttagtactccgagtaaccaagcactctcatcgcaacgtagcccctctgtcagaatagagattcaaggagtaccatttctggccaaccttattctgttagaatccaaagaccttgatgtcatcctagggatggactggttagccagatataaaggtgtgatagactgtgccaatagaaaagtaactctcaccagcaatgacggtgaagttgtaactgttcatgcattgtcctctgaacctctaaggtcaagtctgaaccaaataacgttggaagagattcccatagtacgggagtacccggatgatttacctggtatgccgcctaaaagagatatagaattcagaatagatctggtaccaggaacaactctgatccataagagaccttatagaatggcagccaatgaattaacagaagtcaagaggcaagtagatgatttgctttagaaaggatacatcagaccaagttcgtctccatggggagctccagtcatctttgtggaaaagaaggaccatacccagaggatgtgtgtggattatcgtgcactaaatgatgtgaccatcaagaataagtacccgctgcccagaattgatgatttgtttgatcaacttaaaggtgccaccgttttctccaagatcaatcttcgatcagggtatcaccagttaaggattaaaaaggaagatatacctaagaaggcttttaccactcggtatgggttatttgaatgtactgttatgtcttttggacttactagtgctcccgctttcttcatgaacttgatgaataaggtgtttatggaatacctagacaagttcgtgctggtctttattgatgacattcttatctactcctgaaccaaagaagagcatgaagaacatcttcgccttgcactagagaagctacgagaacatcaattgtatgccaagtttagcaaatgtgagttttggttgtctgaagtaaagttccttggtcacgtcatctcagccggaggagttgccgttgatcctagcaatgtggaatccgtaaccaactggaaacaaccaaagacagtttcagagattcgcagtttcctgggtctcgcaggttattaccggaggtttatagaaaatttctccaagattgctaagcccatgacacgactgcttcagaaagacatgaagtgcaagtggtcagaagagtgcgagcagagttttcaagagttgaaaagtcacctaatatcagcacccattttgattttgcctgatctaaagaagggtttctaagtgtattgcgatgcatctaagcttgggttaggttgtgttctgatgcaagatgggaaggtggttgcctatgcatctcgtcagttacgtccgcatgagaagaactaccctactcatgatcttgagttagctgcagtggtacatgcgttgaagatttggcgtcattatcttttcggtactcgtatagaggtgtacaaggatcacaagaatttgaagtatatctttacccagccggatctaaacatgagacaacggagatggttggaactgattaaggattatgacatgggaattcattatcaccccagaaaggctaatgttgtagcagatgctctcagcaggaaaggctactgcaatgctacggaaggacgacagttgccatgggaattatgcaaggaatttgaatgattgaatctgggaattgtcagtagaggtttcgttgcagccttagaagcgaagcccactctcattgaccaggttagagaagctcaaatcaatgatcctgatattcaagagattaagaagaatatgagaagaggaaaagctattggatatttggaagatgagcaaggaactgtatggttgggtgagagaatctgtgttccaaagaacaaagatttgaaagatgcaattctgaaggaagctcacgacactttatactccattcaccctagtagtactaagatgtaccaagacctaaaggaaagattctggtgggcaagtatgaagcgtgagatagcagagtatgtagctgtgtgtgatgtttgtcagcgattcaaggcagaacatcagaaacccgcaggtttgctgcaacctttgaagataccagaatggaagtgggaggaaatcggtatggatttcatcactggtctacccagaacgtcatcgggccatgactctatttgggtgatagtcgacagacttaccaaagtggctcatttcatcccggtaaggacaacatattccggaagtcgctaggcggaattgtatatggcaaggattgtgtgtttgtacagtgtgcctaagaaaatagtatccgatcgaggtagtcagtttacttcaaagttttggaagaaacttcaggaagagatgggttctaagctgaacttcagtaccgcttatcatccgcagacagacggacaaactgaaagggtaaatcagattttggaatacatgttgagagcttgtgctttagacttcggtggaagttgggataagaatctgccttacgcggaattctcgtacaacaacagttatcaagctagtcttcaaatggctccttatgaagcactgtatggtcggaagcgccgcactccgtttttgtgggatcaaacgggagaacgtcaggttttcgggactgatatcttaagggaagcagaagagaaggtaaagatcattcaagaaagattgcgtatagctcagtctcgtcataagagttatgccgacaatcgccgcagagatttaagttttgaggaaggagatcatgtgtaccttcgtgtcacgcctcttcgaggggttcatcgttttcacaccaaaggaaaattggcaccgcgttttgtgggaccttataagattgtcagtagaaggggtgaggttgcttatcagttggagttacctcaatccttggcaggtatccataatgtgttccatgtgttacagctgaaaaagtgtttaagggtacctactgaagaagctaatcttgaacagatagaagtccaagaggatctgacatatgttgagaaaccaatccgtatcttggagatagatgagagaagaaccaggaatcgagttatccatttttgcaaggtacaatggagtaatcactcagaggaagaatctacttgggagcgagaagatgaactaaagtcagctcatccgcatcttttcgccagttcttccgaatctcgaggacgagattctatttaaggggggtaggtttgtcacaccctgaaaatcccaaatatgtaaattgttgtttaattggaattattagaaataattttaaaagcctagaagagaagatctaattttaaataataaattccaatataaaagtgggccagataaaattttattaaatacttcacttgattctatagttactagatttttctgggatttatttgagccaaggaagtatttttaataaatggaattgcatttcggcccaatgccaaaatgaggatttttaaaactttttcaatttaaattaacgcgcgcgcgccctcgccgctgactggtggggccggcttcgtctacctcgcaccgccgccgcagccgaaccctagccgagccgcgccgccgtctccttccaaatttgatcgcgtctttccttctccggtcgaatcaatagaggggaaatgatctccgggacctcctctaccttttctcttttggaatcatcgtctaattttgattggaaagcgccggattcgatctcgagtcggattcctctctctctcccgaaccctaatgtttccatcgcagtcgccggccaccatgggcctccaccgccgcccctagcccctttataagaacccacgagacctcctctccctgccgccaccctcgccttagctcgccgccgcctgtagcgccgcctccgcgatcaaccgtgcgccgccgatgccgccgcgagttcagccaagcaccgccgtcgctctggtcgtcgtcgtcgctcgggcaggacaccgtcgggatcaccaggtcgtcgccgtcctcgtccacccctccgtcatcgccgaggatcgccggaagaccgttgtcgtcatcaagccgaccgtcgccgccgcttcttcctcgtcgccgtcgtcgtccggtcgctgtccgccgccgttcgtgcctcggtaaggatcgccgcatcgcccgcaacgtgtagatgccctctgtttgcgctgccgcgccgtcgttagccggcgagcatccgtgtccgagccgccgccggtgatgatgtcaccgctgacgtcagcgctgacgctagccgtggaccggcggtagatcgataagatctcagccgttcgtttccgtagaccgccgccgtgcacctggtccaccgtgaacccgagccgctgacgcaataatccctttttccttttcaaaaataattcattattgcgtcataattcaattaaaatctatataaatgatttaatccgatttaatctttgaaaattcataaataattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgaatttgcaggagaagactttgaagagttacaaagccagcaaggcaagtcacacagatcccaaacaaccctttaagcatgttgatcccgtttaaagctactgtttctataaaactattgcatttattttcgaatgtcattgggtggaaataacctattgccttgttatagcccttttgctattgattccctattctttgtcacttggttaataatttgattagctagaacattatatggctttagctaaagtgaataggatgcttagccatgcttagagacactagctcatataaaggggatactcatgattcactattatttaatgttggtttaatgatagctcacgatggttaatcgtgattggttaattaattaatttgccaactaaaatatgataatggtgggttgtgagcatatggttttgatggttgtgctcatgacaattaaggaccggttcacgattttcggttgtgaaacatttaccgtgccaaccacaagccagcgtgggcaacggctttactttctgtatagtatggttcattgtagagcaccagactgtgaagtggtggagataagcccacgggggtcgctggggagtgcactactttgaattgtgttatatagagggtattgtcacaatctctattcgggtacttgttaagtatcacgacgcatggttgacatgatgttgtggttgtgtcttgtgggtacagtggtagacctctggctagagtttaaactattcgaatagccgtgcccgtggttatgggcgggtctaacaatgtcttttgtgattagtttcacacttctcaccataataaatgatgctgttaataatttgtttagctcctggtctggaatggtatattcctggtttggagatagaactgtgcagccgggattggttgttcagaatggttgggcctatgcaacagggtatgttgtatagcgttggattaatactgtttaattaatattctactgttttattaaattctgaaatatttattaaatgctatttatgcaaatgagactatactatgccatcctttattatcctgtgcacttgcatatttgctgcgtggcttgctgagtatgtcatatactcaccttgtaatcattcatcagaggaggagttctacagtgatgccgatggtgtgtaggattacgcgtagccctggtcaagctgcctgtggagtggagtcgtctgcgccgtttatcttattttccgctgcttagaactttattgattgagagaaactatctacctctgtaatgacattatattcgcttattaattaaagtaataattgtactctattatcaatttgttattgtgtgcctcggctgattcctggacgagggtttacacacatgtaagcgtttggaattttggatagaaattccgggcgtgacaaatttacacccaaacttcaccatacctctcatcttctcctaggaaacatctacatggggccactagacagccactcatacttggttgagtgaagtacaagtgggatcacagcctcaaaccactgccaactcctttaaatcgtttctaatcctcatgttgacaactagctctcactttccaccttcacttttaccattcactactacagccaagatatttgtgtgagggctaaaacgatttttgcacgcgggtaggcggcccgcacgcacctaggtgtctgggaaaatgatgatttttggcgcaccaccacgggaaaacaaaaatccgaaataacataatttttttaaaacaacaaaaccctagaatccggcggtgggcttccgcccgacggccatagtgctgccggcctccgcgtcacccgctgtcggatccgcgctcccctccggccgcaacgccgccgacgcccctcccctccgccggatctagggagggaaggaaggggagaggaggggagctagatctggcgctgggagaaggcggccggctgcgggatacatgcggggacggccgccaccgctggattcttgcgttgacgtccaccaccgttggatccgtgtaggcactgccgccgcccaccggatcccacgccctccaccgcctccacatggaggaggccggcacgctcctactcccaccgccgccgcgcctctgctgtcgccaccacgccgctactgtcaccgcgcgccgccaccgctaccgctgtcgagaggagaggagaggagagtggagagaggagaggagaggcgtgagagagagaagactgagaggagatggtctgcgtggaaattttaaagtggaaaaagggatagaggggaggggagaggagagaaagaggggaaattttaaagtgagtgagagaggaaagagggagttagtatttttgcatgcggctctcttaataggtccgcatgggaaaatcggctcattttcacgtgctgtccatttaaggggaccgcatgaaaaaatcgatttttcccataagcaacgagttgccgcacggaaaaattgatttttccgtgtcgtcctcttnaatggacggcntgngaaaatgagccgattttcccagaagcaacgagataccgccctcacggaatctaaaaggtccctatccaggaaaatcgtttctatagtagtgattcatgaagttccttctctacttgatcgatccattttctttgtttcttttttggcatagatcgaacacttggtggtgcgctcgtcggcgttcccggtgtccagagcgccaccatcgtcccactttgtcattcccgtcaactcgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcggccgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagaggctctgcatgcacggagctgatttaattaattaacttgttgccagctagtacctaattaagcatgtgtgttaatttattattaattactttgctagtgttaatttatccttagtttttttattccaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatactgcttcacgtggtcggaactatatacgttaagatcaaatgtgctcaacgtggtctggcacatcatggaccatgctgtttcatgtggtcggatctagatgcattaggaataatccttttcgtagtagtgaaactaaagaacttcacttgcgaactacttcctccgttttacaatgtaagtctttctagcatttctcacattcatattgtttctaatgaatctagatagatatatatgtttaaattcattagcatcaatatgaatatgggaaatgctagaatgacttacattgtcaaacggagggagtagtttttgtagagactgaacaaagatgaaactttttggaaaggtgctcctgatgaccaagttcaattcaccaactgaaatcgcacactggatttacatgaaaaatgcgagatagacaaaaatgatttctttcggttttaaattaatactcccggccatttgggaggagcaatatgtacatatgcattcatcacacttcaggttttttgtcttttttttccttggagttgtaagaatgctcataattagggcatgcaagttgatccattgatatattcgcaatatttgacgatttttttttcattttaaaaattgttgacgatattagcttaattttggtatggaaaatatcggttaatttatctccaatttttatcaagagagaaaatgaaccatgagagttgaggtgcgaattaaccacaagcaaatattcattttaatttgtggtatatatatatacacgagcatgcatgtaaagatggaaatatgtgaaaaatacaatggtgctagtagatttgtctaaaacacttccataatactatgatcaggacactcgataaggacaaagttaaattttagggattgtgtcattatcaaaattatcaatgaataattggccagagggccgggattagcatgggtctactactgtcctgccatttcattaattaattagattaagtccccgattgcttgcatccctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatactgatacacatatacttaattggtataagaaaattagtggtagttaattagtataaaagcatcaatcaaatggagactattagctagctaggagaccgggcaagcaaagcaaagcattgatcttgactaggaatcgtgcacgtacaaggcacgtataaaaaaaataagtataaaatgtaaactacatataaaaattaggaagtgtgataaaatgtcataactgcataatttaccaacgtaacagccaaaaaaattaaaattatctcagtgcaccaataacataaacaaaccaaactttggtagatatatattaaaaaattgaggcacatcacagattgaaattagtcaacaagttcagggaatgaactcagaaatgaaccggtaccacctagaatattaagttcaggtacatccccggataagatcagaaaatactatagcaaatgttccaaattttgtttctgaattctccttaatccacatgaattgtccttaatacaatccaggataagatcagaaaacaagacctctcttacaagcaataacgcatatattatttgtcaagacaaagccaagtgcataatccacatcaggttatcctctagatgatactccagccatgctccctggtcctccaaaaacaaccaggttcaatagtccaatgcataatgtaaataacagggccggcagaagaatctgaacatggtaatcttaaagcgaccttatataatctccacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacaaacacaaaatggcattttattcttgcacgaagaccatgtctaagccttgatatatgcattatgccttcatgatctttaaagtcaatagatacctgcataaagcatcaactaagaaaatacattgtttttgttccaaaaaaactgataaataacaaaaatggcatgataaaaggaacaccttaatggatacttttgttaaaaaagatagtgaaattcttgattattcaacgccggatcgaatcatgtccaatggtcattggaattttgtctatccttctattcttcaaaataattcagatttgttagccaaaatgcgaagaaataggtttgccattccattacagtatcatcaagaacaagcgaaagaaccaatatcctgttttgggatttcgattgaaataccctttatgggtgttttacgtagaaatactatagttgcttattttgacaacccacgatacaaaaagagataaaaaggttttgagaattgttaaatttagatataggaccacataagcaacacaattaatttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattggtgaaatcacctattgggcatggaagaaaatcagtgataaacaatagttaacaaaatcatgagcatcaatattgatattttagaatgttgataaactaacctccatatgatccctcctaaatagaataaaaacaccttttagtacatacactacaatagagtattatcacaggccaaatataaattgtctccaggtaaaataaaggtagcaagcaaagcaaaattcagacaaaaaataatagtacatgttattgcagaaatttgtagtgtagagcttcgttgattatccattgaaagtattcagaaagcacggctatgttgtggaccactattatggtagagaactgcaaatgcaagacactcttatgcatcagttcagaatcctcttatgccatggacgcccatcgtagacagccagagccagccaacaacccactcagccatggacgccatggacaaagcaatcaaagcaaccataaaaccaagaaaagaaaaatcaccggttgccgaggagagcctggaggtggacgatgagcttctcctcctgctcagtgaagttcccccgcttgatccccggctggaggtagttcgtccaccggagcgggcagctcttgctgcaacgcatcacccctgcacacacgcacagatcaaacatgcaaaaatctcagatctcgcaacccaacgcagatcgatcgatcaagaacacacaagaacacgtaccggtgttggtcggcacggcacgccagttgccggcgccgtgctcctggatgtaggaggccagcatcaggtcctcctccggcgtccatggccccttctttacccaaccttgtcgcagcacggcggcctccccatcctgctcgccggtgcgcggcggccggccggtggttggtggtgtatgtgtgtcgactcgatctcgatcagggaggaggagactcgcgtgttggcggtggcaacggaggtagccgggcgggtagcggcggcgtccctgcgagcagcggaggcgctgtggtgccggtcagaggcgactggacccgtgcctggccatgggcagcagtgcggtagtgcctcggcgctggtccgacattgaggcggagcgaggaggcgaggtcgctggtccggcggtggaccgtcgtgaggagaggaggcgcagagcgaggatgcgggcggggagagaggcgcggagcgaccaggcggaggagtcatcgcaccggggatttgcgcgtcgcagttaccgcgtcgggccgtgggggcgaaatcgctggtgggatgagatcgggccaaatcgctggtggatatagatctacggtgtacagcggacggctcagattggatgagagggtggatggacggatgggataagagtggttgatttcacttgtaggattgctaggggtgaactcctcctttttatattagtacagatgaatcctccaaagagattaattgcatattgccagttcctcctgacctattatatgcatgtaagtgctctctggtgcggtgcaacgacgagcaagagtgcgtacgtttatagtagaactgagggggtgcgccttatatacgccggacgagcaaagagtgcgtacgtttgtagtgacgtctccaattttagtgtctatggtagtgaaatattcgacgtttgacacctcaaaccggagaaaaactggagctgtgaaatgttttcttttttttatatgcgtggagctctgaaatattgatagttttgtttttttctattaaaaaagccaagaagagttgacgacttatcggtaggcgctcctcgatggagggagatgagcttaaaaagtttcagtaaatggacccatgcagtggaaatgcggagtggagtggagcagtaataaaatataaaatgccacgcgcagggcatctcgaccacgacaggactctccttgagatcttcgaacagtgtgtgcttgctagctgaactgcagcagtggaacagtaataaaatttaaaacggatgtgcagtgttcacagaggacgagtgtgctctgtgttctctgcttgtgaatagatatggcgatctctgcttgtgaatagatattgcgagtactatagtacgctacaaacacaactaagttaccttatgaaggactactcaatagtacacttaaaacattgttactcgttgccttttacatcgatttttccgtgccatcctcttaaaaggaccgcacgtgaaaatgagccgattttcccagaagcgacgagttgccgcctgcacggaatctaaaagggtccctgtagtagtgattaatctagccaactcgccactgtgaacctcatctatttctcacagtgttccactatgcaaaccaccaaaaactacctcggaatctccaagaacttccacttactcttttcacccgaaggagtttcatccatcgcacatattctctggtgagcttcaccgcactccaaccatgggaacgtgaagttccttctctacctaatcaatccattttctttgtttctattttggcatagatcgaacagttggtgatatgctcgtcggcgttcccggtgtccatagcgccgccatcgccccacttcgtcattcccgtcgactcgaaccatctccggccgagccattgcgccaacgacgtcgcctacgtcccaggaaaaagacgcccaaatatgatcaagccaatacgcagccacgaacgccatcagtcgccgttgccctcctattgcctctgcttccccagccgccaagtcaccgacatgtgggccctggctatttagccacttcattaggtgtaaggactttcattagtagaaatttaaatcttgtaaggttctttttgtaaaattgatttgtatgccatgtgggcctatggacctaaacgcaattcacctaatgcccatggaccattttgtatagggtttagggcaagtcctaaaccctacttagagattactatttcatgcattcattacttgatataatagcttgatgagtatgttgtactcaccattgctttaaccctctctttgagaatcattttggagtttttgctgaagccgtgagtttaaacatataaattagtttcattccaacttagttcccatgtatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcggttactgaatctttaattttgggacctgacaaggtgtgtgggtgggggcctagagcggccatcccgctcccccctccccccctcgtcggccctgactacatgggccttaacaggccacatggcatcttatcatgatttctgggcttgatagtgacgaagatggacgtcatagactgtatgacgacagaaggatcatcacaatattaatgacgaaaagataagcattctttatagaacgccattagagacgcatgataggttgtcacgcccggaatttctatccaaaattccaaatgcttacatgtgtgtaaaccctcgtcctggaatcagccgaggcacacaataacaaattgataatagagcacaattattactctaattaataagcgaataaaatgtcattacagaggtagatagttcctctcaatcaataaagatctaagcagcggaaaataaaagaaacagcgcaggcgactcctctccacaggcaacttgaccaaggctacgcctaatcatccacactatcagcatcactgtagaactcctcctctgatgaatgattgcaaggtgagtatatgatatactcagcaagccacgcaacaattaagcaagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatactcaaagggttgtttgggatctgtgtgacttgccttgctggccttggaactcttcaaagtcttctcctgcaaattcggactctccgggaacgtcggactctaaagagaaaagagcaaaatcaccaaaacagcacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaaggacacctacgggttgcgggcgacacggcgaactcaccggtgaccaaagcagcggcggaaggtcaacggacggcgacggcgacgaggaagaagcggtggtcaccttcagctcgacgacgacggcggggctccggcgatctacagcgacggcggagaggcggacgaggtcggcgacgatttgacgatcacaacggcggctttcccgagcgacgacgacgaccggaaggacggcggcgcacggctggacgaacggcggcgacggcggcgctagactacacgacgctagggctctaccggcgacaagagacttaggcgagggtggcggcgggtagaggagacaccgggggtccttttatagcggctagggggtggcggcgaaggtccacagcgaccggcggcagcgatggaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatttaaaaaacctttttcaatttaaattattcatgaaatgcaattccattgattaaaaatacttccttgcctcaaataaatcccagaaaaatctaggaactatagaattaagcgaagtatttaataaaattttatctggcccaattttatattgaaatttattatttaaaaatagatcttctcttctaggcttttaatatcaattctaataattccaattaaacaacaatttatatatttcggatttttagggtgtgacataggtgacgaatgatatttgtcacacgaacgttagatttcacaacatgacttaaaattcaattttcatgacgtaaattagcatcagctacactggtggagaaaccctttttcctcccggttcgtaacccccctttagtcccggttatccaaccgggactacgaatccgggactaaagatcgctatccttagtcctgggtgaaataacctggactaaagatcgatctaccaatttttttcttatttgcatggccctattgctgcatggtttagggtttatgttacaatacatatatatgcattatatatatctatatatatatatatatatatatatatctatatatatatatatatatatatgatggctctttcatacgcccaggtgtatgtacacccttttattaatggatgatccattagcattcaaattagctatgaaaaaaattaataatattaatttccaaatgactgcatgcatgtggcatagctgcacaccggattgggtgcagatttgaacaagattgttggcatgcatttgctttcaaatttgataacgtaccttagatatccccaccttttctagtatgcaacagtatatactgttttttaagccgcagtatatatactctttgaagtgatgagcagtactatatagtagttttttgtgtattagcagtacctaataaggagtaccttatatttttgttgtagcagtgaatacttctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgtnnnnnnnnnnnnnnnnnnnnnnnnnnnnnnnnnnnnnnnnnnnnnnnnn

SEQ ID NO: 26521 - DNA, 9353 bp, Oryza sativa
tgagcataaatgtaacaaatggaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagcgcaaagactcgaattcaacttcactcggcaacattgcttctgccccataaacaaggaaaaaaggtgactggcctgtggcccgactgggtgtagttcgcaaagaccaaagtactgatgacagctgtttcacccatttgccggcataaggttttagccggtcaaaaacacgcactttaatcccttgaagtatcatgccattggctcgctccacctgtccattgctcatgggatgcgccactgaagcatagcaaatcttaattccaaagtcttcacaaaagtctttaaaaactccgcccgtgaattgtctgccattatcagtgatgatccgattgggcactccaaatctatgcacaatgttgatgaagaagtctcgagcgttatctgctgtgattgtgacaactggtttagcttcaatccacttggagaatttgtcgatggctacaaagaggtgcgtgtaaccaccgactgcctttttaaacgggccaaccatgtcgagcccccaaaccgcaaacggccaagacagtgggatggtctgcaacccttgagctggtagatgaatttgtctggcaaaaaattggcaaccttcgcacgtgcgcacaattttgtcggcgtcggacacggcagtaggccaaaagaaaccctgcaggtaagccttgccgacaatggtgcgtgcggcagcatggtttccgcatatcccagaatgtatgtcttttagcaattgtctcccttcctctaaagatacgcagcgttgcagaatccctgaagggcttttcttgtacaactcagcttcatgcataacataaagtttgctccgcctcgaaatccgctcggcctcatctttgtcttgggggagttcttgagaagtcaaaaatcgtatgaggggctctcgccagtcggcttcaaccataactacgtcatgaatgcccgcaacttgagtagtatctttgtgaggtaccgtcggcgtataaaggtgttcgacgaaaacatcagagggtgccgcctcgcgtttggatccaaagttggcaagtctgtcggcggcttcattattgtgtcgaagaacatgactgagctagagtccatcgaacttgtcttccaatttgcgtacctctggtcgatatgccatcatgttgtcgtcaaggcaggaccactctttcataacttggttgacgaccagctgtgaatcgcctcgaagtattagacgctttatccctagggaaattgcaattcgcagcacatgaaggagggcctcatactcggcgacgttgtgggacgccgaaaaatgtatccaaagcacatagcttaatctttctccagttggggaaatcaaaaccactcctgctccaatgcccgaaagtcgttttgacccgtcaaaatgcatggtccagtgctccatcttctccgcgggggtatcctcctggcactcggtccattcggcgacaaaatcagctaacacttgggacttgattgaaattcggggcttgaatgatatgtccaaagacatcaactccaaggcccacttagcaatacgtccgtttgcttcgcggttgtgcagtatatcaccgagtggaaatgatgtgaccaccgttaccgagtgaccttgaaagtagtgagacagcttcctggtagtaattagaataccatataacagcttctgaacctgagggtacctcgttttggagttggctaggacctcgctgacaaagtaagtcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcaccaagtcttgaaacaaatcggctgagcgccgccatgcatccagtcaacttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcgaatgctcgcgaaggtttcttctagatccgagatcaaatcatcctttttcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatgcgccattgccccgttttcttccgtactagaaccgggtttgccagccagtcgggatgaaggacttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatatattagaaaaactattctacacccggggtatagaatagctattctatacctccctcccaccaacccacctcctctccccccaagggcccaaaacccacctcccacctcggtcaaaggccagtcaaaggtctctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaacagaatgtgtaatttacagtaataggggtttatacatgcagtaacatggttttaccaaatgtataaaattattcaaaatacttctacatcaatcagaccttgcttaaagccacctacaaactttatctatggcccacctattcgaacttcatctcgtaaaaatgacatagtaacactgcatttatcatgcagtaacatatctacttggaagtggtacatgcac

SEQ ID NO: 26522 - DNA, 9058 bp, Oryza sativa
tattatgaagtacggcttctactttttgtgtagtaccaagtatatggttagcatgtgaggctttaactcatatatttttatttcaattcctagtttatgtagtaatactatccaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatatttcaattatatttgagcgttgttactgcacgtaaaacacagtgttacgagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgcgatcgagccagatggtcccctcgccaggaaggccagttgttggttaatcgtctcgttacccatgagatgttgtcgcagccacacggggaaagtatcaatgtgatgccgtgtaatccatgcatcggatttaccgatgtttctggcgcgaactagagccaagtgctccttgatgtagggagccaccaatgaagattgttgcagaaccgtgaaatgggctttacggaataaattgttgtctaccatcattattgctttccttctgagagtcccctttccccgtagtctcccttcatggcgtgattcaggtatcccgattgggcgaaggtcttcgataaattctacgcagaattcaatgacctcctatgttccataccccttggcgatgcttgtctctggacgagcacggttacgaacatacttcttcagaacgcccatgtacctctcgaaaggaaacatgttgtgtaggtacacaggcccgagaataccaatctctttgacaaggtgacaaagcagatgcgtcattatattgaaaaatgaaggtggaaatatcaactcaaagctgacaagacattgcaccatattattctgaagggcttctaatctatccggatcgatgaccttctgcaaaattgcgttcatgaaagcacatagctttgttattgttgaccggacattgtctggaaggaaaccccttattataactggtagcagctgtgtcatcaacacgtgacagtcatgagactttaggtttgtgaacttcttctccttcgtgcttattattcgctttatattcgtggagtatcctgatggtaccttgatgctttccaagcattcaaacatactgtttacacccaaatttggcatctgtggacgaaatagggaaaaattgccaaagtttggaaagtaacgggtttccttactcgggaaggcaggtttagtgtttcctttggtttctatcccgagttggatgtggagaagggcctatagagggtaagaccaacccctatataagggacaaggccggttcattgtaaaacccccgaatacaatctacttgaatcgttcttttactatgtcttctattttaccctagtttagtccatctttgtcggtttgcgccgtaaaccgtccgccgccgctacgagagtgcgacacctctttgtatgtttgtcctgaaaaccttccgttttgcccacgagacgggtagttatcctcatatcgatctaaatcggcctagaggctgattttgatctctaaatcggctccgctagccggtttaggttttgtttctacaaaacccatcttgatttggccctttggctagatcgaggtggttggcgactccatatcaccgcaaggcatttaggtgttgtgatcgtgcttgtcgacttgtcaaaaaaattaccaacacgatttttggcgactccactaaggaacgatctaatcggccatatcacggctgaatttcgtttaatacagtagttttcgtcaaattgagagtttgggctaaacagccgagatcaatctgtacaacttatcgctgctgctacgaagttttcctcggatcagtatattcgacggcggtactgtttggtcaccaagtggaattaatctacatagctcagccgacgctatttggtttcatctgccgcagtcagccggcgtcgccgttgtctgtgttgaggccgatcgattcaatcggtttgggagcagtacgctgtccttctattttgctgtgcacggctgaaattttgagtcttcgtcctattcggtttgctatatacaaattcctaaaaacagaagaaatcaggctatcaaagccgatctgccactgcccacataccgaaaatcaggctattagagccgatttacctagaataagacaaaaccaaatcggtttctgttattgtgcattaggcaactgttaccgagaaaaaaaaaagggatcgaagccgattcatattgtttcggctgttattgtgagacatcgattttctgaatttttgcctacacacgagacagaaacagttctgttcttgctgcacgctgttaccgaaaaaaaaaatcaaatcaaagccgttgcagtgcatcggctgttattgtggaacatcaatttccaaatatttgctagctatacacacagtagcataccgaggaagttaagaccgtatattaatttattcggtcaaatatttcggctattagctatatggccggatttaatcaagaaatgtcttcatcaactattacgagcgggaacgggttaaacaatgttactacacaatacttcaggaccgatcaaggcgtcgtgagaggaaacgtcccgctacctcaagttgtaatttcaccaaaggtaaccttcgtttcgcctaacccgtcctttgctattcaaaacgttaataatcattgtgtagatgcatatgctacttctagttttgctcctatacaatatgcttataatgctacgggggagtcaatggatgattatacggccaattacacagaaatcggctataggcaaaacctagataacggtatgactggtcatggtaccggtttaaccacatcttatgccggtcagaccgtgcccaccatggccgatcagaccgtgtactacgccggtcagaccgtgcccaccatagccggtcagaccgtgatctatcctggccagatcgcgcctcatgtggccggtgtgaccggttccctggaaatttctccaggttttcataccatgactagcagtattgattttaattattattcatcacctgttaatactgttagtcatactactccacatatccctaatgcttacaatgattctaatagaagatattctcctgatactaggtatggccaatataacaatattgcgccacaaacacaacctattaggccaccaagtccaccaccagatccaccaaggcctgaaactgtggagaattggtttagaaatattatcagggagaatttagcaaagctaaggaatcgctctagggactaccgaaagccgtatcctgattattatgacattttcccatatcctcgtgattataaaattcctgaatttaccaagtttagtggtgaggatagtaggactacatgcgagcatgtagatcaattcttagcacaatgtggtaggttaaaagtgatatttttaaattgcgcttgttttctttatctttgtccggtactgcttttacatggtttacttctttaccggcaaattctattgatacttgggctcaattagaacaaaaatttcatgattattttcacactaataaaactgagcttaagttatctgatttaacatcggttaggcatgaatacaatgaatctgttgctgattatattgaaaggtttagagatgttaaaagccgatgttttagtttgaaaataactgataaagatttggccaacattgcatatgatggattgcttgattctattaaagagaaattgaatggccagatatttcttgatattgatcatgtgttgcatgaagctctggctcaggaaagccgagtggatggcaatagcttacaagctagtttagatgaaaatgcaatatcatgtatagccgaaccaagcgatggttcggattgtgttaatgatttgtgcaatgatgcaacaaccattatagccgaaccaagcgacggttcggattgtgttacttgtttagacaccgatggaatagccgaaccaagtaatggtttagattgtgttgctagcttagagagtaacatcattgaaaatatagccgaactaagtgacggttcggattgtattacaagcggaagtgaaatagcattgtcacctaagaccgaatcacaaatcggtcatgtggatattggaaaagataatgacaatgtcttgtgggatagtggtgaaatagaatccaaagtagctatgcatacatatcaaaggccgtatcctgaacatgtagattcggtcccatacccgcaaggatttgaggtgcccaacttcacgaaattcacaggtgagaatgctatgactacaatggagcatatcggccgctttattgattaatgtggtaaagccggtagcgatgatttgcttaagttgaagttgtttcccctttctttgtcaaactttgcatctacatggtatagtttacttgctcctaattcaatttctacatggtcacaaatggagcatgagtttcatgattatttcaaagatgcaagcttgatggagcaaagaccgattgatacttcatcggtcacttgtgaaacgatttcggttacatctatgtctaagatcggaattgttagtaatcctctccctattagtcctattgatgttaacaaaaagaaagggaaaagtgttattattggggatcctcggcccaagactaggatcaataatgcgaaggccgaagatcataaagttgcaaaggatgagtcatctagtttgcaaaggaccaaaaagccgaagctcacttttgagatgcttatggctaagtacgagaaaggattagcgggtcaacgatttgataatcaaactagtgattcaaaaataccaagatcatctcgtaggaagagatttggtcaaacaccaaagcaattggagccatcaactataccaactccatgcaaacctccgattgtgatgccatggtatccatatccaatgtcactatatggttatccttttatgtattatatgccatggatgcctcaaccacctatgctgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagacaaagctccggaggtcgttgctatcaaggagaaatctcaggatattcaagtacctactgaagatgcggcgaaaactatacaagcggagaagactgaagccgacgccgttgctgtcgacattggcagtctgaccgagccagccggccggtctaaccgccagactacggccggtctgaccgacccttctagccggtctgaccgacggcttgtggccggtctgatcgggcccaaaggccggtttgaccgggcggcattggataagagtgggaaaattgagagcaacataggagcttccacttcgaccaaaaatatgaagaataattgcttagctcctggaaaacaactacagccgaagtggataccttctggcttatctcgctctcaaaagaggaggctacaacgtcttcgggccataggtaagaaagaaaaggaggccgaagatgtggagaacaagacatgcaataatttagagtctcgaacagcacctagacaagtgtggagacccaaagaggtaaaagttaagagaccggtgatttcccatagaagtaacaaatccaatttgatgagagaagaatcatcggtcattagagataagtctccttcacatgatgctatgggtgttagtgcggtattcgtcttgccttcgaaatcgcacaatctagaaagccgattttgcttggggggcaagacatcaatatgctcatgagggaaccaagggaagatgaacggcgatggatacaacatcacatctttgagccgccgtttgttggatgctaaggcaaggtatgagtttattgtgtttaacattatattatatgcatatgccatgttattagaacattgcttgctatctagcacatgtgtgtttttgcttatcaaattgatattatacatacatgttgcaaatgccaattctaggtagtagaattggtaggttggcatataatttgtttgaagtatgatttggctcatgactctttgatatttatttaaagccaaatcatatgtgtttttatgaatcaccatataagatatagatttcatatttattgcaccatgaaagttttgcttactagtaattcggctaatgtcaatggtcaatgtgatgatttgctctagagtggttttctttaggaacattggcattgttaatattttgcatacatgctcaagccgattacttacatttttagtttattggaatctatgcatgtgacacatatgactttgatgatttattattgatcatacttcaattggctaagtgttgtgatgccatgatgattattttttcaaaagccaattgaattagtattcatctagacatattagttggatattatgatttttcatatgtctagaaaggagttttggttcaataatttgatataccaagcatctggctattatgtgaagaaaaatttatatactaaaagccgatgcttgatttcaaaagtttggacgaaattggcaaagtcatagaccaggggcggtctgactagcattgcacggccggtctgaccggtggtagccagcggtctgaccggctctgcatggccggtctgacagggcagacagggtggtctgaccggcattgcgtggccggtctgaccgatctcgggcagagagctgggggcacgttacaattgattaaaaggccaaattaattatgaattcggacatttgtgctcatgagttagaaatagcttggagaattcctttgattaaatatttgaaagatcctacacttaaggttgatcggaagattcggcggcaagtgctcaaatattatatcgccgaaaaatagatatagtattacttagataatgatcaatctaaagttgctaggagagtagtacatgaagggatttgtgaaattcatcaatatgcccgtaagataaattggttgcttaggagagtggggttttattggctgaaaataattgatgattgtttcaaatgctatagagagatt

SEQ ID NO: 26523 - DNA, 641 bp, Oryza sativa
agttgtaagttccatagtcttgaccataaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagat

SEQ ID NO: 26524 - DNA, 1500 bp, Oryza sativa
gcatttattacttgatataatagcttgatgagtatattgttatcacccttgctttaaccccctcttttaaatcaatttggagtttttgccgaagccaggagtttaatcatataaattagtttcattccaacttagttcccaggtatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcggccgtaccgctcgcgccccctccccccagagccggccctgactacatgggccttaaaaggccaaatggcatcttatgacgatttctgggcttgatggcgacgaaaatggacgtcatagactgtatgacgacagaaagatcatcactagattaatgacaaaaagataagcattctttatagaacgccattagagatgcatgataggtgattcgtcacacgaacgttagatttcacaacatgacttaaaattcaattttcatgacgtaaattagcgtcacctagactggtggagaaaccctttttccacccggttcgtaacccccctttagtcccggttatccaaccgggactacgaatccgggactaaagatcgctatctttagtcccgggtgaaataacctggactaaagatcgatctttaatccggtcagccacgttgccagctaagccatcttagtcccggttggtgtaagatcgatctaccaatttttttcttatttgcatggccctattgctgcatggtttagggtttatgttacaatacatatatatgcattttatatatatatatacatatatatatatatgtatatatatatataggacggctctttcgtacacccaggtgtatgtacacccttttattaatggatgatccattagcattcaaattaactgtgaaaaaaattaataatattaatttccaaatgactgcatgcaagtggcatagctgcacaccggattgggtgcagacttgaacaagatcgttggcatgcatttgctttcaaatttgataacgtaccttagatatccccaccttttctagtatgcaacagtatatactgttttttaagccgcagtatatatactctttgaagtgatgagcagtactatatactagttttttttgtgtattagcagtacgtaataaggagtaccttatatttttgttgtagcagtgaatacatctttttttaattagcagccgtatatacttactccagaactaacgtgtatatatatactgattatgtctttttattggtacgcgcagtatatactac

SEQ ID NO: 26525 - DNA, 3883 bp, Oryza sativa
  unsure (1)..(3883): unsure at all n locations
cctcccaccaacccacctcctctccccccaagggcccaaaacccacctcccacctcagtcaaaggccagtcaaaggtcccccacgtcggtcaattctaggtcaaacccgtcggtgactttccccacgaccctctctcttcttagctctcgtctcggaatgacgtagtaacgtgttggtcatcgtatagtaacacaatgttttacttgcagtaacaaaattaaaatttactcataatatacttatgatggatctacttttggtaagcaccttttttttaacatcatggtgcaaacggtttttaaaaatagtacatgatgtgagagatattacccttcaaagatttgtttttgaggatttaactctccacaagtaataatattgtagtaattacaagtggtaacgtgtaattgtcgtgcggtaacacttttacttttgtgcagtaacaagtgtatgattagcatctgagacttttatcgcatatatttttgtttcaattcctgaattactgcaattcaccacaatattacggtcaaaagtgcaataacgtcatatacatgcagtaacgctatattggagggaggaaaccaattttcttgagaagagggaggaaaaacggttcttgaggaggggagtacgtagatgcattttgaagtttaatcctccacatgcagtaacacgataacatcatggtggaaacggttttaaaaaataatacatatcttgtgagatattgcttttcaaagattgacattttgaactttagccctccacatgcagtaacagaatgtgtaatttacagtaacaggggtatatacatgcagtaacatggttttactaaatgtataaaattattcaaaacactcctacatcaatcagaccttgctcaaagctacctacaaactttacctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatacggttagcatgtgaggctttaacccatatatttttgtttcaattcctagtttatgtagtaataatattcaagaaatgcaagacactttgttactgcaaagcttattgtctttactagactcttatagtaacgttgtgatagaactgtagtaacgtacagtagtaacaagtaatgctattgtattactacttgtggagagtcaaattccaaaaagaaaagcttttaagaacaatatctctgatgtcatgtatggttttttaaaaattgtttgcaccatgatgctagaaaaaaaatgcttatcaaaagtagatccatcgtgactatatttcaactatatttgagcgttgttactgcacgtaaaacatagtttactacacggtgaccgtcgcgttactgcacagtttcgcgagacgagagctgagaagaggtgggtggtgaggggagttagtaggtggttttgactgagctttgaccggcgggagggggctttgaccagcgtttgaccgaggtgagaggtggtttttaggccttggaaaggagggggaggtgggtgtggcccttgagagggaggggggtatagaatagttattctataccccgggtgtagaattgtcttaccctatatatattacatatatattacgcacatatatatatggaatacatatatatatatatatatatatatatatatatatatatatatatatatatatatatatatatatatatgcatatgtataaatacatatattacacatgtataatttaaagcacttaacattttatgtgcatatatattaccaaaatatatatttacactaaagtaaatgtgtacatctataaacatatacatgcatgtatagtacaattcatttgctcactatttagctacgacttcgacgcgggcgttatgtcaaaagaagaaggaccgacgttatgaattgtcgatccgtcgtagtagaattcacccttgggattaaggacttgaacagccgtgataaaatccttgtgtgagagattgtccctcatgtgaatacgctatcattcgaaaaataatgacatatgaatatatgaaattaataaacaacaaatcgatacgcaatgaaattttgaatggtttatatatacgtacatcgagctctcgtgtggtgtagatttgggttgataggcagtgggcatactcgtatacgtagtagccgcacaagttagttccctggtcccgctttgcacactacataagaaaggacaagagatttaatatacacttatattaactgtaattagagattcaattcaatataatttcggagcatgcatgtactgattggaaaattaaagctccgtccaagtttttctttccaagtcccgcggaacaattgacggaaccgatcccaagccctacatgcagttgcaagctatgattatttattatccgagatccgcataatagcaataggaaaaatccatgcggctttggaatagatggcattatattacctatctataagttggaaaaccttgtcaaaagtcttctctttattcattgagtcatacacattgactctgcatgcatccaagtcgaaaagtaacaggacccagtggaatctgcaacatgcgtgagatgatatatgaaaatgtacatgttatatgtatgggaacgaagtttgttcgaacgatagtaaaaactcactctgtgttgtacggcagtactatgaacgtcttgaaatgctgctgcgtcaggagatggacgagattgtcctctgtgtctttctcgtacttgtcgatcatttcgacgttgattttctgagggtcgatgaacccagtatcgcaaaccccccgccgtcgggtcttttgaatcttcattctacaacgataaaaggaaattattattgtttacatatatgcaaggagctaattattgaacgaaacaaatcgaactcaacgatacttacaaaatccatgcgctcagaagagagacgttcagggcgttcagatggtatagttcgaagacatccttgaaatggatccagagaacattttctccttgcaagaagtcggagtttcttatcctcgctccgaacatctctctacccttggcgttcatttccatgtaccattcatggaatttgtacatctgtgtcggtagggactgcagctgctcaggcgtgacaagcggtttaccgagttcaaacttgtatgccacttccgtcttcgggattggtgcgcctctaatcaactgttccacagttagaccggtgtcagaaatgaattatgttatgccaatttctttgccgacaccaacggctcgacctcttggttaggttgttctccaagctgaggaactggtttggacttcttgtaataggctttcttaagtgttcggtcatagtccgatagctttaaggcctccttgtttgttgtggacattttcttgaagaagttcttcacgctcgggtcaataggtatcttcttttcaagactccgaggcttgaattgcctcttcacttttgctgccacataagcgtcaagctcctcttgactgcaattgtacagcggctccttgtttttggtggcgtcaacttttgccttcttcgttgcccttgtgcgggcaggcggtggagcttgacgagaccttgtcttgggaggtgcaggcggacatggtggaggtggaggaggcggaggagccggaggagccggaggagatggtacaggaggaggtgacggaggagccagaggagatggtgcaggaggaggtagcggaggagatggcggagccggaggagatggtgnnnnnnnnnnnnnnnnnnnnnnnnnnnnnnnnnnnnnnnnnn

SEQ ID NO: 26526 - DNA, 1216 bp, Oryza sativa
aacttcgaccctcgagtatcctgctggaatcggcctgcagtggtaagtccctgaagggtcagttgggatggccattcctgatgccaccttcacgtgatgagaggttatctattagtaatcaaccgaagcagcaacttgcggaatgtacaagtcaaaaatcataaaactatgagcataccttgactgataagttcttgaaggaaatatgtagctcacatggtgtccgctacgtgatctcatcaacggggcaagtggtttcatcctgagtttgcatggagtccatgctctgtgatcctacctgccccgttgaggctgtcacgccctaaagttcccctccttgcttaaaaattcataaaataaatcgtccgaagaaattgtttaatttaacctagagttgaatccctaaactaataaatgcaaataataatcagaatcggcatgtggaatttttcttggattctacatgtcaaaatatgctaacaggaattttagtagaattttcagagccttagaaataattttaaccaattaaaataagcaaagtgcaatattaaatccctgggaaaatcctttttcctttttatcttttcttttccctcctttttccttttcttgggccgtcggtccattccttcccacaccagcccgcttctcctcccttccccgaagtcctccctccctcctctctccttcgggcgctgacaggtggggcccacctgtcggtcgtctcctacctccggtcgttggagccgcagctccaaccgcccgcaccgccggtgccccacctcctccactcgccccacgtcgtcaagcccacgtcgccgcccccttccccacgccttcccgccccgcgcgcgcggcccgagagggcgggattcggttttgaatccgtctctctctctctctcccccccacgtcgccggccgaatcgggggggtttcccggccgtgtccgcccctcccgagcccctataaagcttccccgcatccccctctcccttttccccttttcaccgcgctctcgcacgccctctaccgcacccgcgccgatctcctctagcgccgccgctcgccgccgtgctccggccgcacgccgccaccgctagagccaccgccgccgttagcttctccgccgccaaagctacctcggccgccgcatccccatccaatcccgctgccggaacgcctctctctccgtgcaccggtgagtttcgccg

SEQ ID NO: 26527 - DNA, 12798 bp, Oryza sativa
  unsure (1)..(12798): unsure at all n locations
atagggcgaattcgagctcggtaccccgggtcatcgccgccgccttcatccttcgggccggccgccgtgctcgccgctgatgatcccctctcctcccttttcccctctctcccatgtgcaccgccgcctttgcgccggtcaccgccgttgtttcccgcctcccgtccgcgtcatcgccgctcgccatgggggccggccggcttgaagccgagccgagaccggccggtgccaccccttcccctgagccactgcctggtgggacccacccgccaggtcacctcctcctcctcttgtgtcactgacccgttgggcccgcttgtcggcgccgcccctcccggataacttcagccctgggatcctttattgcgcaataaaactcattaaggcttttcttttatagtaataaacacagagaatcttctaaaaatcataactaattcatctgagctccgattaagtccattcaagtctcagtaaattcatacaaatgcatagaatccattaaaaatggttttgtttcctgtttcagtagacttatagcttgttttgcttgtgtgctttgtttgtcgcgtagatttcggccgtttcgtcgatccgtggttcctcgaagacattgctgtggttccatcagtacgagagcaaggcaagtcatgcattacgattgatcatattgtacccaatttataaatgtcccgcatttctattaaatgttgcattgttttacaatgtcatgtgggatgggtcctgctactcagccatatattgtttaccttatgtcattgataactggggtatcaaaatgattagatgttggcttaggaaatgcttagccatgcttagttcaactagtacacaaaaggggaattacattcaagcatagactttgattattggcatagctttggattagtgccaccgcaatggtgttggttaattaaaatacactacatggtgggctgtgggtgcatggttttgctagttgtgcccatggcaattaaggactggttcgcgggatgccctggaagaacttaccgtacttaccacaagccagcgtgggcaacggctgggcttgtagtgtagctttcctctagccgacgtacccaggcgagggtgggagtgatggagttgggtcggccggggtgtccggtttatcggcttccggattcaccgcggcacgaaaggggggctgcccgttgcctgctggggacgggggcgaaccctaaggtgtggtgcgatcggttagagggggttatgcgaagggttctgtcacggcctctttccagtatgtcgtggtggcatgtcggcgcatgggaacgtgtcgtgtggctgtgtcttgtgggtacagttgtacacctctgatcagagtaaaactattcgaatagccgtgcccgcggttatgggcggtcgaccagattcaccgtgattagtctcacccctagttagctaatgaactggtgtagttcaggtggttggttgggcctgttgcaacgtggtatagcgttggacagtgattggttaatattgattaattgctacaactgttttactgctttcaactaccgcttttaaatgctagctttatgcaaaagaacctttagcctccttggatatatcctgcatcataccttctcttctggtatgacttgttgagtacagtgggtagtactcagtcttgctctcttttcccccaccctagagttgaagttcttttcagttgaagatgtctcgaagaagttggtttcgtcgctgccgtcaaggatgcctgtggaatggagtcgcccgctgcagaagtcaagtcttcaggcttagctcgttttttttctttcttttccgctgcatttgtaaacttttatatttttgtaagacgtggatctgtatgtcaacaattgtcgtttaatgcacattcagcttagaaattttggttcgtgaatttctgggtgtgacagaggcacagctgctacgattgcctcaggggctgattattacatgaggaatgtacggctggggatcgtggcaccgatgtgcggccatgcgttcatccactttccttgccacctcctcttgcatgctgagctcgtagctcgataccctataatcaagatctgcaatctttgcctcggtatctatcttgctcctcatacgacttctgtacatgtggatgtgcttcttgaatccaatatttgaaggaaccacgccttttcctcgngttcgacctggatgctcgggaatctgcagggcgagtgacagctcgtgcttctctctgtcaggtcggaacgttccctgagaagacgcttccactgcgtccgttagtcgactggcagcctcacgtatttgatcggtgaacaccagggagacaacaacggggttaagcgttccaccgtgagcatagtaccagaacttcgatcgatccggccatttagcggtgaccggttcgatacccctctcaatcaagcttgcttccatctcctcccactttggcactgcgacgctatagccgcctgacccaggtggtgatggtacttcttcttgggggcattttcatatattaatactttaataggcatatattaatactttaatagccatatattaatactttaataatcatatattagaaatcaaataatcatatatgctaagtctatgtttcgtatattaaaactctaataatcttatattaaaactctaataatcatatatgataagtctaataatcatatatgctaagtctaataatcatatattgatactctaataatcatatattagaactctaataatcatatatgttcagtctaagtttcgtatattaaaactctaataatcttatattaaaactctaataattaatatatgctatgtctaataatcatatgtggtaactctagataatcatatctttacatcacttgcctgcgcaaattcctccgagggctagctaccacttcggcttgagggacgacgacgacatattttctgcaacatgcaaaaaaaatgtattagccgaaatgcaaaggaacatatatttttcgttcacgttttcaagtatataatcatatatgctaagtctaataatcgtttaattttctcgttcgtacacgtctcgttcgcgttcgttcacacgtttcgttcacgttcgttcgcgttcgttcgcattcgttcacgtccgttcacttccgttcgcgttcgttcccattcggcattgatggggcggcaccgaaaaggagcggcggtggcgtgccgcagcgggggcggcggcatggcaaggcgcggcagtggcggcggcgttgttggcagtgacggcgcatcgcggggtcggcgtcgacggggttggcgtacgtcgtcgacagtgccggccgggtcgacgtcggggttggcatcggcgggaggcggagtcggggtcggcatcggcgtggcacggcggtgtcgcaacgacgacgacgacgaggcggcggcggtttggagagagagagatcgagaaggcggcggcggcgacgacgacgacagcgagacgacggtgagagacgacagtggcgtcggcgcgtgggatgccctaggcagtggcggtgaaggagaagccgagatcggagaaaaacttctaagtgctggtggagaagacaagtgcgcctcgagcatatcggatctttagtcctagttgattttttcccgcgattgccaaattcttttttaacccggttagggttaagaacctggactaaagataatagcactacatatttaatttcattatgtatgggtttctaaaatagtaaataatgatttcacgtcacaaaattaatgacaaaaccttaaaaatatattaagtggataagcatatgcatgatttaaaattgttaaaaattctaataatcatatctaattagcatatgcatgatttaaaattgttaaaaattctaattatcatatgtaaataccacatgcatgatttaaaattgttaaaaattctaataatcatatataactagcatatgcataatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataagtagcatatgcatgatttaaaattttaaaaattctaataatcatacataattaacatatgccatacaacaattgatttatatggatattcaatacatctaaaatattttacatcgtgtacacaacaattatggcagtatatcggcgatgacggttgaccgcacgtacttccgcctcacaattgttccttccttgtgatcgctacgtgagtaaggggtgtcttcgtttgataggaggatgatagggtcaaccgtcaccgtgaaagggggttgcccataacactgatcataatcctcgtcagtcttgtcctcaactccgatgatttttcttttgcctgggagaaccatgtggcacttcggctcatcaggccctttgcccttctttcctttgctagatatgtccttcacataaaaaacttgcgttacatcattggcaaggacaaaaggttcgtccgagtatcgaaccttgttaaggtcaaccgttgtcatcccactgtcatctatcgttacgtgtcacgcccagaaattcacgaaccagaatttttaagctgaatgtgcattaaatccctgtctaggaccagccagggtacacaaacgacagttgttgacatacagatccacgtcttacaaaaatataaaagattacaaatgcagcggaaaagaaaaaacgagctagactcggaagcttgacttctgcagcggggcgactccactccacaggcaatccttgacggcagcgacgaaaccaacttcaacaagacagctcccattaggaagatcttcagctcttgtgtgggggaaaagagagcaagactgagtactacccactatactcagaaagtcatactggaagaggaggtatgatgcaggatatatccaaaggaggctaaatgtacttttgcataaagcagacatttcaaagcagtagttgaaagcagtaaaacagttgtagtaattaatcaatattaaccaatcactatccaacactacaccacgttgcaacaggcccaaccaaccacctgaactacaccagttcattaagctaaactagggtgagactaatcacggtaaatctggttgatcgcccattaccgtgggcatggctattcgaatagttttactctggatagaggtgtacaactgtacccacaagacacgattccacacatgtcgccatgccccgaagtatcaccatgatactgcaaaggggaaaatcgtgacaagaccctccgcataaccctcccctaaccatccacaccatgctaaggtttcacccccacccctcaaaaggcagtgggcggtcccctcttgcgccgcggtgaatccggcagctggacaaccagacaccccggccgacccaactccatcacgcccaccctcgccaccggtgactaggaaagggtcgagctatacttcagatcaagcagttacccactcccgcttgtggtaagcacggtaagtctcctagggtttcccgtgaaccggtccttaattgccatgggtgcgaccagcaaaaccatacacccacagcccaccattcagtgtatttcaattaactaacaccatttcagtggcaccaatccaaaactatgctcatagtcaaagtctatgtaataatgtgatccccatctgtgtgctagttgagctaagcatggctaagcatttcctagaccaacatctaatcattttgatacccaagttatcaatggcataatgtcacgccctaaaaattgcctaatttaaaaatacattgtttaagtcatttttagaaattaaattaaaagcctacaagctaaacccaaattatctaggaaaattttcaacataaaaatgagctagataaaattttattaaatactttgcttattcctctatttttaagaattttctgggaattatttgagcaagggaagtatttttaataactgaaacaacatttcacgatttattttaattgaaaaagttctaaaacccctcctttaagttgttgggccatttttgccccaacatttcttcttcccgcgctgccaagccggcccaaagccggccgagctggcccaccagcccaccgagccgccagcccctctcccctcacatggaggctgacaggtgggacccacctgtcggtggtgtctcccacctccagccggccggctgtgcaagccgagcccgagccgagcacgagcatcgccgtgccacctccaatcccaccccaaaccggccccgattcttccggatttttgaggggtttttatcctctcattctcctctatctatccccccaaaaatcggagcaaatcgttgagtattttatcagaatcgaactcgttttcgagtttatctccaaaaccgagtttttgatttcccaagtcgatttcttgcgggaggagtccgatctcttcaatccaaggctataaataggacgccctagtccttctctttcgtttgccccaactcccgtcctctcccgtgcctcctagccgccgcgccgccgccgctaagcttgccgccgccgccggccatctccggcgccgccgcccagccgttgccgccgtcgccgccgcttgccgccaccgcctttaggtgcgtgggagcgaggagaagctcggccgcctctttcccgcagccgccggacgccgtagcccgccggccccgtgcaagccgagccgcccgcgccgtcccttcgtcgacggcccccgtcgtgcgtcgttcggcgtgtaggtgagcaccgtcgggttcgtctcgtcgccctctacgtgtccatgtgctccaaattcgcagccgactgctctagctcgggagaggttgccatcctagcccgccaccattgatgatgtcatcatgacatcatcggtttttctttttcccgattttctaatagattaaattttcggaaaatcataactaaataaccgtagatccgtttcaggtggttcaagttgctaaatttttctaaaatcaagatctacatgttaaaaatatccacatgaactgtttatgcttgtttttgtactgttttgttgatttttgtttaattgctttagtttccgacgtttcggaggagagcgtttccgttaaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattattattaattatggttatatttaatggtagctcacgatggttaatcgtgtgaggttaattaatggataattaaaacttggttaaggtgggttgtgagcatatggttttgatggttgtgctcatgacaattaaggaccggtttgcgagctactgttgtgaaacatttaccgtgccaaccacaagccagcgtgggcaacggctttatcttttgtatagcatgattcattatagtgtgacagactgtgaaacggcgagaagtccatgggggtcgctggggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacatgggtacacctctgatcagagtttaatctattcgaatagccgtacccgcggttatgggtgagttgagcaatgtttttcgtgattagtctcacattattcattactggtaattgtgttaattaatgtgattcctggtttggaggtttaatttgttcaaccggggttggttgttcaaatgaggttgggcctatgcaacacgggtgtgttctatggtgtttatttaatattgattaattatacaactgttttactattctcttaagtatttattaaatgatgtttatgcaaatgaggtatattatgccatcctttgttattctgtgcacttgcatatttgctgtgtgacttgttgagtatgtcatatgctcattcttacaatattcaatcatcagaagaggagtgcttcagtgaaggtgatgatctggaggattgagcttcttcctggttatgatgcctgtggagtggagtcgccatagctgttccgtagtttgctttagttttttttctgctgcgtagaatgttattctttgagaggaactatccacctctgtaatatttttttatttgcgaatattaaatagttgattatttgtactctattatcaatttgttattgtgtgcctcggctgattcctggacgagggtttaacacacatgtaagcgtttggaattttggatagaaattccgggcgtgacaagttggtatcagagccaccttgaccttaggacaagccaaatggtaaacctcaagtagccttcaaaatattttgggaaattagaactgctcttctctattctcttacaaattaattaagttggcagcacatgcaaggttatgcacaaaatttatttaacttaattccttttcttttgaaagcaaaacgttgttcttctcaaaatgtttcttatttcgctttattaaacttcattgattagtcggcactgtacatttattatggtatcgattcaatcatgttagcacaagtactactcatcccttttaatgatgatactgtaccatgcttatagtaggtcctaaatattctggttttattttatttatttgtcaaaaattatttgtccctgtttaaaaagttaaattctaaaaatatatatataatagcttagtatgtgtcttttcttttatttttcttcctctttggtcaaatcagttaagtctagatggtgcagctaacttaaaaatatgcattaattcctcccttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagactttccgtcccttaagttcgaagctggaggaagatcgtatagccatgcttgccaggaagcagctttggtggccattggagatttgcgtcaacgcttttaagaagagttggattcatcagctttccagtatcatcctcacaagcctcatggtcaagattatggaacttacacctatcctgatggtgaggagagtgccactctgatgcaggcggtgcatatgcttagttctatgtatgcagtaagtgtggagcgagacaaagccgctcatgacagggaaaactggaatcgaggcaagatttgcaagttggagagtaaggtgtaccgtctacagaaggaattagctgagcttaaaggagagacgccgccgccaacacccaagcttcacctcaccgcaaggaagagaacctgtccaccacctcgtctccagttagcttcgaagcttcgcgtgatgggagatgctgtgccagatcgtgctgaacctgtcatccacgtcttaagtgatgaggaagaagaggaatacccagaagaaagagtgccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaatttaaatgtaatcatacacagttaagagcaatatagaatttaaattaattaaataactccgttctaagggtgtctctctgtcgttctttcctgtgtttgtgcttatcttcagatggtgaacacgcgcactggaagtggaagtggagctgctaacaatggaggagattccacgctagctcagattttggcccaacaaacacaactgatcaatctgttagtgcagcaggcacagaatcagcaggcaaacaaccagaaccagaatcaacccccacctccccaaaacaagttggcagatttcttacgtgtgagaccccctaccttctcaagcaccaccaatccagtagaagcaggagattggttgcatgcggtggagaagaagttggatttgatccagtgtactgagcaggagagtttcttttgcttcgcatcagctgcatggtcccgctgctgaatggtgggatcactttcgccaagccagggctgaaggagaacctatcacttggcaggaattcacggccgctttcaagaacacgcacataatgacaggtgttgtagctctgaagaagagagaatttagagcgctcaaccagggatctcgttcggtcactgagtacctccatgatttcaatcgtttagctcgctatgctccaaaatatgttcgcaccgatgaagaacgtcaggagaagtttttggagggactgaatgatgagttgtcttatgctttgatgtctacggatttccgggatttccagcagttagtggacaaggctattcgtcaggaagacaagtacaatcgaatagagcagaagaagcgcagggctgcccaatttaaggctcaacagggcagtaaccagaggtcgcgtctcgttacgggacctcaagctacatcataccctcaaggaggatcttcgtcagttgctcgccctcaacgccagttctacaacaacaatactggtaatcgtggcaatgacaaccgcaacgtggtcgctcgtcctgcagcaactccagctaagaaccagcctgtcaggaaggaacagggaagcaagccaggggtgtgcttcaattgtggtgatccagggcactatgctgataagtgtcctaagcctcggcgtgtgaagaacgctccagccccgaacaactctaatactccagcaccgaaggcacgtgttaatcatgttgtagcggcagaagctcagaatgcaccagatgtggttttgggtacgtttcctgttaattctatacccgcatctgtgctttttgattccggtgctacacattcctttttgtctaaaagttttgcgagcaatcatgggatggaagttattagtcttgggagacctttactagttaataccccaggcaatcaagtatcttcgacacagtattgcccttccgctactatagaaatagaagaagttcctttcccatcctctgctggaatccaaagatctagatgttatcttagggatggattggttatctcgtcacagaggagttatagattgtgccaaccgtaaggtgactttaaccagtagcaatggggaaaccgtttctttctttgtgtcctctcctaaatatcatggtgtgatcttaaaccaagttgctctacaagagatccccatagtacaagactacccagacgtgtttcccgaggatttgccaggtatgccacctaagagagacatagagtttcggatatacttggtacctggaaccaaccctatccataagagaccatacagaatggcagctaatgagttagctgaggtgaagagacaggtgggtgattttcttcagaaaggatacatcagacccagtacttcgccatggggagcaccagtcatctttgtggagaagaaagatcatactcagagaatgtgcgtggattattcagaagaattcagtggagcaatcattcagaagaagaagccacttgggagcgagaagatgaattgaagtcagctcatcctcatctgttcgccagttcttccgaatctcgaggacgagattccgtttaaggggggtaggtttgtcacgccctaaaaatcctaaatatataaattgttgtttaattggaattattagaatttattttaaaagcctacaagttaaactctaataatctaggaaaattttcaacataaaaatggtctagataaaattttattaaatactttgcttgttcctctattttctagatttttctaggaattgtttgagcaagggaagtttttttttaataattggaacaacatttcacaaattattttaattaaaaagttccaaaacccctccctaaagttgttgggccgtttccggcccaactcttctcttcccgcgcgcggccaagccggcccaagtcggcccagccgagccgccccgccccctcctcctctagccaccgacatgtggggcccacatgtcggggtcatccctaacctccagccggccggccgcctagccgagcccgagctgccgcctctctccaccaatttcgcctcttccggtcgccctcgagtccgataaattgaggggtttttatccccacatcttcctctatctttaccctcaaaaatcggagcaaatcgttgggtattttatccga

SEQ ID NO: 26528 - DNA, 698 bp, Oryza sativa
  unsure (1)..(698): unsure at all n locations
ctcgtcgccctctacgtgtccatgtgctccaaattcgcagcgacttgctctagctcgggcgaggttgccatcgtagccggccaccattgatgatgtcatcatgacatcatcggtttttctttttcccgattttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgtttcggaggagagcgtttccgttgaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattattannnnnnnnnnnnnnnnnnnnnnnnnnnnnnnnnnnnnn

SEQ ID NO: 26529 - DNA, 391 bp, Oryza sativa
atgaattaaagtcagctcaccctcatctcttcgccggttcttctgaatctcgaggacgagattccgtttaaggggggtaggtttgtcacgccctaaaaatcgcctaatttaaaaatacattgtttaagccatttttagaaattaaattaaaagcctacaagctaaacctaattatctaggaaaattttcaacataaaaatgagctagataaaattttattaaatactttccttattcctctattttctagaattttctgggaattatttgagcaagggaagtatttttaataattaaaacaaaatttcacgatttattttaattgaaaaagttctaaaacccctcctttaagttgttgaaccatttttgacccaacatttcttcttcccgc

SEQ ID NO: 26530 - DNA, 810 bp, Oryza sativa
atagccactacgcaagtcaatctttgtgaaaattatagagccacacaactcatcaagcatgtcatctaacctaggaataggatgccgatatcagatagtaatattattaatggctctacaattaacacacattcgccaagaaccatctttcttaggaaccaaaattacaggaactgcacagggactaagtctttgacgtacatacccgtggtctaaaaggtcttgaacttgccgctgaatttccttagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttg

SEQ ID NO: 26531 - DNA, 698 bp, Oryza sativa
attgttactcggctgaaggtcgttgttgcggaattgctctacaacgtcacttgcaatcctgtcagccgcgttttgagcattgttgataagatcaagagcagcctcttcgcttgtcccgtctgcaaagccatcaatggcgtcaatttcaatcctcgggtacaaggatttggtcatcgctaatgccatgccagctcccatacttccagctttcttgatgttcttgaaatatacatccggagcaactctcagcttgtcgaaaatttcggttgcgtcgagtgcactcggaccactgttattgaggaacatagcttggacgagtggtatagcgacattggcgacttcatctcttgctccttcaagcctcttgatcttactaaccaggacgtcaaactgagcttgagatttgattttacgatctacaaaacacatttatgataagaatctgctgcatttaaaagagagacgtccagattgctagctggcagtaccttcaacctccttcaaggccgaatccctttgcgcagccagttctactttgtcttttttcaaggcttcaatttgtttctccatttgaaccatcctggtggcttgcgctgttcgaaatccaaatggttgaggatatagttatgacagcatagattaatgggacaggtctaaaagaataccttttgacaaaccactcagctcgaagtttgaat

SEQ ID NO: 26532 - DNA, 702 bp, Oryza sativa
  unsure (1)..(702): unsure at all n locations
tttcggagccctcagttcgcgccggcaggccgtcattcgccggcgagaatgcgtgcccaagccgccgccggtggtgacgtcgtcgctgacgtcatcgtcatcatccctcgtggtctagccgtggacgaatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattcagacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatggnnnnnnnnnnnnnnnnnnnnnnnnnnnnnnnnnnnnnnn

SEQ ID NO: 26533 - DNA, 648 bp, Oryza sativa
tttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattg

SEQ ID NO: 26534 - DNA, 727 bp, Oryza sativa
  unsure (1)..(727): unsure at all n locations
nnnnnnnnnnnnnnnnnnnnnnnnnnnnnnnnnnnnnnnnnttgctacctttattttacctggagacaatttatatttggcctgtgataatactctattgtagtgtatgtactaaaaggtgtttttattctatttaggagggatcatatggaggttagtttatcaacattctaaaatatcaatattgatgctcatgattttgttaactattgtttatcactgattttcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacactgcttatgtggttggccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactgatagtgaaatcccttcttatgtgtacaa

SEQ ID NO: 26535 - DNA, 781 bp, Oryza sativa
tttttaaaaataattcattattacgtcataattcaattaaaatctatataaatgatttaatccgatttaatctatgaaaattcataactaattcatcttagctcgcatttagttggttcaagtctctaaatttttctaaaattgagatctacatgttaaaaatatccacatgtactgttcaggcttgtttatgtgctgttttggtgattttgctcttttctctttagagtccgacgttcccggagagtccgaatttgcaggagaagactttgaagagttccaaggccagcaaggcaagtcacacagatcccaaacaaccctttgagtatgttgatcccgtttaaagctattgtttctattcaactattgcatttattttcgaatgtcattgggtggaattaacctattgccttgttatagcccttttgttcttgattactctattccttgataccttgggttattataacttaactagttgagctttatatattggttcagctagatattagacataattgcttagccatgcttagaaacattagcacactattgggataacttatgcttcactattatttaatgatggcttaatgatagctcatgatggttaatcatgattggttaagtaattaatttgccaactaaaacctgataatggtgggttgtgagcatatggttttgatgggttgtgagcacacgattttcggttgtgaaacatttaccgtgtcaaccacaagccagcgtgggcaacggctttactttctatatagtatggttc

SEQ ID NO: 26536 - DNA, 756 bp, Oryza sativa
  unsure (1)..(756): unsure at all n locations
tatatgagctagtgtctctaagcatggctaagcatcctattcactttagctaaagccatataatgttctagctaatcaaattattaaccaagtgacaaagaatagggaatcaatagcaaaagggctataacaaggcaataggttatttccacccaatgacattcgaaaataaatgcaatagttttatagaaacagtagctttaaacgggatcaacatgcttaaagggttgtttgggatctgtgtgacttgccttgctggctttgtaactcttcaaagtcttctcctgcaaattcggactctccgggaacgtcggaatctaaagagaaaagagcaaaatcaccaaaacagcacataaacaagcatgaacagtacatgtggatatttttaacatgtagatctcaattttagaaaaatttagagacttgaaccaactaaatccgagctaagatgaattatttatgaattttcaaagattaaatcggattaaatcatttatatagattttaattgaattatgacgcaataatgaattatttttgaaaaggaaaaagggattattgcgtcagcggctcgggttcacggtggaccaggtgcacggcggcggtctacggaaacgaacggctgagatcttatcgatctaccgncggtccacggctagcgtcagcgctgacgtcagcggtgacatcatcaccggcggcggctccgacacggatgctcgccggctaacgacggcgcggcagcgcaaacagaaggca

SEQ ID NO: 26537 - DNA, 628 bp, Oryza sativa
  unsure (1)..(628): unsure at all n locations
atttgacgatcaccacggcggcttttcccgagcgacgacgacgaccgaaagaacgncggcgcacggctgaacgaacggcggcgacgcgggcgctagactacacgacgctagggctctaccggcgacaagagacttaggcgagggtggcgccgggtagaggagacaccgggggtccttttatagcggctagggggtggcggcgaaggtccccagcgaccggcggcagcgatgaaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggattnnnnnnnnnnnnnnnnnnnnnnnnnnnnnnnnnnnnnnn

SEQ ID NO: 26538 - DNA, 642 bp, Oryza sativa
gctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatatatgaaaatgcccccaagaagaagtaccatcaccacctgggtcaggcggctatagcgtcgcagtgccaaagtgggaggagatggaagcaagcttgattgagaggggtatcgaaccggtcaccgttaaatggccggatcgatcgaagttctggtactatgctcacggtggaacgcttaaccc

SEQ ID NO: 26539 - DNA, 1575 bp, Oryza sativa
atctgaaatgttaaacgtgggactaaccccaaactcaggaggcaactcaagtttatatgcattatcattaatcttctcaacaattttaaaagggccatcaacacgaggcatcaacttagactttctcaattctggaaatctatccttccgcaagtgcaaccatactaaatcacccggttcaaacttaacctcttgcctacctttacttccagcaattctatacttttcagtcatcttttcaatattgaacttggttgactcatgcattttcaaaataaattcagcgcgtgccttagcatcattatgaatcctctcactagtaggtaaaggcaaaatatcaattggagcacgagggttgaaaccatacactacctgaaaaggacttaccttggtagtagaatgtgttgcccgattgtatgcaaactccacatgaggcaaacattcttcccacatcttcaaatttttcttcaaaatagccctcaacatggtatccaaagtgcggttgactatcttcgtttgtccatctgtttgtgggtgacatgttgtagaaaacaatagctttgtacccaacttgttccatagtgtgcaccagaaatgacttaagaattttgcatcaccatctgaaacaatagtacaaggcataccatgcaagcgaacaatctcatggaaaaatagatcagcaatatgaacagcatcatcacttttatgacatggtatgaaatgtgccatcttagaaaaacgatccaccaccacgaaaatactatccctccccctcttagttctaggcaatcccaaaacaaagtccatagaaatatctgcccaaggaatagaaggtacaggaagaggcatatacaaaccatgtggattcaaacgagacttagctttctgacaagtggtgcaacgtgccacgaacctctcaacatcctttctcatccttggccaaaagaaatgcatggccaaaacatcttccgtcttcttagctccaaaatgtcccatcaaccctcctccatgcgcttcctgtatcaacaaaagacgaacggaaccaactggaatgcatagacggttagctctataaacaaatccaccattgagcacaaatttgttccaagtacgtccctctttgcaatttatcatcacttcattaaaatcaggatcaagcgcatattgttctttaattaattcaaggccaaaaatccgacaatcaagttgggacaagaaagtatagcgcctagacaaagcatctgcaatcgcattatctttccctttcttgtgtttgataacataaggaaaagattcaatgaattcaacccattttgcatgtctacgattcaaattattttgagagcgaagatatttaagcgattcgtgatcggagtgaataacaatttttttaggccacaaataatgacgccacgtctctaaggaacgtacaagagcatacaattccttatcatacgtggaataattcaaaacatgtcggatcccaaaactaatgatttggaaaccgacatgtttaactgtatcaagccctggatcagtagattgatataggttcaacaatctggatcttcattg

SEQ ID NO: 26540 - DNA, 1698 bp, Oryza sativa
catcaacaagaactccaaatagactctgaaaaagaggggttgaagtaagggtgagtacaacgtactcagcaagctattatattattcaacaatgaatgcatgagaggtaatatccgtgtagagctaggtttacttgcagaaggctgagaataaagagggagaaagcctgcaacgtatttgatgcaatagtatttaataaaatctggaattgagtttctaaccaaagtaccatatgagtcccgatcctcaaatccgtcagttcggctattcgaatagattcaaggatattcatactgcagtagatgtacgctttacccgcagtccatgacttgccactaatcattagcttagtcatggcccagtattaggttattaacaattgtggcacctgttccatgaactctagtccccatgcgctatgactgtaacgttatcagcagcgagaggagttctggcattcccacgtcatctcaaccaggttttcataaatttacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattgtagaagctgcggtcgtactcgttcgtttgacataagtacttggtaaacttatatcgaccgagacagtactagccacccggaaatcaaccaaatcttgcgtactgtcccaatctaagttcattatattttatgcaatctaacttggcagggctaagcaaaagctagcatatctggtttgctatatgtttaggttatgcattgtaaatcatgaatggctaatgcatgtgtaacatacccgaaattttaggacttaaaatttcttgtcaaaatagttagaggttaatttctccaattttgagagccaaaaatttctgttttaatttaggtgatgaccaacttaaaccattgcatgattaaaatttgagaacaaaataaaaccttttcattcccaacattagactagaaatatcatcaagcatacatgtacataatgcatgcctaggcttgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaaatttaatgtaatccctataataatattagatgcaattatgaagtgggaatacatatacaaacaaaggtcatcctaattctctaaaatattttgtgcaagataaaatcatggaaaaatttatgtgtacagtgattagcacaaacttatcctctgtaattttggtaacatgttaacactcaagttgatatctcaaattaatcagttgaagcagacaactaaaagaaatcaaattaaatttaatcggctaaaaccatatttcatccaaaagtacatttaactgcacataagtgaacatggaaaattatttattcaaatactagattaggtatcatgaataaatgtaatttttctagaatttttctttctctgtttaagcctcctaaaaattcaatctagctttctaatagcccatttttgtttaatttgtgtgagcag

SEQ ID NO: 26541 - DNA, 7978 bp, Oryza sativa
tcaacttaaaccattgcatgattataatttgagaacaaaataaaatcttttcattcccaacattagactagaaatgtcaccaagcatacatgtacataatgcatgcctaggctcgagttctttgtgcatttggagttttggtcttgcattccataataggtcccatgagcataatctaaaagaattatttcaccaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagccgaccaagaaacacatagagggagagattgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccgtcatcctcaacctcgccactggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgccgacaacgccctggagcacgcaccggagcgccgccgcttcaaccatcgtcgccgtcgtcggccattctcatccacctcagagaaagccgctgcgccattgtcatcgcctcgacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcgcacatgcactttcaccccaaaaccaccgccactcacactcgccatcggcgctactccgatgtcctctaaccaggaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagtgttgtttaagtaatacataaacatatataagtatatatatacactttaggtctaattaaacctaaataaaaacttgattgaccagtgaagccatagttccatcctcatataaaacttagaagaacttggctcatataacaatttctaggttaatataatatattgctagtttagattaaagcatctctactttataaaatatgaaccatagtagtaaagaccataaacatgtgagataaaaatgttttagttaaccaaattattccttttattcaacttaaacatgaagtagcatgttctgaacctataactcaggagtcatgcacatataaaacactatatgcctaaaacacgttgtaacttgtaaaatctataagaaaatcattataactccaaaaattgtgaaacaaaatgtgttagtcttagaaaacacatctccacacccctgtgaagtataatctaataaaaatcactttacaaaagtatttcataacactacctaagactatactactataaaccgataaaacttctaaaaattcataactccctaatggaataagataaaataaaaattctttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaactcagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaattactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacactggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcttttacaaaagaattgcgaaacaaaacttgctttatgctgaaaatgaactacatattgtcttcctttgaatatatgccttacatgtagtatagtaggattgacttgtgcttgccagtacattaacttgtttaatgtactgactcttgctattgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcatagcctcaattcactgccaactcctttaaatcgtttctacccctcatgttgacacctagctctcactttccaccttcactttcaccattcactactacaaccaagatttttgtgtgagggctaaaatgatttttgcgtgcgggtaaacggcccgcatgcacttaggggtctgggaaaatgacgatttttgcgtgcaggtgaagcaccaccacaggaaaacaaaaacccgaaaaaacataaattttctttaaaaatgaaatcctagaatctggtggtggcgccgccgctcttgcttgccgctgccgcctcctcgtcgtcatcatcatcgtcagtggcggcctccgcgccgctcgcctcggatccgtgctcccctccggccgcaccgccgcggacgcccctcccctccgccggatctagggagggaaggaagaggaggggaggggagatggatgccatgcggggggagggcggccggccgctggatccgtgcgtggacgaccgccaccgctggatttttgcgttgatggccgctgccgctggatccgtgcagggacggccgccgcccgccggatcccacgccctccaccgccacaacgtggaggaggccggcgcgtgcctatgcccaccgcggctgtcaccgcgcgccgccgccgctgccgccatcgggaggagagg

SEQ ID NO: 26542 - DNA, 21921 bp, Oryza sativa
  unsure (1)..(21921): unsure at all n locations
tgaaaggtgtgattttagtgcacatccttgggaactagattcacatgagtatgagttaggaatatttgagaggttgtagatctttagctatttttgtcaagtctcctgaatgtgtaacacatctggtcgccgccttcgagtggtttgacgggcacatctcaggctgaagttgactggcaggctaagggcccagcaatgtctccaatatttctctctcaaggtgtcggatgtttcattatgcttgtttgatgacttgaattattcacttcatctctcaaatataatggaaggtccggagagcctacgacagcatgagatatgggagataaagaatataggacatttatgctcaagagaggaataataacttgccttgctccaacgcaaatgaatccaagataggcaacctgattaaccgattctcgaaataccataggttgccatcccaaaagacaatagactttactgagaaagtggaagaaccaaattcaataaaagccataaaataataagaagacgataaacggctaaaagggctagggtttaaggtataacctatatcttagggattatggggcttgtatttgctagtggtaggtttaggtggtataatacctagggtttagttatatgggagtcgattgtggagtaggatagcatataggttaggctctatattttatgtggaggttctagaggattggaggctagaggggattaagcaattattgtcgcttatattttatgtgaaggctctcgtggtttggatgataggaaatatgctggatagttgatatggttaaataggcatgtggctaatatgggtcaaggttgtacttttgtagaatagtggctagggtttagttgtttaggccgatatcaaggtaggataaatatcggctagggttttgggtgttcgctagtcgtcgctagagttggacggcatgacgactagatttggtatcatttctagccatgtcgatagacagcatatcagctagaagaataggaggtgggtgcaggtttagtggggcggaagtgttactccgacaaccgtgagtggcggcggagcggctaggatcacacagagctcaagagctaactgtgcggcgtgcaatggaggtcgaggggatagtgaagctccgaccgatgtacgcatcaaggcgtggggtgccaggagcagcacttcgaccttgggtttggtttatgccgggctttacaaccaacggtccgacgttgaggtccgtagaccgtgaacgtccccatggaaggcgtaaagttccaaccggcggctttttagtggctaaagggtattttggaaataaaagaaaatatttgaaaagcaaatataagtttaaattgtaaattcaattataagattaaatcaaatatttattcaaatggtatttgaataaattaaagaaattcaaataaaatcttaaaatagcaaatttgatatcaaaatgaagagtttgaatttagatgaatttaggtccaaatttcactggaatcggatctacggtttaggagatatgggcttctaaagattgggatttgaattaaatctagaaaatacgaaaaggtactatttatgggcccacctgtcagtacctgcccttcttctcttcttcttttcttcttcttcttcttcttgccggcaacagagaggagggagggaggtggggcgccggtgctccagtggccaaagtgtggcgacgttagcggtatatcgtgttcccgggcgacgcgcacttggggattgtggtagctagccaagggaaagagggagatggccggaacggcggcgacgagagctcaactccggcgataagagaaggtggtggtggcggtttatctcaagatggagggagaggggaaaggggaaaaatggaatcacctcggtgaggcggagttggtggcgcaagggtttggcttgcgaagctccggtgagggaaatcggccaatggcaaccatggccggacatgggagagaaagagagagagatggagctctgattgtatgtagagaaggggagggatggccggctatttatatgggagagaggtggtggtgaaaggcggttgtggaggaggagatcgagaagcacacggcgacgacagtggcgtgcaaggaagggcaacggcggccggctttcgtttccttagcggcgacgtttgcggcggcgtgagcagtgcacggcacgcgcacgggaggaggaggcggctcggctggggtgtgggctggtttgggccggctcggcttagctgggacggcagcccaagatggtggaggaaaatagaagataaaagaaaagggattgggccaaaaaggaagaaagaatggagtttcggcccgatgacagaaagaaagaagtctaatttgaatacctgatttggataactaggttttgcaaaggatttgaattcggaaagaattcacaaaagagatttcctaatttatttgagtgcaatatttagaggtggagtttgagggaatttgtttggaagcactcaaataggaagggaaattaataatattcctcaaaatatttttgggaatatagaagagaattagttgaaggcaataaataggatttgaactctaaaattggtgttatgtatatttgtggctaaaagagaaattgagtgaagagtataaattgaaattttcttagcacaagagcaattattcacaatatttgcaataatactattcttgtgccgaagaggaaatcaagccacataaattaaattggtggctagatcaaaaggaggaatttggatagttggatcgagaatcaaaggatggttttaagatcaaaggatgggctaacaattaattccaatgagattggaattactttggtttaggttcaagggcaaaattggaggatttcttggaccataattcataatagtaaaaatggttttcaaactaaattcgaataaaagagttttagtcgaaagaaggtttaatattcgaaaataaaatttcaacaagaaataccaaatatgtttttaaatgaaaaacacaaaagggattaaataccagagaggttttatgcgagttagttctaggaggtccagctaattatattttcctaggtctagaaggttattaaaaacataagaatcagcatgatgcaagattagaaaatgacacattttcaggatgttacaaaacaagaccatgcaacttctcgctaaagtatgcaacaggcttaccatcttgcattaacacacctccaatgccaactgcactagcatcacattctaactcaaaagtcttaccaaagtttggaagttgtagcaaaggtgcatgtgtaagcttgtccttcaaagtatcaaaggacttctcctgtatctttccccaatggaagaccacccctttcttcgtcaaatcattcaatggtgcagcaaaagtactgaaatctttgacgaaacggcggtagaatccagcaagaccaagaaagctcctcacctgtgtgatggtttcgggaaccggccaactccttatggcttcaattttcgactcatccacctcaattcccctgtggagtaacaacatatccaagaaaggagactcgttccgtgcaaaagatgcacttttcaagggtagcaaacaaacgtgcatcgcgtagagcattaaaaacagcacgtaaatgatccatgtgttcattcaaagacttgctgtaaatcaatatgtcatcaaagtacactaccacaaatcgtccaataaaaggccttaaaacctcattcattaagcgcatgaaagtactaggtgcattaatcaaaccaaaaggcattactaaccactcatacaacccaaatttagttttaaaagctgttttccattcatctccaagtttcattctaatttggtgatagccactacgcaagtcaatctttgtgaaaattatagagccacacaactcatcaagcatgtcatctaacctaggaataggatgacgatatcagatagtaatattattaatggctctacaattaacacacattcgccaagaaccatctttcttaggaaccaaaattacaggaactgcacagggactaagtctttgacgtacatacccgtggtctaaaaggtcttgaacttgccgctgaatttccttagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttgtgttacctttgctcttccggaatcgtttaaccactgaatatggtaagggtgtggatgtgtacgtgtagtcaagccaagcttcttgaccaaatcagaactcacgaagttgttgcagcttcctccatcaatgatcacacgtgcacgacggttgttgatgacaaagaaaatctgaaacaaattatggcgttgcaacctgtcatgctgctgtacctgcgtgctgagcacccgctgcacaatgatggttctgtagtccgttgtgtcatcacgaccaaagcttcgccatcctcatcctcaacttcttcttcctcctcttcctcttccacgtcggaggtggtgatgtagccatcttctgtagcaacataggcccgttgactagggcaatctttctgcacatgcccaaacccttaacaacggtggcactgaatgcgtcccgtcgaggcgacatatgaggcactcttggcgggtacctgcgaggatcctttacctgactctgctggtcgtggtggtggagatggttttggtgccgcagaagctccgaatgctgctggtcgcttgcccgctggctggaaggatgcccgaaacgaaatggccttgggcagtcccgcagatggcgtcgtgcgcggagtgtatgtgcttgccttgctcttgccctgatggtcgcacccctgtaattccttctctgcaagcataacaaatcgaaacaactggttgacagagttaaattccttataatcaacaatgttctgaatttcctccctcaaaccagaatagaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagcagtaggtagtaccccctcatcagataacccagcccaccacataatagcaaaatccttgaactcactactggcttgtctaactctatgttgctcgggtacaaggtgggcattaaacttttgttctaccgtcatctcccaatcaaggtatttctcagcatcataatatcccgaaaaagatggtattttaaacttaaccttagcataaggatcatcgggcacatgattattattattaccttgttggtggcgagtgccacccatacctgtgcggtttgtgcgtaggcgatgtcgtagccatgcttgccttgtagccagtgcatcaatatagccactggaatcatacaccgtgtcttcaggatgagcatcgtcgtcaccactcaccacttcctcattggaaggtgtctccaacgcggcgacctgatcagatagcgtggatatccgcttgtccaacctctccatgtggttcaggaaaccgattttagtgaaggcatcttgaacagactttgcaacggcctccgtgatgtccttttgagtattttgttggagagttcgtagttgctcttggctgacacagtcagcaaaatcctagggactcttctcaccttcgttacctgacattgaaacaccaaaacataaacaaaatggtgaaggttatccctaataatctactacgcaggtgtagtggtgcctctcaacgattctaagcaatatggagttcctaaccaagctcttataaggttcttaccagcaaagcaaaggatacctagaaggcgtagtcagcgattgcagggatcaagaacctgtgctgtgcagaagtaatatgtggagctaggaaggccaaatatatgtatatgagtggtacacaatccaatgacagatagtaatgctgaataaaaatcccaagtcacttgcccatagttgctagtctactcatgtcctagacagtagtgataacaaagatggctcaaagaatatgacactagtaaacagcaaagaaggactggcaggcaagcttcggcgagtttcagcaaaaactacaaaaccgaactggcaaataagctcaacggagcgcgtcatgagctcaatgcactagtggaaatcaacttttctttttttttcttttatttttttgatatttttttcttttttcagaacacaaaaataggcagacctccaagttacagcttaatcggagtaggtatgtggcctatggatttttctgaaaccactataaacaaggtgcaggaacttgtgagctcgaacagacaattttgcaagccaattttcggaattttggattcgccaaacccgccgaaaattttgcaagccgatttttggaatttttgagaaaatttttttctcttatctgaaaagttaaattttgcctgattccgagtccgtatgcaaaagttatggccgtttgaagtttcggcttctggctaggttttccaaaggggatataacctagtctattttgcggtggaattggggatatggtggcagcggagttgtagggtgttctggtggtgatctggatgggtgtttatgatggcggaaacggctctcaaaggatgaaccctagcacacggtgaaaggtagcggctagggttacgaaaggacaaacacacgactagactaaaacacgcattagaccagcaataggaatttagactaggactcaaactcaacactacggactctgaaaaggaatcatgcaaaggctaaacatggtctaggttaaggtaactaacaactaaattttttttgccttttctgtagactctaggataattgcgaaaaacaaaaactaatctagggcaaagaactcagcgaacttgacggtgaacctagagctctgataccacttgatgtgcactatggttcccgatcttccgaaaggttctgataaacaacgatttggacggagtcgcgacacaaatcgatccggcttcttgaacgcgcacgtcttgagccccgcaatcgcagcaccacgtctcctctggttatcaaccatgtcgaaacgcggatgacctcaccgagaaacctaatccctgtttgccagtcgaagaacacaaacaagaacgagatagaaaaacaaccaaaattgcagatgaatgattaagctcacggagttggggtcttacaaaccgatctagcggcgaaactgttctcgacagattaatctaagcaaaacccaaaaacctaaagatggcggtgggtactgatatatagagtttagggtcgtgcaaacccctctcgacgccaccctaatgggttccaacactatacacgggccaaaggcccaaatacggtgacgcagcaccgggacagattctggatgtcaatttgttcggtcatttcccattgactcggaaagaatttagacgtgggaccaaaaccattggaaatgttatcttcttagctttccatccatataaagtatgccccaatccggacacgtatgcgacctgggcgcccgttttagtgcagactggtcctggactccgaattgcacccgacgtcgacttggtttgggcctccaccttgacttggacgtcccagatgatcctccatggctctaagtccttctccaagtgtctccttgtcccctccattgttcctaattacaacataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcagtaggtacacaggcccgagaataccgatctctttgacaaggtgacaaagcagatgcgtcattatattgaaaaacgaaggtggaaatgtcaactcaaagctgacaagacattgcaccacatcattttgaagggcttctaatctatccggatcgatgaccttctgcgaaattgcgttcatgaaagcacattgctttcttattgttgcccggacattgtctggaaggataccccgaattataactagtagcagttgtgtcatcaacacgtgacagtcatgagactttaggtttgtgaacttcttctcctttatgcttattattcgctttatattcgtggaggacgtccaagaattcccaatagggtaactcccaaaatatagagttctttttccacatcgtcgcgtgaccatctgcgctatcattaggttggctgccaggcccctttccaaacactactttaagatctttcaccatagcaaacattgttttctcactgcgatgtttaggcttcgtacagtggtccgccttatgttcaacgtgcttgcctttctttcgtacagggtggtttgcagcaaggaatcgacggtgacccatgtacacaaccttcctacagtgcttaagatacgtactttctatttcatccatacagtgagtgcaagtcttgtaccccttgttaaactgcctggataggttgctaagtgtaggccaatcgttgatggttacgaacagcagcgctcgtatgttaaactcctcctgtttgtcctcgtcccacacggggacaccttctttcttccacaacagtttcagatcttcgaccagtggtcttaggtacacatcgatgtcgttaccaggttgcttggggccttgaataataatcggcatcattatgtacttcctcttcatgcatagccaaggggggaggttgtagatacacgtcgtaacaggccaagtgctatggccgctgctcatctctccaaaaggattcatgcctgtcacgcccagaaattcactagtaatttctgaactaatttatgcatagaatcctcgtccaggaatcagccaaggtacacaaactgacaatttaatatacaaattcatcataataataacgttacatacttacaaaacaaaagaaaaacaacagcggaattacgatctagcgatggcttcagctccactaccacaggcagctcaattggggtataagccaaacgtcttctccttctggatcctttttcttcagctgaggttgattgattattgcaaggtgagcatatgacatactctgcaagccacatagcaaatatgcaagtgcacaaggataccaaaggatggcataaataggctcatttgcaaaagcagcatttagcaaacatttgagaattgaaaaacagtagagtaattaatcaatgttattcaacatgaacatcacacccatgctgctcaggcccaaccatcctgtacacaaggagctaagcaaattattaccagttatagcatcaataattatttgagaggtgtgacactaatcacgaaaaatattgctcaacccgcccatgaccgcgggcacggctattcaaatagttttgttctggccagaggtgtaccactgtatccacaagacacagctccacgatatgttaccatgcgcctcaataccaccacggtacctcggaaaagaactgtgacggtacccctcgcacaacacaactcatcatagtgcaccaatcctggatcataatcaccccctctataaatataaccagaggcatggactccccagcgacccccatggacttctcgccgcttctcggtctaatgtcctgcaatgaaccttgctatataaaaggtaaagccgttgcccacgctggcttgtggttggcacggttaatgtctcacaacagtagctcgcgaaccggtccttaattgtcatgagcacgagcttcaaaaccatatgctcacaacccaccattatcaagtttaaattatcataacacgattaaccatcgtgagctaccattaaatataatcataaataataatgtagtatgattcattccattaatgagctaatgtttctaaacatggctaagcaattatatatatagcatttagctgaaccaatccaatatataaggtccatgctaatcaatttattacccatagaaaaataaagtcatcttcgaccataattaattgggaaaggctcaccacccgatggcattcgaaaataatgcataagttgaaataaaacattagctttaaacaggttcaacatgctcaaagggttgtttgggatatgtgtgacttgccttacaataatcagtcttcaattaatcttctgaaccacttccgacgctctcacgaaccttcgcaatgacggaaatgacaagctaacacgcaaaacgaagaaaaagactaataaaaaccaaataaacagtacataaaaagtaaacgaacatgtagatcatgattttagatgaattatgagacttgaacggcctcattctgacttcatatgaattagttatgaattttacaagattaagtccaattaaacctattaaagaaaaaaaactattccaaattaattaaacaatttacaaataatttataactgagatataagactaaagcatcctccggaaattattggaatgaatttagtagacgacatatagtaaaaagaactaatatgccattgaaagggataacatgatttatattgattttggaaggctgagatcaactttgacctagttgaccaaaattggatggctcggattgatctgatctaaggttttagatggctgccacgtgggacaaaagagatgacgtggcacttaggtgccagggacggtagctgacaaggcgatgacatggcaaccacgcgggatcgacgtcggctgctctgttcggcggtgaggacggcaaacggcggcacaacggcggaaaccgagagcatggggaggatgaggatgacgcgacgatccttaccaacacttacgcagcgatgaacagcgaaggagatggccggcgacgagatcgggagtggcgatggggtactgatcaacgacggcgacggcgttctccttacagatgcaaatccaatggaggcaacggcgaccgaaggcgacgacggacgacgacgaacagcgcgactggagatcaaaccatggcaacaacccacaggttcacggcgacggcaaccttccggcgggattcggcctcgggtaaggggtggacggggtgtagcttgaccttgcggagccgaaagaggtggcggcgtaggagggcgacggccgaggcgacgacaaacggcggctggagcgactgccggcggcggagaaagaagacgagcgtggggaggcggctagggttagggaaaacttcgggaaacagaagaggaggctgaggggatgctatttataggcaaaggtggaggagatcggctcgggaacgcatgaattcggtgaaggaagttaggatttatcctgagtttccccggataaaaacgaccaaaattcgtgagatagataacgaatttgatgaggcatcttagggatatgatagaggagatagggaggaatccgtttttgcactcaatttggaagggaagcaacggatgcatcgaatttgatgcaggagacggcggctctcgggaagaacacggcctctagacggctggctggagctttaagacgcactgtatcgcgggggaggccaaacagactttaggctgggctgaggaacagggagaagggaggaaggaatggtcccaaaagggcccaagctgaggaggaggatttttattgcttttccaaataaatcaatcaccaaaatgatctttgaattgttaaaaatacttcccatgctcaaataatttcaagaaaaatcctgaaactaattggacacccaaagtacttaactatattataatcagaccatttacggattaatttattatttcaataattgctgaactgctctttgtattattaaaattaggaattgagctctgaaaaatccgagaaaatttcagagagtataattaaccatggagaatttaataaaattaaatccagccattctttatatttaggaaattttatttcccacatttaacttcacttgtaatttaatgagcatttaatataaattctaaataaacacaataaactcataccttgccttagcatctaacaaacggcggctcaaagatgtgatgttgtatccgtcgctgttcatcttctcttggttccctcataagcataataatgtcttgccccttgagcaaaatcggctttcttgattgcacgatttcaaaggcaagacgaacaccgcaccaacatccatagcatcatgtgaaggagacttatctctaatgaccgatgattcttctctcatcatattggatttatcactagtttgggaaatcaccgatctcttaccttttacttctataggtctccacactcgcttaggtgtcattcgaggctctaaattattacatgttttgttctccatatattcggcctccttttctttttgacctatggcccgaagacgctgtagcctcctcttttgagagcgagataagtcagaaggtatccatttcgactgtggttgttttccaggagctaagcaatgattcttcatatttttggtcaaagtgaaagctcctgtgttgctctcaattttctcactcttctccaatgcccctcggtcaaaccggcctctgagctcggtcagaccggccacaagccgtcggtcagaccggccaggagggtcggttagaccggccgttgtctggcggttagactggccagctgttttggtcaggccgccgatgttgacagtaacggcgtcggcttcagtctcctccgcttgtatagttttcgccgcatctccagtaggtacatgaacatcttgagattcctcattgatagcaacgacctccggagctttggcttctttcctcacccacaccttcttcacctttgatccaccggaccgattcttttgtgggaaacgatcttgtcttgaattagatgaatgattctgtactgacctaggtgattccttccactcttgataatacggcataggtggttgatgcatccacggcatgtaatacataaaaggataaccaaacggtgacattggatatggataccatggcatcacaaccggtggtttatatggagttggtatagttgatggctccgattgctttgatgtttgaccaaatctcctcttacgagatgatcttggtctttttgaatcactagtttgattatcaaatcgttgaccggctaatcctttcttgtacttagccataagcatctcaaaagtgagcttcggctttttggtcctttggaaactagatgactcatcctttgcaactttatgatcttcggccttcgcattttttattctattcttgggccgaggatccccaataataacacttttccatttctttttgtcaacatcaatagaactaacagggagagaatcactaacaattccggtcttaggcatagaaataaccgaaatagtttcacaagtgaccgatgaatcatcaaccgatcttttctccatcaagcttgcatctttaaaataatcatgaaactcatgctccatttgtaaccatgtagaaattgaagtaggagcaaggaaactataccatgtagatgcaaagtttgacaaagaaaggggaaacaacttcaaattaagcaaatcatcactatcgcccttaccacattaataaataaagcggccgatatgctccattgtagtcatagcattctcacctttgaatttcgtgaagttgggcacctcaaatacttgcgggtatgggaccgaatctacatgttcaggatatggcctttgatatgtatgcatagctactttggattctatttcaccactattgtcacaccctaaaaatctccaaattataaattttcgtttaattggaattagtagaatttattttaaaagcctagaagagaagatctaattttaattaataaattccaatataaaatggggccagataaaattttattaaatactttgcttaattctataattcctagatttttccgggatttatttgagctaaggaagtatttttaataaatggaattgcatttaatgaataatttaaatggaaaaaggtttttaaaattcccttttggttttgggccgaaagtcggcccaaaccgctctctctctctccctcggcccaagttggcccaagccgaccgcccgcccgcgcgcgcgcgcgcgaccgccgctgacaggtggtgacccctttcctctcgccgaaaccctagccgagctgcgccaccgccgccattccaaatccagccacccctttccgtttccggtgaaattgattgaggggaaaggatccccatgatccactctaccttttcccttttggaaacatcgtctaaatcgctttggaaatcgccggatttgagttcgattcggatcgatctctctcctccaaaccctaaactttccttcccgtcgccggtcgccgtgggccttcgccgccgctccctagcccctataaattgacccccgagctcccctctacccgtcgccactctcgccttagcccgccgccgtctgtagcgccgcctccgcgtgagaccttgagccgccgtcgctgccgtcgctccagccgtgcgccgctgtcgctccggtcgtcgtcaccgctcgggaaggccgccgtcgtgatcgccgtctcgttgccgtctccatccgcaccttctccgtcaccgttgaccgccggaacgccgtcgccgtcgtcaagccgaaggttgctgccgccttttcctcgtcgccgacgtcgtccgttgctcgtccaccgtcgctttggtaaccggtgagttcgcagcgatgcccgcatcgtttcggagccctccgttcgcgccgccacgccgtcattcgccggcgagaatgcgtgcccgagccgccgccggtggtgacgtcgtcgctgacgtcatcgtcatcatccctcgtggtctagccgtggaccgatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattccgacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttattaattaatttgccaactaaaacttgataatggtgggttgtgagcacatggttttgatggtcgtgctcatgacaattatggaccggttcacgagtttcggttgtgaaacatttaccgtgccaaccacaagccagcgtgggcaacggctttactttctgtatagtatggttcattgtagagcaccagactgtgaagtggcggagataagcccacgggggtcatcttcggccattaattaattgggaaaggttcaccacccgatgatattcgaaaataatacatagttgaaataaaaataatagctttaaacgggttcaacatgctcaaagggttgtttgggatctgtatgacttgccttgggcttccacaaatgtttcggaaccttcctcaacggaaacactctatccggaacgtcggaaactaaagcaattaaacaaaaattaacaaaacagtacaaaaacaagcataaacagtacatgtgaatatttttaacatgtagatctcaattttagaaaaatttagcaacttgaaccacctgaaacggatctacggttatttagttatgatttttcgaagatttaatctattagaaaaacgggaaaaagaaaaagatgatgatgtcatgatgacatcatcaatggtggccggaccgagatggtgacctcgccggagattggatggtcggctgcgaacatggaggacatgtacacgtagaggacgacgagacgaacccaacggtactcaccctcgagccaaacgacgaacgacgacggccggcgacgagatgaacggcggcggcggctccggtcggtggtggcgagtaggctccggtggtcggtggctacgggggacgggcggccgggcttcccctcaccttggcacacctattggcggcggcggcaaggggcggcgacgacgaaggcggcggcgcggcgctacccaagttggccggcggcggtggcgagctagccgncggtggcggcggagctacggagcacggaaaggcttggagacggggaaaacgaaagaccagcactaggggatcctatttatagccttgattgaagagatcggactcctcccgcaagaaatcgatccgggaatccaaaacttcggttttgaagataaactcgagaacgagtttgattcggataaaatactcaacgattagctccaattttttgggggtaaagatagagaaggatgaaaggatcaaaaccccttaaacaatcggactcggggaggccggatttgatgcggatttgaaggggaaagggggcggctcgggcggcatggctgggctcggccagccgactgctagaggttagggaagggtccgacatgtggggcccacatgtcggtctcccgagtggagggggtggctggcgggttgggttgggccggctcggtggctttgggccggctcgggcgcgcgggagagagagaagttgggccggaatcggcccaacgacttagggaagggatttttgaactttttaattaaaataatttgtgaaatgttgttccaattattaaaaatacttcccttgctcaaataattcccagaaaattctagaaaatagaggaacaactaaagtatttaataaaattttatctagctcatttttatgttgaaaattttcctagattattagagtttaacttgtaggcttttagaataatttctaaaaatgatttaaaatatgcatttttaatttaggcgatttttagggcgtgacagcccctctgtcagaatagagatccaaggtgtacctttcctgtttaaccttattctgttagaatctaaagatcatgatgtcatcctagggatggactggttagccagatataaaggtgtgatagattgttccaatagaaaagtaactctcaccagcaatgatggtcaagttgtaactgttcatgcattgccctctgaacctcgaaggtcaagtataaaccaaataactttggaagagattcctatagtccgggagtaccctgatgtgttccctgatgatttacctggtatgccgcctaaaagggatatagagttcagaatagatctggtgccaggaacaactctgatccataagcgaccatatagaatggcagccaatgaattggaagaagtcaagaggcaagtagatgatttgcttcagaaaggatacatcagaccgagttcatcaccatggggagctcctgttatctttgtagaaaagaaagaccatacccagaggatgtgtgtggactatcgcgcacttaacgatgtgactatcaagaataagtatccactgcctaggattgatgatttgtttgatcaacttaaaggtgccaccgttttctccaagatagatcttcgatcagggtatcaccagttaaggattaaggaggaagatatacctaagatagcttttactactcggtatgggctgtttgaatatacagttatgtcttttggacttaccaatgcccctgctttctttatgaacttgatgaacaaggtgttcatggaatacctggataagttcgtggttgtctttattgatgacattctcatatattcccgaactaaagaagagcatgaagaacatcttcgtcttgcattagagaagctgcgagaacatcagttgtatgccaagtttagcaaatgtgaattctggttgtctgaagtgaagttccttggtcacgtcatctcagcaggaggagttgtcgttgatcctagtaatgtggaatccgtaaccaactggaaacaaccgaagacagttacagagattcgcagtttcctaggtctcgcaggatattaccggaggttcatagagaatttttccaatattgccaagcccatgacacgactgcttcagaaggatgtgaagtacaagtggtcagaagaatgtgagcagagttttcaagagttgaaaagtcgcttaatatcaactcctattttgattttgcctgatccaaagaagggtttccaagtgtactgcgacgaatccaagcttgggctaggttgtgttctgatgcaagatgggaaggtggttgccaatgcatctcgtcagttacgtccgcatgagaagaactaccctacttatgatcttgagttagctgcagtggttcatgcgttgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattatcacccgggaaaggctaatgtcgtagcagatgccgttagtaggaaaggctattgtaatgctatggaaggacgacagttgccattggaattgtgcaaggaatttgaaagattgaatctgggaattgtcagtagaggctttgttgcagctttagaagcgaagcctactctcattgagcaagtcagagaagctcaaatcaatgatcctgatatccatgagatcaaaaagaatatgaaaagaggtaagctatcggtttcttggaagatgagcaaggaactgtatggttgggtgagagaatctgtgtcccagataacaaagatttgaaagatgcaattctaaaggaagcccattatacgttatactccattgaccctggtagtactaagatgtaccaggatctcaaggaaagattttggtgggcaagtatgaagcgtgagatcgcagaatatgtagcggtatgtgacgtttgtcagcgagtcaaggcagaacatcagaaacccgcaggtttgctgcagcctttgaagataccagaatggaagtgggaggaaatcggtatggatttcatcaccggtctacccaaaacatcgtcgggccatgactctatttgggtgatagtcgactgacttaccaaagtggctcatttcatcccggtaaggaccacctattccggaagttgtttagcggaattatatatggccaggattgtgtgtttgcatggggttcctaagaagatcgtgtcagatagaggtagcaagtttacttcgaaattctggaataagctccaggaggagatgggttccaagctgaattttagtaccgcttattatccgcagacagatggacagaccgaaagggtaaatcagattttggaagacatgttgagagcttgtgctttagacttcggtggaagttgggataagaatttgccttacgcagaattctcgtacaacaacagttatcaagctagtctccagatggctccttacgaagcactgtatggtcggaagtgccgcactcaccggtgcaagaaactacgacggacgacgacgtacggcggccggcgacgagctccgacaacggcacggcttggctcgacgtcgacggcggcgctgcggcggcttgcgacggtggcgaaggggcggccgaggtgatcctcctccgcgcgaacccgacggtggcgacggaaggcgggggcaacggctacaacggcggcgcggcgtggctggaaaggcatcagcgacggcagcggctagggctacgcgccggcgacgctacgggcaacgatagagctcgggacttgaggggaaacatagaggacgactaggggatgctttatataggcttggattagagagatcggaccctaaccaagagggatcgaagccggaaaaaagtagggttagtttggagagataaactcaaaacgaatttgatttggtttattcgggcaaaattgatctccgaaactttagggggaagggagaggataaggaggagatgatttcccctcaagcaatcgaactcggagatggccggttgaggcggaatcgaaggggaggtggcggcgctcgggctcggctcggccggaggtggaagaagaccccgacatgtgggccccacacgtcggcggcttgagaggagaggggcggcggcttggcttgggccggcgtgggccgcacgcagctaagaggagagttgggccggaaacggcccaacagccttggggagggttttaaagacgttttcaattaaaataattcgtgaaatgatgtttcatttattaaaaataccttccttgctcaaataattcccagaaaaatctagaaaatagataaacaagcaaagtgtttaataaaattttatctagctcatttttatgttgaaatttttcctagattattagagtttaacttgtaggcttttagaataatttctaaaaaagcattaaaatatgaattattaatttaggcgatttttagggcgtgcaagtccatatgtcagaatagagatccaaggtgtacctttcctgtttaaccttattttgttagaatttaaagatcatgatgttatcctagggatggactggttagccagatataaaggtgtgatagattgtttcaatagaaaagtaactctcaccagcaatgatggtcaagttgtaactgttcatgcattgccctctgaacctcgaaggtcaagtgtaaaccaaataactttggaagagattcctatagtccgggagtaccgtgatgtgttccctgatgatttacctggtatgccgcctaaaagggatatagagttcagaatagatctggtgccaggaacaactctgatccataagcgaccatatnnnnnnnnnnnnnnnnnnnnnnnnnnnnnnnnnnnnnnnnnnnnnnnnnnnnnnnnnnn

SEQ ID NO: 26543 - DNA, 1727 bp, Oryza sativa
  unsure (1)..(1727): unsure at all n locations
nnnnnnnnnnnnnnnnnnnnnnnnnnnnnnnnnnnnnnnnnnnnnnnnnnnnnnnnnnnnnnnnattttatcttgcacaaaatattttagagaattaggatgacctttgtttgtatatgtattcccacttcataattgcatttaatattattatagggattacattaaattttcttttagactgagaagatgatatttgagtttaatattaagtccacatgttatcacccaagattaactataggtttgtttggtgaaataattcttttagattatgctcatgggacctattatggaatgcaagaccaaaactccaaatgcacaaagaactcgagcctaggcatgcattatgtacatgtatgcttggtgacatttctagtctaatgttgggaatgaaaagattttattttgttctcaaattataatcatgcaatggtttaagttgatcttcacctaaattaaaacggaaatttttggctctctcaaaattggagaagttaacctctaactattttgacaagaaattttaagtcctaaaatttcgggtatgttacactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatacgctaagaataaattaagtaaagaacatgcacacacaaataataataatcatgttgcattaaattgctaaggtcagagaccaacagatgacacattggatagtgctatggccttattaaaagtagcaagagaaattaaatatgcttgtgagcgcacatatgcacgacatacaaatagttgggaccaacagatggatcgactatagatcgctccatatggtcaacaatttattggagataaacattaacataacttggccataacttgaagcaaaacaacatattcttatgaaaggcattaagactggtagcaatgcgagtaggttgttttaggcttgtccttccatcttagcaagaactcccatttcgtccatcttagcaacaactgtgaaattaaaatatggaaatcacattagcgcattagttaattaattttgtagtggaagtagagcataaattgtcttcatgttgcaagatatatgcctgaagttgtcagatgggaagtgaagtcaacaaactatattgatgaaaatgcatggaaggccacacatatgtattagtccacgatatgctacaaagtctgtatctacatataagaagtgcatttaaaagagtgacttcagtgaatttaccagaatcggccagaatacatgggaaacaacaagtgttcttgcagattgagtcggagccaccagcagcaatacaaccaaaacaacatgcttttgcccgagaggatatgcagcagccgcactgtgccgcggtggcggagtcgacagtgaggctcaagatgaccaggcacatgatcaccatcgaagtggtagtcctctttccctccattgcctcctgctgctgatgctaccttccctggttacctagctatgtttcttagttgtgtgttgagaggtgattcttgaatgtaaggtgctgctgctatttataggcagnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26544 - DNA, 2841 bp, Oryza sativa
cctcgtgttgatggcccttttaaaattgttgagaagattaatgataatgcatataaacttgagttgcctcctgagtttggggttagtcccacgtttaacatttcagatttgaagccatacttgggagaaaaggatgagcttgagtcaaggacgacttcaattcaagagggggaggatgatgcggacatcactacctcggatacacacagcaatccttcaacggtcattcaaggaccgataacaagagctcgtgcgcgacaattgaatttagaggtgagctcgttcctatgttcttctttgtatgaattcgagaatagattgctacctaatgattatattgtgattaggaacaatggaggggacaaggagacacttggagaaggacttagagccatggaggatcatcggggaagtccaagtcaaggtggaggcccaaaccaagtcgacgtcccgtgcaattcggagtccaggaccagtctgcactaaaacgggcacccaggtcgcatacgtactcggattggggctttctttatatggatggaaagctaagaagataacctttccaatggttttggtcccacgtctaaattctttccgggtcaatgggaattgaccgaacaagttgatatccagaatctgtcccggttctgcgtcaccgtatttgggcctttggcccgtgtatcgtgttggaacccattagggttgcgtcgagaggggtttgcatgaccctaaactctatatatcagtacccgccgccatctttaggtttttgggttttgcttagattaatctgtcgataacagtttcgccgctagatcggttagtaagaccccaactcgtgagcttaatcattcatctgcaattttggttgtttttctatctcattcttgtttgtgttctttgattggcaaacagggaatagccttctcagcgaggtcatccgcgtttcgacacgggtgataaccagaggagacgtggtgctgcgattgcggggctcaagagcgtgcgcgttcaagaagccggatcgatttgtgtcgcgactccgtccaaatcattgtttatcagaacctttcggaagatcgggaaccctagtgcacatcacctacacaacatgtttcctttcgagaggtacatgggcgttctgaagaagtatgtttgtaaccgtgctcgtccagaggcaagcattagcatggggtatggaatagaggaggtcattgaattctgcgtagaatttatcgaagacctttgcccaatcagggtgcctgaatcacgccatggagactacggggaaaggggactctcagaaggaacgcagcaattacggtagacaataatttattccgtaaagcccatttcacggttctgcaacaatcttcattggtggctccctacatcaaggagcacttggctctagttcgcgccagaaacatcggtaaatccgatgcatggattacacggcatcacattgatactttctccgcgtggctgcgacaacatctcatgggtaacgagacgattaaccaacaactggccttcctggcgaggggaccatctggctcgatcgcaacattctagggatatgaaatcaatgggtacacattctacacgagagcccaagacatgaagagcacgaaccagaacggtgctgttcgtatcgatgccatgggacacgatggtacaactggcacctattacggtgccatcgaggacatatgggaacttgactatggacctctcaaggtacctctgttccggtgccaatgggttaggttgactggtggaggcgtaacgattgatgacagtgggatgacaacggttaaccttaacaaggttggatactcggacgaaccgtttgtccctgtcaatgatgtaacggaagttttttgcgtcaacgacatatctagtaaaggaaaaaagggcaaagggcctgacgagccgaagcgccacatggttctcccaagaaaaagaaaaatcatcggagtagaggacatggtttgatgggcaaccccctttcacagtgacgattgaccctagcatctatcacaccctaaaaatccctaaatatataaattgttgtttaattggaattattagaaatgattttaaaagcctagaagaaaagatctaattttaaataataaattccaatataaaagtgggctagataaaattttattaaatacttcacttgattctatagttcctaggtttttctgggatttatttgagccatggaagttattttaataaatggaattgcatttcatgaataatttaaattgaaaaaaggttttaaaagtcttcttttggctgcccaaaaccctctctcaccctctcctcggcctagccggcccaagtcagctcgcagccgcccgctcgcgcgctctctctcccgctgacaggtggggcccacctgtcggggtcgtcgtcttcctcccgccgccaagccgcgccctagccgccgccgccgcccttccaattcggttgcccctttccttctccggccaaatcgattgaggggaaatgatccccgggatcccctctaccttttctcttttggaatcatcggctaaaatcatttggaaatcggtggattcgatctcgaatcgaattcatttctcgcccccgaaccctaactttccatcgccgtcgccggccgccgtgggcctccgtcgccgccctctagcccctatataagaacccccaggacctcctctttccgtcgccaccctcgctttagctcgccgccgcctgtagcgccgcctccgcgagaacttgtgcgccgccgtcgccgccgcttgtccagccgtgcgccgccgccgctccggtcgtcgtcgtcgc

SEQ ID NO: 26545 - DNA, 11236 bp, Oryza sativa
gtccatctttagatgtcagacctgttctccgatcgcaagcgccgctccgagcttcagagtcgccgcccttagctttatcgtctttcttagtttgttgtttgctagtttctgtgtttaggtctgctgcttgtgggttagtcggcggtcgatatcatgtgtgagtggtatggctgccttaattaggagttgtttgcttccttttcggtgttttaatcaaaattaagataattgtacctaaatttataagaaagattagattctgagccccctgtttttcttccttttctcatatttctacctatcccccttcagatggtgaagacaaggaatggttcccgggaatccaacaacgccagtggcagcgaagagcagatcagtggagcacgtgcaagcgatgcatctagcagcagttcatctccaccgcccgagaacccaacgattgctcaggtgttggacaatcagactcagatgatgacaatgatgatgcaacagatgcagcgacagcaccatcaggtgttgtagcaggtgcatcagcaagcacagcagcagcagcagaacctgcagtttggtcctccacctccacagtccaaactgttagaatttctctgagtcaagccgcccattttctcaagtaccaccaacccaatcgaggccaacgactggctccatgcgattgagaagaagctgaatcttttgcaatgcaacgaccgggagaaggtcgcttttgctacacaccagctgcaaggtcccgcttctgtttggtgggacaactacatggtgaccagtccagctgggacaaaggttacttggtcagagttttgtcagaatttcaataaagcacatgttccagagggaatcgtggcacaaaagaagagagagttccgttctctgcaacaaggaaccagaacagttatagagtatctgcatgagttcaaccgcctcgcgcgctatgctcctgaggacgtgcgcactgatgctgagaagcaggagaagtttttgtttggtcttgatgatgaattgaccaaccagctgatctccagagactatgaggactttgagaagcttgtggacaaggctatccatcaggaggagcagtgtaacaaaatgaaccgtaaaagaaaggtcagttcaagacttcccaggggaaaagtcagaagcctcgcttcacgatgggatgtcagggtgcaccttccaccatgattatctggcaacatcgtccgtaccacccgggtaatttcaacggcatcaacaacagtggcaggcacagtaacagtaagcagcacagcctcaaccttactctaagtcgactaatgattccagatcagtcagttcagtcagctctgccagctcagccagaacagccccagaggtttggaggaaagcccaaactctgcttcaattgtaacaaacccggacacacggttggaaagtgtcaatcatgcgtatgcagaggaggcgcagtcagcaccagaggttatattgggcacatttcctatcaactcgacaccggcagtaatattgtttgactctggtgcaactcattccttcatttccaagcgttttgctggtgcacatgggttatctttagtgaagcttaagatacctatgcgagttcatactcctggaggtggcatgaccacaactcactattgcccgtcagtgacagttgaaatccaagggttgatttttccagccaacctcatttttcttgaatccaaggatctagatgttattctgggaatggattggctgacaaggcacagaggagtgattgattgcgctagccgcaccatcaagttgaccaatgcgaaaggagaagtggtaaccttcccgtctccagtaccgcagaagccagggatcagtctgaaccaggctactagtgaagaacaagaggtagtagtggataaaaccactaagaagttggaggatattcccatagtcagagaatatccagaggtttttccggacgatctgacaacaatgccaccaaaacggaatatcgagttccggattgacttggtacctagaactgcaccgatccacaagaggccttacagaatgggagccaacgagttggcggaagtcaagaagcaagttgatgaacagttacagaagggatacatccgcccgagcacgtcgccatggggtgctccagttatttttgtggaaaagaaagataaaacgaaaaggatgtgcgtcgactaccgcgcactcaatgaggtcactattaagaacaagtatccgttgccaagaattgatgatctgtttgatcagttgaaaggagctactgttttctctaagatagacctgcgatcaggctatcaccagttgagtatccgtgaagaggatattccaaagacaacattcatcactcggtatgggttgttcgaatgcacagttatgtctttcggactcactaatgcacctgccttcttcatgaatttgatgaacaaggtgtttatggaatttctagacaagtttgtagtggttttgatcgatgacatacttatctactccaagtccgaggaagaacatgagcagcatcttcagttggtacttgaaaagttaagagagcaccagctatatgccaagttcggcaattgtgacctctggcttaaggaagttcagtttctcggtcacatcgtgaatgctcaaggagtagctatggatccaacaaatgtggagttagtcaccaaatggaccccaccaaggacagtcactcaggttcggagtttcttaggactcgcgggctattaccgccggttcattgagaacttctctaaaattgccaagccaatgacacagctcttgaagaaggaagaaaagtttatctggtctgctgaatgcaacaggagtttcaaagaactcaaacgacggttggtgtccacaccagttttaattctgcctgatcagacaaaagatttccaggtttattgtgatgcatctcgccaggggctaggatgtgtgttgatgcaagatggcaaagtggtttcttatgcttcacagcagttgcgtcctcatgaaggcaactaccctagccacgatctggaattggccgcagtcgttcacgccctaaaaatcctaaatatataaattgttgtttaattggaattattagaatttattttaaaagcctacaagttaaactctaataatctaggaaaattttcaacataaaaatggtctagataaaattttattaaatactttgcttgttcctctattttctagatttttctgggaattgtttgagcaaaggaagtttttttttaataattggaacaacatttaacaaattattttaattaaaaagttccaaaacccctccctaaagttgttgggccgtttccggcccaactcttctcttcccgcgcgtggccaagccggcccaagtcggcccagccgagccgccccgccccctcctcctctagccaccgacatgtggggcccacatgtcggggtcatccctaacctccagccggccggccgcctagccgagcccgagctgccgcctctctccaccaatttcgcctcttccggtcgccctcgagtccgattaattgaggggtttttatccccacatcttcctctatctttaccctcaaaaatcggagcaaatcgttgggtattttatccgaatcgaactcgttttcgagtttatctctaaaaccgagtttttgatttcccgagtcgatttcttgcgggaggagtccgatctcttcaatccaaggctataaataggaccccctagttcccctctttcgtttgccccttttcccaagccttcccgtgctccgtagctccgtcgccaccgccgcctagcaagccgccgccgccggccatctccggtgccgccgcgccgccgtctccatcgtcgtcgccggtcgccgtcaccaccgttgggtgcgccgtggtgaggggaagctcggccacccttccttttccgtcgccggtcaccggagctccgccgccccgtgcaagccgagccaccgccgccgccccttagtcgccggccctcgtcgttcgtcgtttggctcgagggtgagtaccgttgggttcgtttcgtcgttctccacgtgtacgtgtcctccaaagttccggccgaccgccctatctccggcgaggtcgccaacccgggccggccattgatgatgtcatcatgacgtcatcatcggttttccctttttccagttttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttaattttttgtttaattgctttagtttccgacgttccggaggagagcgtttccgttgaggaaggttccgaagcgtttgcggaagcccaaggcaagtcacacagatcccaaacaaccctttgagcatgttgaacccatttaaagctattattttctttcaactatgcattgttttcgaatgtcatcgggtggtgaacctttcccaatggttagcggccgaagatgatcttattttcctatgggttataatttgattagcatgaaccttatatgttggattggttcagctaaatgctttatgtaggtttgcttagccatgcttagaaacattagctaactaaagggattaattataaactatgttactttattattttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagctagcgtgggcaacggctttatcttttgtatagcatgattcaatatagtgcgccagactgtgaagtggcgagaagtccacgggggtcgctgggtagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtttaatctattcgaatagccgtacccgcggttatgggtgagttgagcaatgtttttcgtgattagtctcacctttctcaccatagtaaatgatgctttaattggtaataatttgattagctcctggtttggaatggtatattcctggtttggagatagaactgtgcacccgggatggttgttctgaatggttgggcctatacaacagggtatgttgtatagcgttggattaatattgtttattacttaactgttttattaaattctcaaatgtttgctaaatgctgtttttgcaaatgaaactatattatgccatcctttgttatcctgtgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttagtttttttccgctgcgtagaaggttatttttttgagaggaactatctacctctgtagcaatttattatttgcgaatattaaatagttaattatttgtactctattatcaattttgttattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttataaattaattaagttggcagcacatgcaaggttatgcacaaaattaaattaattcattttcttttcttttaaaagaaaaaaaaattgttcttctcaaaatgtttcctattccgccttagtaaacttcattgattagtcggcactgtacatctattatggtatcgatacaatcatgatagcactagtactactcatccttcttatggtgacactgtaccgtgcatataatagatcataagtattttagttttattttagttatttgtcaaaaaaaaattatttgtctctgtccaaaaagttaaattctaaaaatatatgtataatagcttaagtatgtgtcttttcttttatttttcttcctctttggtcaaatcagttaagtctagatggtgcagctaacttaaaaaaaaatgcattaattcctctcttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagaccttccgtccattaagttcgaaactagaggaagatcgtacaaccatgcttgtcaagaagcagctttggtggccattggagagttgcgtcaacgctttgaagaagagttggattcatcagctttccagtatcatcctcacaagcctcgtggtcaagactatggaacctatacctgtcctgatggtgaagagagtgccactctgatgcatgcggtgcatatgcttagtgctatggatgcagtaagtgtggagcgagacaaagcagctcatgacagggaaaattggaatcgaggcaagatttgcaagttggagagcaaggtgtaccatctacagaaggaattagctgaacttaaaggagaaacgccgctgccaacacccaagcttctcctcaccgcaagaaagagaacctgtccgccacctcgtctccagttagcttcaaagattcgcgtgatgggtgaagttgtgcccgatcgtgctgaacttgtcatcgacatcgtaagtgatgaggaggaagaggaagaccctgaagaaagagagccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagctcttttgcttgtcagagtgtaagatagttggtgagatagtgttaatgcaatttaaatgtaatcatacacagttaagagcaatatagaatttaaattaattaaataactccgttctaagggtgtctctttgtcgttctttcctgttgtctctgcttatcgtcagatggtgaacacgcgaactggaagtggaagtggaagtggaagtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctacctttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagggctgaaggagagcctattacttggcaggaattcacggccgctttcaagaagacacacataccaacgggtgttgtagctctaaagaagagagaattcagagcactcaaccagggatctcgttcggtcaccgagtacctccatgatttcaaccgtttagctcgttatgctccggaagatgttcgcaccgatgaagagcgttaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttacggaacctcaagctccatcgtaccctcaaggaggatcttcatcagttgtccgcccccaacgccagttctacaacaacaatactggtaatcgtggcaatgacaaccgcaacatggttgctcgtcctgcagcaactccagctcagaaccagcccgtcaggaaggaacagggaagcaagccaggggtgtgcttcaattgtggtgatccaggacattatgctgataagtgtcctaagcctcggcgcgtgaagaacgctccagccccgaacaactccaatgctccagcaccgaaggcacgtgttaatcatgttgcagcagcagaagctcagaatgcaccagatgtggttttgggtacgtttcctgttaactctatacccgcatctgtgctttttgattccggtgctacacattcctttttgtctaaaagttttgcgagcaatcatgagatggaagttattagtcttgggagacctttactagttaataccccaggcaatcaagtatcttcgacacagtattgtccttccgctactatagaaatagaagaagttcctttcccatcctcacttatcttgctagaatccaaagatctagatgttatcttagggatggattggttatctcgtcacagaggagttatagattgtgccaaccgaaaggtgaccttaacctgtagcgatggggaaaccgtttctttctttgtgtcctctcctaaatctcatggtgtgaccttaaaccaagtcgctctacaagaaatcccagtagtacaagactactcagatgtgtttcccgaggatttgccaggtatgccacctaagagagacatagagttccggatagacttggtccctggaaccaaccctatccataagagaccttacagaatggcagctaatgagttagctgagataaagaggcaggtggatgatttgcttcagaaaggatatatcaggcccagtacttcgccgtggggagcaccagtcatctttgtggagaagaaagatcatactcagagagtgtgtgtggattatcgagcgttgaatgaggttactatcaagaataagtaccctctacccagaattgatgacttgtttgatcaactggaaggtgctacagttttctccaagatagatctccgttccggataccatcaacttcgaatccgtgaggaagatatatcaaagaccgcctttacaacccggtatggtttgttcgaatgtaccgttatgtcatttggactcactaatgcccggcctttttcatgaatctgatgaacaaggtgtttatggaatatctggataagtttgtcgtggtgtttattgatgacattcttatttactccaagacaaaagaagaacatgaagagcatcttcgtctagctttagagaaactacgtgagcatcagctctatgccaagttcagtaaatgtgaattttggttgtctgaagtgaagtttcttggtcatgtcatctcatccggaggagtggcagtagatccaagcaatgtggagtcagtgttaaattggaagcaacccaagacggtttcagaaattcgtagtttccttggacttgcggggtactaccgcaggtttattgagaacttctcaaagatcgccagaccaatgactcgtctgcttcagaaggatgtgaagtataagtggacagaagattgcgagcaaagtttccaagaactgaagaaaaggctagtgactgcgcctgtgttaattctgcctgattcaaggaaaggttttcatgtgtattgtgatgcatcccgactcggtttgggttgtgttttgatgcaagaaggaatggtggttgcctatgcatctaagcaattacgtcctcatgagaataactacccgacgcatgacctagagttggcagctgtagtgcatgcattgaagatttggcgtcattatcttttcggtaaccgtacagagatgtatacggatcataaaagtttgaagtacattttcactcaacctgatttgaacatgcgtcagtgaagatggttagagttgattaaagattatgatatggaaatccattatcacccgggtaaagcaaatgttgtagccgatgccctcagcaggaaaagctattgtaatatgtcagaaggtcgacatctaccttgggagttatgccaagaatttgaaaagctgaatttggggatagtcagcaaaggttttgtggctgctttagaagctcaacctaccttgtttgatcaagttagagaagctcaagggaatgatcctgacatccaagaaatcaaaaagaacatgagaagaggaaaagccatcggttatgtagaagatgagcaaggaactgtgtggttaggagaaagaatttgcgtacctgataacaaggagttgaaggataccatcgtgaaagaagctcatgaaactttgtattccattcaccctagaagcactaagatgtaccaagacctaaagcaacaattctggtgggctagtatgcgacgtgagatagcagaatatgtggctctatgtgatgtatgtcagcgagtcaaggctgaacatcagaagccagccggtctgttgcaaccattgaagattccagagtggaagtgggaagaaataggtatggattttataaccggtctacccagaacgtcggcaggacatgattctatttgggtagtggttgacagattgactaaagtcgctcatttcatacctgtcaaactgtcaaaacaacctacacggggaataaacttgcagagctatacatggccagagtggtatgtttgcatggagttcccaagaagatagtgtcagatagaggtagtcagtttacctcgaagttttggcagaagctacaagtagagatgggtacccgtttgaatttcagtaccgcttatcaccctcaaacagacggtcagacagaaagagtaaaccaaattttagaagacatgttgagaccatgtgttctagattttggtagaagttgggataagaatttgccg

SEQ ID NO: 26546 - DNA, 673 bp, Oryza sativa
aggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaaccccgttaaatatgccgatcgctat

SEQ ID NO: 26547 - DNA, 607 bp, Oryza sativa
atagggcgaattcgagctcggtaccccgactccgtccaaatcgatgtttatcataaccttttgaaagatcgggaaccctagtgcacatcacaccctaattcgatgatgaagctggtgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcacccatcaattcctcggcaaccaagaatgttgcaccatcaatgtcaacgccgaattccgcaacttctctcaaggcgagctctccgtcaccgactactgtcgttgcctcaagtccatggctgacacgcttagcgacctcagcaaacccgtctccgatggtgcactcattctccacctaatcaccgggcttaatccccgttttggcaacatgcattcacttttgtccatgtaaaaaccattcccatcgt

SEQ ID NO: 26548 - DNA, 998 bp, Oryza sativa
  unsure (1)..(998): unsure at all n locations
nnnnnnnnnnnnnnnnnnnnnnnnnnnnnnnnnnnnnnnnnnnnnnnnnnnnnnnnnnnnnnnnnnatgatgaaattgacggaactgctcgatagggcaacggaaagagattttagatgctaataaagcgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgctttt

SEQ ID NO: 26549 - DNA, 543 bp, Oryza sativa
  unsure (1)..(543): unsure at all n locations
nnnnnnnnnnnnnnnnnnnnnnnnnnnnnnnnnnagtactcggacgtatgtaccccttttctttcaattcttccaactgtgtctttacttcggctagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttggaggtgcaaagaaaacaaccggctgttctggccctcggtacagagtgacagtgcgcctcgcgcaatccactaccccttggaattgggccaaccaattcatcccaagaatcacgtccaagttcttggtgtctagcagaatcagatccgagggaaaaggaatcccctgaatttctatagggacggcagggctatagtactttnnnnnnnnnnnnnnnnnnnnnnnnnnnnnnnnnnnnnnnnnnnnnnnnnnnnnnn

SEQ ID NO: 26550 - DNA, 887 bp, Oryza sativa
cggcaccgatacgtcaagcgatgacgacagcaatgacgtcagcaccggcggcggctcgggagcgcaagctcgccggcgaacgacggcgctttggcacaaacggagggcaccaacgggtagagcgcgatgcggtgaactcaccggtgaccaaagaagcggcggaggaacaacggacagcgccgtcgacgaggaagaagcggcggcggagatcgggttgacggcggcgacggagctctggcggtcttcggcggcggcgaaggggcggacgaggatggcggcgacttggcgaccacgacgatggccttcccgagtgacgacgacgaccgtagcgacgacggcgcacgactggagcggcggcgacgacggcggcgcgaaagctcacggggctagggcgctacacatgacggcgggcgaaggcaagggaggcgacgggtagaggagagctcgggggtccttatataggtgcaaggaggcggcggcgaaggcccacggcggccggcgacgagaaggaaagattggggaaaaacgaatccgaatcaaactcgaatccgcctatttccaaaggaaattgaccggagtttctataagagaaaaggaagaggagatcgagaagatcatttcccctctatcaattcggccggagatggaaaggagcgacggaattggaaagcgacggcggcgcggctcggctagggtttcgggcggcggcggccggaggaagaagacaagactgacaggtggggcccacctgtcagcgacagcgagagagagaggagagcggcggcgacctgggccggactgggccgagggaagagagagagaaggagagaggttttgggccggctttctgcccaaagccaaaacagacttttaaaaacctttttcaa

SEQ ID NO: 26551 - DNA, 589 bp, Oryza sativa
tcgagctcggtaccctggaccaaatgatgtactttcagtaaacaacatgcagatgaaaaggaggaaaaggcttatactatgagagtctttgaatctgattttgaggcaaaagctgcccctgaatttgggaacaccctgccaaaatcaagtaataataatagcatgctaaatagtgaacagagctctgatccacctgctggaaacaatggtcctgttttgcaatgtactgctgaaaacttgatgcacgtgactgatgctgcaaatgctgatcaattaaagtctgagaacagctccccgctagtccctcagtcaacagagagtgaaattggagatgaaggtaccatttagaaactttgtttttttaatttacaacatatgcctctgttattactttctgaatatgtattgagccctgagcatggttaatatgatgcaggtaactcgcgagtggatcacaaagagtgtagaacaccacataataatgcaatagtcttggaagaagtgaatgtggataaaagctgcattattttagcttcagatggagctgattcttcgatagtcagcttcctggacaaagaagaaaatgcaa

SEQ ID NO: 26552 - DNA, 1423 bp, Oryza sativa
caaatattataacttacaaaggttgaaaatagttaggaacaggaaaaattgaaatatatagcaaccacatgcttcagacctatttagcaaaacaatatgctctagcatattccactttgaatgtcctgcttcacttgggctgcagagaagtgaaaaaagtatattaaaaactattaaaaggtggtttgaccataattaaacaaatcaaaaggctaaggcatggatcaacattaatccgttcatttgagtttagcttcagtggtgttttccaaagcttatagttaccatatcagcctacattaaacataatcatataacaagtcccacccctactatgtttaaatttcaagtagggaacaatgcaatgttcgacagtgccactaaattaagtgaagtgataccttcaaataaattagttcccgactgcaacaaacaaactcagcctaagtgtgttctcaagccaacacaaagcaccaaccataatataaaattctaagaataataaatacaatagttaaatccataaaagaaaagaaacatcaagcttgattaatagcaaccacggacacactacccagaaactgtatcaaaacaaagaaaaatacagcttcatacatactacagtaatacaatatcataagttttttgcaactaattaaaacatcaagatataaaatcactctgaccttgacaagagctgcatgcttgtcaaatagttaaagcttctgttgtctaaaaaaatgtttgtcaaacagtataatcacgactaaccactcgcatcattctaatcacccatcactctaatcattcgtggatgaaatttacatttgtggaatttaatttctgaatttaaaattttcttcatacaaaatattttagttccagtctatcaagatatggctacttctaaagatttgattcccatttgctcctataattttcggatatagaataattctagttatatatgattgtcagggttatggataccacatacctaatagtaattgactaaatatcggcaggacccaccacatatcatgtcttatacggaaacaaccttcggatataggaggagttccgcataaggaaggatgaatagagttctacatactatgcaaatatatcctagtaccaacgatccccattctatgcaaataccggaatcgcgacatcaaacatcgacaatgatgaaacctaaacctgactaaataagtagagcatgtttatcctggaaggacccatgtgatatttgtgaaaaaaatattgacttgcatttaattgtagcatcctgcatgcatgtgaagggaatatttcaccatcatccacagttgcagcctacattgaagaatgggaagtgctaaccaaaaaggaaaaaatgtttctcaaacgatgggaaatttttaccggttgcacctcataa

SEQ ID NO: 26553 - DNA, 1432 bp, Oryza sativa
  unsure (1)..(1432): unsure at all n locations
nnnnnnnnnnnnnnnnnnnnnnnnnnnnnnnnnnnnnnnnnnnnnnnnnnnnnnnnnnnnnnatatatatcggtttcttataaaagattttccagtttttattaagaaccagtatatatagatatttatagggtcggtttttgagtttataaatacatttatatttgtatttttaatataaatatagatgtcggattttaaaaaatcatgatctactactcctagaaaaacaaaactcaatggactttttatttttgaaccattttaatgcacgaggagttttttatgtctcagcaagaagagaaacaaatctaccatctgaatagccgatacatataacaacataacaaacgatatgcataatctgcacaccattttgtacacctatcgaaaaagcattcatcgataacccataaaatgtttgaggcgattttcaatctcatcgactaggtgtgaacggagaaaacatgtgcaatcagaatctataaaatgcaatggatgcatggttctaagtgggttgatggtctggttaatgataggaaatgttaaataatatagctagggcacttggccctgtttttcctagactaatataatttgtgagcacacttttaaacaccttgatcggatacgatccatttgaatggttgtactctagctttacaattaaatcagaccaaccattagagaaccctcttaagcatagcatatactcctataaataggatatttatatatgttgatcagtatgttatataggagtatgaatagaatatggaaattctaatttatattaatgaaacagaggcatccgtttaggattaatgaatcagatttcatatgtgggctaaaaacgttttttcaattcctaactaatttcagttgttttttcatttacattattagttttagcactattttatccactaaaatttttttattgtaacttataattttctctatattagattatttatagctaaatttaaaaatgggattaaattacataactttattatcgttccggacaaagttatttatttgtagttgaaaaagtacgagttaccccctgaagtattgggtgagtatgaattacccccctaaacctgaaaaccagtcatttttcaccctcaactatcgatacggatgaaaacccccccagcagttttgtaagcggtttttgtctacgtggcagtccagtcagcaagttttttattaaataaaggatagggcccacctgtcatgacataatattctctctctctctttccctctcacccctctctctcctctctcccgttagatgccagcggttgcggctcgcgcgccggcggcagagcggcggggcgaagcagcggtggcagagcgggcggagtggcggtggccgaagcatgccggcaatagcggggcgggcagagaggaaggaggtgag

SEQ ID NO: 26554 - DNA, 1178 bp, Oryza sativa
gccccggccccaccactccccgccgctctcgcggccccgctcaccgcccgtccgcgcgtcgccgccgccacgacaggagggcacgggcgccgtcatgcccgccggccaccggccgcctctccaccacgtccgctgcgcccccaacccgcccgccgcttgccccggccccaccattccctgcagcgcccgtcgccgcgctcgccgcccgtttgcgtgccgctgccgtcgcgcactgcccgttgacgcacgcctgagagagaggagggggagggggaagactgaagagaggtaatgacaggtgggcccttgtgtgtgtgtgtttttttttgctgattggatttccacgtcgacggtacgtgtatgccacgtaggagcaaaaccgcttagtattgagtcgggggggggtgtaattcagccggtatcaatagtttgaggtgtaatatatccggttttatggttcggggggtaattcgtactgtcagaatagttcagggggtaaaacgtaatttttcctttgtagttcaatattgttgtttatacgtttatactttcttcatcatttatgcccaactatagaatatcctttaggattttaatttatgccaatgaatattatttagcactcgttgcaacgtacggatattatgctactaaacttaaaaaagataaactatatggagaaaaaaaaaagaagaaaatagtgggaaaaaatcgatcgccccatgcgagcgctaattagcgatctcgaaaagaagcgcacgcacacatatgccacgcattgacgcatggcacgggacattgacaactgatgccgtcccggagaccgggcgcgtcgatacagctaatacccgaccgcaacgtggcgcgctgacgctaaaaaaaggttgcgtgaaaacgggaacgcatttgctttcacagtggcgctacgctactgtacgcgcaatcccgttcccttcctattgataagataggaaggaatcgtcatcttcattagcgtcctcagtagtactccccaccatcaccgcagcacagcaagaggcgtagttgcgccagccattcccccttccattattcatcctccacctcagtacaactccggaattctccatccaaatctcaaccattccacctcgcgtagtcgcgccgcatctcgcatcggggaggggggagggagggga

SEQ ID NO: 26555 - DNA, 2163 bp, Oryza sativa
gcgtaagcgcgtttcgcctctctcactctccgtgcacccgtcgtcgctgcccttgttttcgctgatctgccccaaagttttcgctaatctcgcttactctgcttttgtctgtttagacggcggcgatgaggagcccgcaggagaggaacacgcggctggagaacatgtcgtggaggatctggaaccttgccagaaagaagaagcaggtatatgcatgttccggtgaatcgacagatgagccacttctcttattatctactccctcttcccaaaaaaacaaaccctggttgtcctgggtttcccttctcttatatgaattttttttataattagtatttttattgttgttaaatgataaaacatgattaatactttatacgtgacttgtctttttaatttttttcataattttttcaaataagacggacggtcaaacgttggacatggaaactcagggtttgtctttttttgggacggagggagtaaatattttgcccagcatactgcgcctttaataaacatttctacgacagttacattgtatagtgacgctggtttgactggggggagtgtcaactctctgcaccctggccttggcatggagattgtgttaactgccgttggtaaaatactgctagttgtggccttatgggttgttaccatgttagcctttgttgcatgcagggaatacttcatgctacttgtgctgcatttgacttgactcttctggtggtgttgtagattaccatgatagtatcgtgggtatccacattttgtctcaagtgcctgctagctgtgtgttatttttttttttgctgattctagtatttgctagaaaatctgtcttttggtgtatctggaggaatttctctcgtgccagagaacacgtacatatccctgcttgaggaggtacactgtacaagtgtgtatgtacaagagtggaactccattgtgtatcttggcgttcaggttgaacgaagttgctttagctgcattgattgtttatatattatatacatcaaataaaaacagattagttgtgaatgaaactatatgcatgttcttgcctttctctaatttatacagtgcagttttcatccaaatagatggtttcatgtcactgcttaaactagggtactacctgctgatgagtaggattacagttgtcatgtagttaactaatgtttttctttctaggttttctaatgcaattcatgatgcttaaacccatcacgtgcgacaatgttatgttatgagaatgctttagtgaacagcttgaactggtaatttttgcagaataatattatcaacaaagttttgaaaaaatattaaattaattattgtgcctagttttgacacctacaatactttgatggttgaaattcaccagcacacatgcaaatgcaaaattcctttggaaaggatggactatttgttactgacattgttctaaaaattgtgcatctagatcactctatcagatctgttactgataaaattgctatttccaaccgtctccattattccacactgaactgactagacctgtgtctgaaaccatatttcatcaaatttccggacaaatctaaagtgacttgacctaatggtgtacttgagttttgagcaaagaagataatttcaaaaacgttattattgttctttattctccagctgtaaatgttaagtgtttctgttacattaaaacttgataaaattccagcattttgtttcattaccgagttttaatttgcttaatacagattgaaggtgaagaagcctcccgtttagctaaacaacgtcttgagcgtgagaaggctcgtagatatgctgctgccgatatgtctgaagacctatctgagggtgaaaagggagaaaacattaatgaatcatcatctactcatgacgagagcacaagggggagaatgcctaggataggttcaacagatgctattgaggcatgggcaagtcagcacaaggataaaaagctatacattgttctgataaggtatggtgctaattgttctgctcttgagatgatattgatcttggtctatttgttctcttttatattcaagggcgtatcgtgctttggtgcatggaatagatatagaatctgtccatcagtcaattggttagtgtttgtatattttgttatatgtgacc

SEQ ID NO: 26556 - DNA, 606 bp, Oryza sativa
  unsure (1)..(606): unsure at all n locations
nnnnnnnnnnnnnnnnnnnnnnnnnnnnnnnnnnnnnnnnnnnnnnnnnnnnnnnnnnnnnnnnnnnnttcaagtctctaaatttttctaaaattgagatctacacattaaaaatatccacatgtactgttcatgcttgtttatgtgctgtttttgtgattttgctcttttctgcttagattccgtcgtttccggagagtccgttttcgccggagaagagtttgaagagttccaaggccagcaaggcaagtcacacagatcccaaacaaccatttgagcatgttgatcctatttaaagctattgtttcttttcaactattgcatttattttcgaatgtcattgggtggaattaacctattgattgttatagcccttttgttcttgattactttattccttgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26557 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnatttttagttgaagtttttggtaggggttagttgcgaaataatgtcacgcccggaatttctatccaaaattctaaacgcttacatgtgtgtgaaccctcgtccaggaatcagccgaggcacacaataacaaattgataatagagtacaattattattctaattaataagcgaataaaatgtcattacagaggtagatagttcctctcaaacaataaagatctaagcagcggaaaataagataaacggcgcagacggctccactccacaggcagcttgaccaaggctactcctaatcctccactccatcagcctcattggagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccggctgcacagttctatcttcaaaccaggaatgtaccattccataccaggagctatcaaattatttccaattatagcatcatttactatggtgagaagtgtgaaactaatcacgaaag

SEQ ID NO: 26558 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnnnnnnnnnnnnnaggagaagagagcattcatcatgtcgtttggtgtattctgctacattaagatgccgtttggactaataacgcaggaaatactttccaacgcacggtccaaggggcacataacgattagctcgggaacaatgtcgaggcctacgtcgacgacattgttgtcaagaccaagacaagcgactcattaatcgatgatcttcgggaaacgttcgacaacctccgaagataacgccttatgctcaatccaaagaagtgcacgttcggagtaccatcgggcaagctactcggattcctcatctttggaagagggatcgaagcaaaccccgagaagatcaaggcaatcgagaacatgaagtcgcccacaagactcaaggaagtccagaagctaactggatgcatgacggcattgagcagattcgtcgctaggatgggagaacgaggacaaccctttttgctctgctgaagaaacaagacaaatttgtgtggacacaggaagccgaagatgcattcatcgcactcaaatgctacctgtcaaatccccctgtacttgttgccccccaacctaatgaagaattattccattatattgccgccacaccatattctgtgagcgtcattattgtcgagagagaaaaggtgcaaagactagtttattacgtcagcgaagctcttcacgacgcanagacaaga

SEQ ID NO: 26559 - DNA, 1130 bp, Oryza sativa
tcccctggttgagctggttctgcatttgctgtatcatcatgttcattaactgagtctgttgagccagaacttgagcaagagttgggttcccttcattattattgtttccacttccactggcgcgagtgttcaccatctattgcagattagagaagataggaggagaggggttacactaaagttaagaccttaaccatgttaccactgatctggtgtgtgtagttcattatattgttcaagttgattaagcaagcaacctagtatagttacatactcatcattgaactactccaatgatgggaaagcaaccatacctacacacaagcaaacaacaaacgttctaccctactaactattcttcaaagatactttggcggcataggttctaaggtaggatccaaacttcattccatcttgaccacttggcacttcagatcgaccatcaccttcttattcatcgatccacttgacttaacctccacaagtagaccacattggcgtcttcaagtttcaacaactactttcagaactactcaagttgaaagagagaggagagtagacaatgaaacaatttgcaaagaattctagataaggaagaaaggaggaattttcacaaattatgttttcggaaaattagtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcgaaagcagcatttagcacagagttaagagtagtaaaacaggggtaccgag

SEQ ID NO: 26560 - DNA, 1444 bp, Oryza sativa
  unsure (1)..(1444): unsure at all n locations
atatctagctgaaccaatatataaagctcaactagtcaaattataataacccaaggtatcaaggattaaagtaatcaatgcaaacaggccataacaaaggaatagattcacaccacccagtgacattcgaaaataaatgcacagttgaaataaatagaaaatataaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacaaagaaaaagactaataaaaaccaaataaacaatatataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatatagatctttattttatacaacttttgcaacttgaaccacattaaactgagttaagatgaattagttatgaatttttaaagattaaatcggattaaaacacttatatagattttaattaaattatgacgcaataatgaattatttttgaaaaggaaaagaggattattgcgtcagcgggctcgggttcacggtggaccgggcgcacgggcgacggttcacgggaacggacggccgagatcgatcctatccaaaacggacggccgagatcgaacggtccacgaccggctcacggggagcggcaacgatgacgtcagcgatgacgacagcgatgacgtcagcaccggcggcggctcgggagcgcaagctcgccggcgaacgacggcgctttggcacaaacggagggcaccaacgggtagagcgcgatgcggtgaactcaccggtgaccaaagaagcggcggaggaacaacggacagcgccggcgacgaggaagaagcggcggcggagatcgggttgacggcggcgacggagctctggcggtcttcggcggcggcgaaggggcggacgaggacggcggcgacttggcgaccacgacgatggccttcccgagtgacgacgacgaccgtagcgacgacggcgcacgactggagcggcggcgacgacggcggcgcgaaagctcacggggctagggcgctacacatgacggcgggcgaaggcaagggaggcgacgggtagaggagagctcgggggtccttatataggtgcaaggaggcggcggcgaaggcccacggcggccggcgacgagaaggaaagattggggaaaaacgaatccgaatcacactcccatccgcctatttccannnnnnnnnnnnnnnnnnnnnnnnnnnnnnnnnnnnnnnnnnnnnnnnnnnnnnnnnnnnnnnnnnn

SEQ ID NO: 26561 - DNA, 1283 bp, Oryza sativa
attactgaactgttctttgtatcatttaagaattgagctccgaaaaatccgagaaaatttcagagagttgacttaatcatggagaatttaataaaaattaaatccatccatgctttagatttaagaaattttatttcccacatttaacttcacttgtaaattaaagaacatttaatataaattctattaataatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataattattctaaggctttaatgaaaactgctgccgctttgaaactggtggctgagctgcaacacttgaagacgcaactcttgaagacgcaactggcactgcattggctcctgtgacgacaatgttgttgacttgaccttgcggctgctgatgcttcggcttcggacactctcttgcaaagtggcctggcttgtaacagttgaaacatacctgctgctcccttccactactgttattctcctgagactgatcctgctgaactggcaccggctgattagcttgctcgatgttaactttattgctttcattagtctctgatttgatctcaccaccgatgttcaactgttgcgactgtccttgaccagcggaagaaggttcaccaatttggagtggcttgatacactgcctctggctactaccttgtgcctcctggaatacagtcattctccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtatgatccttttgcttcaatgccctgaactcacgcttcttcaaagcaacaactcctacaggtatgtgtgtcttcttgaatccttcggtaaactcttcccatgtgattggttgtccttctgctctgttcatccggaaatgatcccaccattctgatgcaggtccttgcaactgatgtgaagcgaacacgactttctcctgatccgtgcactggagcaattccaacttcttctcaatagtgtgcacccaatcacctgcttccactggggggtaccgagctcgaat

SEQ ID NO: 26562 - DNA, 590 bp, Oryza sativa
  unsure (1)..(590): unsure at all n locations
nnnnnnnnnnnnnnnnnnnnnnnnnnnnnnnnnnnnnnnnncaaaccctaaccctttatactataaccctcttgtactcccttgcatttattctacacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgccgtttcccgtttgtctttgtgtgtgctgggccttcgccgcccatgtaataaattaactatttacgcttccgcttgataaactctggaatgtatcaacttttggtgtaccttgcctcctgggacaaggaataatacacgcacgtaaggaacgcccgttgggttaattccggtcgtgacagctgtcaaaaatccccatcgtcagtgagttcggagatgtgtttccggaagaactacccggtgtgccgcccaaccgagagattgagttccggatagatctttctctaggaaccactcctctgtacaagcgactctaccatatggcagcaaatgaactggccgaag

SEQ ID NO: 26563 - DNA, 2277 bp, Oryza sativa
tccttgtcccaggaggcaaggtacaccaaaagttgatacatttcagagtttatcaagcggaagagtaaatagttactttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgagaaaaaattgagcaagactgagtacaaccaccgtactcaacaagacacacccacaagtgcaacataaatggagggagtacaaaggggttaaagtataggggttaggttttgcagtatacagcattaaagacatttagttgctcaaagctattttgtaaatacaatactcgagctatgcaacattattaatcaaggccgtgaacccacacgaacctgccttaacccaaggcctacgatgattcagaccgaactggcaacccgaccctggggtcccagctcgtcccaagccaacctaggccaaccattccacattttagttgttaagcaggctttaagaattaaaacactaacttgggtacattgctaggcttgcccataaccgagggcgcggctattcgaatagattatactctgatcagaggtatacatctttacccacaagacacatcttcctcacgtgtaaccacgtgccacataccaccacggtatatggacggaagacgtgacatagtttccaacccatcctagccatagacaagagtaccgactcaaccccacctacggccggaacctccaggacaggtaggcaggactgagcccctagcagcaggacaccagccctgtgccatgacatctcgactaccgggccgcagctcgtgtagccttcatttgccgtagagatgtccatcgacccccgacttcatccatctccatccgtgtacttttgtttataaccagactaagccacaaactaagccttacccactagacatgtggaagtacggtagtgctttgcaacagaggcccgaagaccggtccttatacggccgaggtgctactatcaaaaccatgcaccccgagcccagcctaaaaccattttgaggattttgaatagagggggaggtgtgaatccaattccacaataatccatccattccatagtgtccaggtgatgagaataacccaaagtctagagttgtaaaaccacctaatgttacctaattaaacagcgaagcatctacctaaaatcatactagtggtaccatgtgtagagtgtccactagttggggttttgtttattctagggtgaacaaggaaataataacaataacaatattaaggtcataacaaaggtaaataggcatggctagataaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgtagagcggatcttccgaagctgcagcgtctacacgaccaacggaaaagaaaaaggcttttactctaataaactccatataacaagcaggaacaaagcacaaaaatgggttcttgactcttaaggaaaaattagagacatgaacggtccaattccgagttcaaatggccaagttatggccatttgaagtttatatgctccttaaatgaatatttacgaatttcttcatttaaattttaatttaaaaatggtttattgcgtcagccgaggggagaggatgcgcggaccgggtccacgggagtggggcccacgcagcagcctcacggtccacggtggaccgggcgcatccgggctcacaccggccggttccatgggccccacgcgttagccacacccgagggcgtgggcggctgacggccgggccccacgcggcggccactcgtcgcgcccgaaggcggccacgtcggcgcggccggcgggaggcagcgcgcccgtgcccctatggttgccggtggcggccataggcacggcggagcggcggccgagagaggaggggaaagggggaaacgaggcggcggtccacggctcaccctatgtcgacggcgacgacgaaaaaggcggacggagcggagaaaggcggcggcgcggcttgggtcggtgggtacggtggcgctccggcggtcggcgagctcgactagggggtggacggggactgcgacagtgcggcgaagctggggcgggaaacggtcccggcgagcgg

SEQ ID NO: 26564 - DNA, 7224 bp, Oryza sativa
  unsure (1)..(7224): unsure at all n locations
cccgaccctgggtcccagctcgtcccaagccaacctaggccaaccattccacattttagttgttaagcaggttttcagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccatggtatacggacggaagacgtgacatagtttccaacccatcctagccatagacaagagtaccgacccaatcccacctacggccggaacctccgggacaggcaggcaggactgagcccctagcagcaggacactagccctgtgccatgacatctcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtctaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaatttagagacttgaacggtccaattccgagttcaaattcttaacaagcaggaacactggcctctccacgtaggtcaagtcttcgcgaacttcaatttgctctgagtcggcctgctcggatggcactcgaagacatttcttgagttgcgacacatggaacacatcatgcacgttgcccaaggcggcgggcagctccaactggtaagcgacttctccgcgccgagcaatgatacggaaaggacccacaaaccgaggtgcgagcttcccttttgtctgaaacctgtgtacacctcgcaatggcgtgacccgaagatacacaaagtcatccactgcgaattccaggtcacggcgacggttatctgcataacttttctgccgggactgtgccacctttagattatcccgaatggttctgaccttcgcttcagcttctctcaggatatcagtcccgaatacttggctttccccaacttggtcccacaatagcggtgtccggcatttgcggccatacaacgcttcatagggtgccatttgtatgctggcttggtagctgttattgtaggagaactcggcataggggagactcttatcccaggtcttcgcgaaatctagaacacatgcgcgaagcatatcttcgaggatctggttcagacgctcggtctgcccatctgtctgcgggtgatacgtggtgctgaaatttaatcgggtatccaactcttcttggagcttcttccagaagggagaggtgaattggcttccccgatcagatacaattttttaggaacaccatggagactcacgatcctagcgaagtagagttcagctagtttgttccctccataggtggtcttcacgggaatgaaccgagctaccttggttagtcggtccacgactacccatatagaatcatacccgccttgggtttttggaagtccggtgatgaaatccatcccaatttcatcccatttctattctggtacttgtagaggttggagaagtccggccggtcgttggtgctcagctttgacacgctggcacacatcacaaagggccacgaactctgcaatttcccacttcatactaacccaccagtatttctctttcaagtctaagtacatctttgtactgccagggtggatggaataaggactttcgtaagcttcctaaagtatcagctgtttaggttccttgtcgtccggaacgcatacacgatttccgttccatagggttccatgtacgtcttctgtgaaaccagcggctttaccctgtttcatattcttgaggatcccatacatatctggatcattcttctgagcatcacggatttggtcgagcaaggtaggcgtggcttccagagtagccaagaatccatgactaacgatgcttaggttcagggcttccaacagttgattaagctccggtggaatgccgcggacgccaagagcgttgcaatggctttttcgacttagagcgtcggcgaccacgttggccttaccaggatgatagtggattcccacatcataatccttgatgagctctaaccatcttctctgccgaagattcagatccgactgtgtgaagatgtatttcaaactcttatgatcagtatatatttcgcagcgatttccaatgagatagtgccgccagatctttagagcatgaaccacaatggctaactccaaatcatgggtagggtagttgccttcatggggccgtagctggcgtgaggcataggctaccacatgaccttcctgcattaatacgcaccccaatccttggcgcaaagcgtcacagtacaccaggaagtccttgcgagtatccggtaagattagcactggcgaggataccccagcttttctttgagagtttggaatgctttctcgcattgagggctccacacaaatttttcttccttcttcagcaactgcgtcatgggtctggcaattttggagaaattctcgatgaatcttcggtagtatcctgccaaacccaaaaagctgcgaacctgagtgactgtcttgggttgcttccaatcagtgacggcggtcaccgtttcaggatccacagcaactcctttagcagatatcacgtgccctaagaacttgacttcggacaaccagaactcacacttgctgagcttggcatacaattggtgctcccggagctttctcaacactaaacggagatgctgctgatggtcttcctctgattgtgagtacaccagtatgtcgtcaataaagaccacaacaaacttatccaggtattccatgaacactttgttcattaagttcatgaagaaggcaggagcattggttagaccgaacgacatcaccgtgaattcatacagtccgtatcgcgtggtgaatgcggtcttcgggatatcttcttcatggatgcgcaactggtgatatccggaacgaagatcaatcttggagaatacaatggcacctttaagttgatcgaacagatcatcgatccggggaagagggtacttgtttttgatagtaacttcattgagggctctgtagtcaacgcacatcctctttgtcttgtctttcttctccacaaaaatcacgggagcaccccagggggaagtgctcggccatatataccccttttctttcaactcttccaactatctcttgacttcggccagttcatttactgccatacggtagggtcgcttgtacagaggagtggttcctagagcaagatctatccggaactcaatctctcgcttgggcggcataccgggtagttcttcctgaaacacatctccgagctcactgacgatgggtatttctggcaatcctagctgatgaagtactgaactgccggcggaagttgggggtgcaaagaaaacaaccggttgatcagggccccgatacagagtgacagtgcgccttgcacaatccactactccttggaattgagctaaccaattcatcccgaggatcacatccaagttcttggtgtccagaagaatcaaatccgaggggaaaggaattccctggatttctataggaacggtagggctataatactttgctgtcataacccctccaggggtggtgatgagcagagggttcctaatcctttctacccccagctgatttctccccacgaatggcacatatataaacgagtgggaagctccagagtcgaacaaaatggtagcagggatggaatgaatgaggaacgtaccaacgatgatgtctggagttgtcagcacatcctcggcagtcacgtggttcacacggctccgagtgacatccttaccaccgttgttgaggcggggaggcgcttggccttgctggcacctcggctttgggcatttatccgcaaagtgcccgggctcaaagctgttgaagcacagacgctgttgactttgagcatccctgcggccttgtccaggctgcacggctggtgcaggagggcggggtgcacgggccccttgctgattctgctgctgctgcggctgtgggacgctcaccatgaattgaggtcggggcgcggagcggggttgctgctgctgctgctgctgcgaggaggatccccctggatagagattggtgtagcggatcctttggttagccccctgttggttgcggaaattcgccaagcgatgcttgtgcgactccaattccttgtgcttggcttccaggcggatgctcttgtcccccaggcgctggaaatctggatagtccccggagaccagacgcacagacagctcagggtccatccctgccaggaatttctcctgcttctcctcatcttcacgaacatcctctggggcgtaccgggccaaattattgaactcgtgcaaatactccatcatggagcggttgccttgtttcaactcccaaaattttctcttcttaagggccatgactctggcgggcacatgggtcctccagaaagcggcggtgaagcgggcccaagtgataggctgtccttctggctgcgtagcctggaagtggtcccaccatagagatgcgggcccctgcagttgatgggtggcgaatatgactttctcctcatcattgcacaggacggtgtccaactttttccccacggcatgcaaccagtccaagacatcaacggggttattggagctagagaaggtaggcggccggatgcggaggaactcggtaagcttagaatgttgcgggggtggtggtggagcattgtgttgcggcggattctggatgtggtggaggaaagcagccatcatgttggcctgctgggcgaggatttgggtgaggatggggttggtgtttggtggcggtggtggtggcgggggaggaggtggaggtgggctgccatggttgttgtggttgctgccttcggggtgactgccctcaccggtagcagcgcttctcctggttgtcaccatctgaaaatccctcacagaaccagcaaacagagagagctgactattaaaactaaccacccacgactaccataattcttgaatttatttctattattaaattggttcattaaggttcaagttgcttatgcaaataaaataaagacaggctccgacacagttataccacacaccggtataaccatgccccacacgactccagcagaagaacaaacgaaaagaacccccacgcgggcctactagctgctcgtctacttctgcgacgggccaaaccggaaggtgagcaacagcacatcctccgtgctaccaacgccagaggctccctcctcctgaggaaccgagggcgagattcggcgcgaggggtctccacaaagcaagtccatgccaaggaccgacgaacaagctcaggcctggaggtactcttgcgggcggtgatcttcaggctgcggcagacgcggcggcgcttggggcgacagacctcaccctgggcgatcttgagctaacacagctacgcctccaccgcgtccaagtccttcttcagccgcaaattcccctgacgcagctctaggatcttcatgttgttatcgaccaacccacggcgcaccatatgatggaagtcgatacaggccgcgtcgtacgcctccaccatccgccaggtgcatgatggtagcgtcatcctccgagctagcatccctgaaggtggcgtagtcgcgggctcctcctcgacgagggtggtagcgatagggcgagtgctgcaactcgtccagatagcgctggtgaagagtgctgatggtgaggagcgcggcgttctggcaagcggcgggaaagaatctccacctacggtgactgccaacgaagtcctctcggcagagccggtgaggatcaccgcagtgacctcccaagcggcgcggggctctgcatcgtcaccgtcctgctccggaagcttcttgccctggtagtccactccatgtggatatcccaagacaatgcacatgccccgcagctccaaaacaaagccagtcaagtccagaccacgacggttgaggttgtcggccatctacaaacaaaagcaaaagagaaaagcaacattttaaagatcagcttttgacaataaattaagcagcaggacagagagagactagaggattttcacaaataagaaaggatttttatttcaaaaatattgataaggcttgggatctaaagctcgtcctagggtcaagaaggctctgataccaacttgtcacgaccggaaatcacccaacgggcgttccttgcgtgcgtgtattgttccttgtcccaagaggcaaggtacaccaaaagttgatacaatacagagtttaacaagcggaagcgtaaatagataatttattacatgggcggcgaaggcccagcacacatgaagacaaacgaaaagacagcggaagactagggcgacgaccacgggcgcttgacggcaggcacgagctagacaccaaagccttcatcttccaggaactcctcttctgggtttgggaaaaattgagcaagactgagtacaaccaccgtactcaacaagacacacccataagtgcaaaataaatgcaagggagtacaaaggagttataatatagggggttagggtttgnnnnnnnnnnnnnnnnnnnnnnnnnnnnnnnnnnnnnn

SEQ ID NO: 26565 - DNA, 4701 bp, Oryza sativa
  unsure (1)..(4701): unsure at all n locations
ccgcgcccgtttcctctctctccggccgctctcttctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctccttactcggcgacacctccgtccgcttcgccgagtggttgccgaccccgtccgccgctccgcttcgcccgccgaccgccggagcaccttcgtcatcgtcatcccgaaccgcgccgccgcttccctccactccggccgccgttctcgtcgtcgtcgttgtcccggggtgagccgaagaccgccgttcgccttcccccttccctcctctctctcgggcgccgctccgccgcgccggtggtcgccggcggtgaccatcggggcgcgtgcgcgccgctcccgtcggccgtgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacgcgtgggcccccccttcccgtggacccggtccgcgcgcccgcccctcggctgacgcaataaataggattttttaattgaaaaataaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagccttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatatgattattgtcattgttattattattaccttgttcaccctagatcaaacaaaaccccaactagtggacactctactcatgacaccactagttcaattttaggtagatgcttcgcaatttaattaggtaacattaggaggttttacaactttagactttgggaattctcatatcatttggacactttggaattgttggtttatggtggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggggtcgatggacattctccagggcaaatgaaggctacacgagctgcggcccggtagtcaagatgtcatacggcggagggttggtgcccaatgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaattttttcccaagcccagaagaggagttcctggaggatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacatcgaacctatcaaggctgagattaaacgtttatatgatattggttttattcgtccttgccgatatgctgagtgggtttctagtatagtttctgttatcaagaaaaacagcaaggttagggtgtgcattgatttcagggatttaaacaagctaccccaaaggatgagtatccaatgccagtagccaatcagctggttgatgctgcttcagggtacaagatattgagttttatggatggaaatgcaggatactatcagattttcatggccgaagaggatatcaataagacggcttttaggtgtcctggtgcaatcggcttgtttgagtgggttgtaatgatttttggcttgaaaagtgctggagctacatatcaaagagccatgaattatatatatcatgatctgatcggctagctggttgaagtttatattgatgatgtggttgttaagtctaaagagatagaggaccacatagccgatttgaggaaggtttttgagagaactaggaaatatggcctaaagatgaacccgacaaagtgtgctttcggtgtatcagctggccagtttttgggatttcttgttcatgagagggggattgagatagctcaaaggagtgttaatgcaatcaagaaatttcagcctctagagaataagacagagttgcaggacatgatcggcaggataaattttgttagaaggtttatttctaatttgtctggaaggttaaagccttttacaccattattaagattgaaagccgatcaaaagtttacttgggggacagagcaacagaaagctttggatagtattaaggaatatcttagctctcctccggttttaattcctccacagaagggaataccttttagattatatctattggccggtgagaaatcaatcgactcagtcttgattcaggagcttgaggggaagaaagagttgtattctatctaagtcatcggctcttggatgcggaaaccaaatattcccctgtggagaaactatgcttgtatttatatttttcttgtacaaggttaaggcattacctattgtccaacgaatgcactgtcatctgcaaagccgatgttgttaagtacatgttatctggtccaattttgaaaggaagggttgaaaagtggatattttccttaacagaatttgatcttcggtatgagtcaccgaaggcagtcaaggggcaagctatagccgattttattgttgttcatcgtgatgattcaatcggctcggttgaggttgtgccatggactttgttctttgacggatcagtatgcactcatggttgtggtatcggcttggttataatttctcctcggggggcaagttttgagtttgcttatactattaaaccttatgcaactaacactcaagctgagtatgaggcagttctcaaagggttgcagttactcaaggaagttgaagccgatgctatcgaaattatggaagattctttgctagtgatcagtcaattggcaggggagtatgagtgcaaaaattatacgttaatgatttataatgagaagtgccgagagctgatgaaggagtttcggatggtaaccttgaagcatgtatctcgagagcaaaatattgaagctaatgatttggcccaaggggcatcgggatataagccgatgatcaaagatgtcaaggttgagattgttgcattaacagccgatgattggagatatgacgtacatcaatatttacagaatccatctcaatcggcttcttggaaactgcgatataaagcgttgaagtatactttattggatgatgagctctattatcggacgattgatgtggtgttgcttaagtgtttgagtgccgatcaggctaaggttgcaatcggtaaggttcatgaaggaatatgtggtactcatcaatcggctcataagataaagtagttgcttcgacgtgcggggtatttttggccgacaatgctggagggttgttttaaatattacaagggatgtcaagattgtcagaaatttggagcaattcagagggcaccggcatcggctatgaatcctatcattaaaccatggccatatagaggttggggaattgatatgatcggcatgattaatccaccatcgagcaaggggcataagtttannnnnnnnnnnnnnnnnnnnnnnnnnnnnnnnnnnnnn

SEQ ID NO: 26566 - DNA, 1997 bp, Oryza sativa
gagtttcggatggtaaccttgaagcatgtatctcgagagcaaaatattgaagctaatgatttggcccaaggggcatcgggatataagccgatgatcaaagatgtcaaggttgagattgttgcattaacagccgatgattggagatatgacgtacatcaatatttacagaatccatctcaatcggcttcttggaaactgcgatataaagcgttgaagtatactttattggatgatgagctctattatcggacgattgatgtggtgttgcttaagtgtttgagtgccgatcaggctaaggttgcaatcggtaaggttcatgaaggaatatgtggtactcatcaatcggctcataagataaagtagttgcttcgacgtgcggggtatttttggccgacaatgctggagggttgttttaaatattacaagggatgtcaagattgtcagaaatttggagcaattcagagggcaccggcatcggctatgaatcctatcattaaaccatggccatatagaggttggggaattgatatgatcggcatgattaatccaccatcgagcaaggggcataagtttatattggtggcaaccgattattttaccaagtgggaagaagcgattcctttgaagaaggttgattctagggatgctatacaatctgttcaagagcatataatctatcgatttggtattcctcaaaccattacaactgatcaagattcaatcttcgtgtccgatgagtttgttcagtttgccgatagcatgggtatcaaattgttgaattcttcacaatattatgcacaagctaatgggcaagccgaggcatctaacaaaagtttgatcaaattgattaagagaaagatttttgattatcctcggcagtggcatactcgattggccgaagcattgtggtcttatcggatggctagtcatggttcgatccaagttcctccttataagcttgtttatggacatggggttgttttaccatgggaagttagaattggctcaaggagaacggagttgcaaaatgatttgacagccgatgaatattataatctcatggctgatgaaagggaagacttggttcaatctagattaagagcccttgcaaaggttaccaaggataaggaacgagttgctcggcattacaacaagaaagtggtgtccaagactttttcggaaggtgaacttgtgtggaagttgattttgccgattgggacacgggataacaaattcggcaagtggtcgccgaattgggaaggacagttccaaatctataaggttgtgtctaagggagcttacatgttgcaaggactcgatggagaagtttatggacgagcgctaaatggcaagtacttgaagaaatattacccaagtgtttgggttaatgcatgatcggctgatgttgccgatacatgatagccgatgtatttgcatcgccttgagattgccgatattgttatatcgtccttagttgttttcatattgtaatcggttgtggtttgccgatgcataatggccgatattgttatatcgcccttagttgtttttataattttatcaatacttttgacatcgtaaaattaggggggcacatatatgaaaaattgcaaatttttgagcgaaatatggagttatattgaatcggcataaaagttattaagatgagttagataaagagtcagagtttcttagccgattacaaaattcctagtctattacacaaaatgtcattgagaaagatagcgctggatagccgacaaagctcgttgcctgatttgatctacttcttcgatggcttggatgtcttgggcatcggttccagggatgatcttgagagatttagtcatgtcagccacattcttgatagccgatctcaatctggacttctgttcttcaatggcatttggaagatcggctagcttttgtttttcaagatctagttcggcattgcactcctcaagttgagtgtagacccccgattttggaaatcggaa

SEQ ID NO: 26567 - DNA, 408 bp, Oryza sativa
ccgggaaaacgatttcgccgacttgggtccaccccagtatcgttgaggtcaaagatccttggtttatgccggggttggcgttgtcgtcgagaaggcttgaagtcatagtagtaaaaccttgagcaccaagcccccctacctagcgcgccactgtcgacgggggatacccgtagaccggatataaagagtattggggtacgttggaacgaggatctacgtaatacgacatcaagcaaacgaaagataaggattatactggttcaggccccttgataggtaatagccctaatccagttggtatgggattatgtgatggaaattaaagattacaaagggaataatggaactcgatgataccgacgagaccgtagtcgagttggttcgactagatcacccggcgacttggct

SEQ ID NO: 26568 - DNA, 293 bp, Oryza sativa
  unsure (1)..(293): unsure at all n locations
nnnnnnnnnnnnnnnnnnnnnnnnnnnnnnnnnnnnnnnnnnnnnnnnnnnnnnnnnatatccttgcggggatttttcgtccgacacccccttccccccctaaaatcccagtcggaattccatatcacacaaatagaatcccacattgagcacacctcctcttcaaatcccacatcatcacaatcgtcacaggaccgccttcgtccgtcggcggtgcgcaccagcagcccccgccctcgaatcccaatcgcgagccaaaaaaaagaaagtccgattcaatcgcccgtccccgt

SEQ ID NO: 26569 - DNA, 1696 bp, Oryza sativa
  unsure (1)..(1696): unsure at all n locations
nnnnnnnnnnnnnnnnnnnnnnnnnnnnnnnnnnnnnnnnttgtcggcataactcttatgatgagattgagccactcgcaatctttcctgaatgattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgattcaccctttcggtttgtccgtctgtctgcggatgataagcagtactaaaattcagcttagaacccatctcttcctgaagcttcttccaaaagtttgaagtaaactgactgcctcaatcagacactatcttcttagggacgccatgcaaacacacaatccttgccatatacaattccgccaatcgacttccagaataagttgtctttaccggaatgaaatgagccactttggtaagtctgtcgactattacccaaatagagtcatggcctgatgacgttctgggtaaaccagtgataaaatccataccaatttcttcccacttccattcaggaatcttcaaaggctgcagcaaaccggcaggtttctgatgttctgccttgactcgctgacaaacatcacatactgctacgtattctgcgatttaacgcttcatacttgcccaccaaaatctttccttgagatcctggtacatcttagtactaccagggtgaatggagtataaagtatcatgagcttctttcaggattgcatcttttaaatctttgttgtcggggacgcagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttacataattccaatggcaactgtcgtccttccgtagctttgcaataacctttcctgctaagagcgtctgctacaacattagcctttcccgggtgataatgaattcccatgtcataatctttaattaattccaaccatctcctttgtctcatgttcagatccggctgagtaaaaatatactttaaactcttgtgatcggtatatacctctgtacgagtaccgaaaagataatgacgccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctaatattaagcgacttttcaactcttgaaaactctgctcacattcttcagaccacttgtacttcacatctttctgaagcagtcgtgtcatgggcttagcaatcttggaaaaattctctataaacctccggtaatatcctgcgaggcctaggaaactgcgaatctctgaa

SEQ ID NO: 26570 - DNA, 2523 bp, Oryza sativa
  unsure (1)..(2523): unsure at all n locations
nnnnnnnnnnnnnnnnnnnnnnnnnnnnnnnnnnnnnnnnnnnnnnnnnnnnnnnataatctttaattaattccaaccatctcctttgtctcatgttcagatccggctgagtaaaaatatactttaaactcttgtgatcggtatatacctctgtacgagtaccgaaaagataatgacgccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctaatattaagcgacttttcaactcttgaaaactctgctcacattcttcagaccacttgtacttcacatctttctgaagcagtcgtgtcatgggcttagcaatcttggaaaaattctctataaacctccggtaatatcctgcgaggcctaggaaactgcgaatctctgaaactgtcttcggttgtttctagtttattacggattccacattactaggatcaacggcaactcctcctgctgagatgacgtgaccaaggaacttcacttcagacaaccaaaattcacacttgctgaacttagcatacagttgatgctctcgtagcttctccaatgcaaggcgaagatgttcttcatgctcttctttggttcgagaatagataagaatatcatctataaagaccactacgaacttgtctaggtattccataaacaccttattcatcaagttcatgaagaaagcaggggcattggtaagtccaaaagacataaccgtacattcgaacaatccatacctagtggtaaaagctgtcttaggtatatcttcctctttgattctcaactggtgataccctgatcgaagatctatcttggaaaaaatggtagcacctttaagctgatcaaacaaatcatcaattctgggcagcggatacttattcttgatagtcacatcgtttaatgcacgatagtccacacacattctctgggtatggtctttcttttccacaaaaataaccggagctccccatggtgatgaactcggtctgatgtatcctttctgaagcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcgggatactcccggactataggaatctcttccaaagttatttgattcagtcttgaccttaaagactcagaagacaatgcatgaacagttaccactcgaccatcattactggtgagagttacttttctgttggcacagtctatcacacctctatgtctggctaaccagtccatccctaggatgacatcaaggtctttggattctaacaagataagattggccagaaatggtactcctttaatttctattctgaccgaggggctacgttgcaaagagagtgcttgattccttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagcatcttgagcttctgcagcagcgacatgattgacacgggcctttgatgctggtacagcagagttactctgggcaggtacaaccttcacgcgacggggcttcggacacttgtcagcataatgtcctgggtctccacagttgaaacacaccacgggcttgctgccttgctccctcttggcaggctgttgctgtgttggagctgcaacaggacgtggagcttgattgcggatgttgttgccagcattgttgttgaagaactgacgctgcggacgaacaacagacgaagaacctccctgtggcatagactggggtcctaaagtaaaacgcggcttctgattactcccttgttgtgccttgaagtgagcaatccgacgtttcctctgctccatgcaattgtacttgtcctcctgacgtatagccttatccactaatttctggaaatcaggataatctccaaccatgagtgggtaagaaagctcgtcattaagtcctcccaaaaacttctcctggtgctcttcatcattgcgcacatcttccggagcataacgagcaagacgattgaactcgtgcagatactccgtaacagagcgagatccctgagtaagcgacctgaactccttcttcttgagagacactactcctgatggtatatgcgtcttccggaaagcagcggtgaattcaagccaagtgataggttcagcagtagtcctattcaggcggaagtgatcccaccattcaaaggcagagccatccaactgatgtgatgcaa

SEQ ID NO: 26571 - DNA, 5505 bp, Oryza sativa
ggatagagaattactttaacttttattgatcttaactgagtttcattattacaaactgaagactctcacaccactaaactcaccaacttcctaacactcaaaagcaaacaaacgcatgcaattacatcccaccactgatgtaaatcacatgcgagccacacacaagcaaacttaaagcaaacaaactaacacaacgatctaagacaacgacttaacaagtcactctagttcttccaagcatcggaggtcgattgaaggctcgttcggctcgtcttcatcatcttgggttgctacccactcaatcttggaattgttgcgcttggattcttcttcttcatcacttatgatgatgaccggaggatccgcttgggatggggcaacttctttctccaccacacgaacctttggcgccaattgatagcgagggacgaatagagctctcttccttgcggtgaggcgaatcctggccttctgcggcggtgcttctccctttaatgcagctagttccttctccaaacgatccaccttgtcttctagcttgcaaatcttaccacgattccggtcttcacgatcttgagccgctaacacagtctccgcacgactttcatccatagcccacagcatctcaaccaaatgccttgtggtagcatcattctcaattccttcagtttcaaggtagctgccacggtcacttccctggggttggcgaggatggtagcgatactcagtgtcggccaactgatcactgtagctatcacggagttctcctatggcgatccttgccacttcctgacatgcatggacgtagtttcttcctccagcttcgaacatcactgaggggacctcttcactattgctgtttaaggtgactttgactcggcacttttcttcatgacgatcatgaggaatctgggcataaaaaggggcagtcccaaatccaatggcaaaggacatcgtacgcaactcctggacaaaaccctcaacaccaaacaggtactcaggcctgtagcgcggcatctaaagacaagtgaaaggagagagttaagacatctatccaattaacagcacaagtttttggattaacttgaataaaatttgaaaatcaaagtaaaaggtaagtaaataaagtaaaccaaacttgcaagataatttgaaatagttgaaaacaaggttacaaattttgtactttttaacaacaggtttcaaaagaaataaaagaaagttataaaatcatcatgctaaatttattttattgtagcaagattaaataaaacaatattgtaaaacttttgctgataaatgagccattagtacagtaatggatgtacagtactaataacactggaataaattttgaataagaaccattaaaagagattatgaaatgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaataagataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccagctgcacagttctatctccaaaccaggaatgtaccattccataccaggagctaatcaaattatttccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcacctttctggatcataatcacccccttataaacaaggcatggactccccagcgacccccgtgggcttatctccgccacttctcagtctggtgccccgcaatgaaccatgctatacaaaagataaagccgttgcccatgttggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataagtgtgctaaggtttctaagcagggctaagcaattatatctaatatctagttgaaccaatataaataaagctcaactagtcaaattattataacccaaggtatcaaggaataaagtaatcaagaacaaaagggctataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaaatagttatgaatttttaaagatttaatcggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggctgagatcgaacggtccacgaccggctcacggcggacgaccccgatgacgtcggcaatgacgtcaccgacagcggcggcggctcggcggagcggacggctcgggcggcgcacgctcgccggcgaacggcggcgcgaggacgcaaacggagggcaccagcacgtagaggacgacgcggcgaacacaccggtgaccaaaacggcggcggaaaaacaacgaacgacgacggcgacgaggaggaaacggcggaaaccttcgggttgtcgacggcgacgaagctccgacgatctccggcgacggcgaaggggcggacgaggacggcgacgacttggcgaccacgacgacggtcttcccgagcgacggcgacgtctggaacggcggcggagcacggctggagcggcggcggcgacggcgaagctagggcacacgacgctagagcgattccgacgacgagaggcgaaggcgaaggtggcgacgggtagaggggacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagattgtttcccctctattgattcggccggagaaggaaaggaacggccggatttggaagggaaacagcggcggcgcgaaactagggtttcgggcggcggcggccgaaggtagacgacgactgacaggtgggccccacctgtcagcgacagcgagggcgcgcgcggctgcggcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagatttttcaaaataaattctagaaattccaattaaacaacaatttatatattttgaattttcagggtgtgacaaacctaccccccttaaacagaatctcgtcctcgagattcagaagaactggcgaacagatgcggatgagctgacttcaattcatcttctcgttcccaagttgattcttcttccgagtgattactccactagactttgcaaaaacggataactcgatttctggttcttctctcacttgtttccaagatacggattggtttctcaacataggtcaaatcctcttggacttctatctgttcaagattagcttcttcggtaggtacccttaaacactctttcaattgcgacacatggaacacattatggactcctgccaaagattgaggtaactccaactgataagcaacctctcctcttctactgacaatcttatagggtcccacaaaacgcggtgccaattttcctttggtatgaaaacgatgaactcctcgaaaaggcgtgacacgaagatacacataatctccttcttcaaaactcaaatctctacagcgattgtcggcataactcttatgatgagattgagccactcgcaatctttcctgaatgattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgattcaccctttcggtttgtccgtctgtctgcggatgataagcagtactaaaattcagcttagaacccatctcttcctgaagcttcttccaaaagtttgaagtaaactgactgcctcaatcagacactatcttcttagggacgccatgcaaacacacaatccttgccatatacaattccgccaatcgacttccagaataagttgtctttaccgga

SEQ ID NO: 26572 - DNA, 2267 bp, Oryza sativa
ccgaggagagaaaaaaaaaaggttttgggccgacttttgggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagatttttaaaaataaattctagaaattccaattaaacaacaatttatatattttgaattttcagggtgtgacaaataagtttttgaaaagggtcaatttgtcaaaaaaacggggtagatgtgtgcggtgaattcggcgatgtataatatacatacgcatatatgcttactactccttccgtttcaggttataagatgttattgactttaatcaaagtcaaactaccacttgtggagaaaccccttttcctcccggttcgtaacccccctttagtccgtgttatccaaccgggactatgaatctgggactaaagattgatatctttcgtcccgggtgaaataaccgggactaatgatcggatcgatctaccaattttttttatttgcatggccctgttgcaaatacatattgctatatgtgtttataccacataatccatatagtcttgtttatgccatagccgatcagatagatctagcgtgtatcggctaatactccgataccactctatattaagatatcacagcaagtaaaatataccaaacgaaagcctaatatacttaaatgcatcaaaagatcttaacataaagggcggatttaacatgtcaataaggcatataagagaaatgtagttaaatcaggtaagatcggctgaaaccccgatactgccctaatcggcaatcaaaggcaggctagagattgagattctaatcatgactcataagatcaaactcaactgatgcagctataagtatgaaaagaagaaaaatatctaaataatcaagccgttggatgtgtcatagagtggtggatatcttatataatctaagccaatatcgatgtttaacctaatcggctgccttctactgacagatgttagccgattgtaagttagatagcgatattgccagagattatgtgagatatatgataactcgatgaattacataaacaagattagagtatcataaagatggaagcactaatcccgagaacgcaagccgccataataagttttacctcttgttgaagatcgaaactgatgcagctcaacccgaaagcaagaactcgtcgaaacaaaacgaaaataaaaagggtagcgatgcgccgagattgtattgaacgtgtgttagtttgattacatggggctcgggtctatttatacctgagaattacaaaatatgtccatatcggacacgacttttatctctaacaaactataagataccacaagtcttgcggcagacttttgcccaaacatatctccaaggaaattacataaaatatcctaattaatagatacaattgccttctcaggactctatccatgcgtggcaatcatcatgaagcacatcaacctaaaccgacaacatatgctatgtcatattgtcggattcggctcaatcggctaacctcgtccgactcgaactttgccgatcttaatcatagccgattcagacttcaaccgatcctcactctgtttccgggacgatttccatctcgaattccatcttggtttcttcttcatctccgatccttggattaccaaatttggttgttaacacatgccccccaagtccggaatattggataatgtttcggatttgccatacgtcaattccgagagaatctcgcgcttgccattttctgaccgttattcagcgctttaaatactaaccgttgtccccgagaaatctcacatcgtttcctccgttttcaccgtcgaagcaatgtcacgaccggaaatcacccaacgggcgttccttgcgtgcgtgtattgttccttgtcccaggaggcaaggtacaccaaaagttgatacaatacagagtttaacaagcggaagcgtaaatagataatttattacatgggcggcgaaggcccagcacacatgaagacaaacgaaaagacagcggaagactagggcgacgaccacaggcgcttgacggcaggcacgagctagacaccaaagccttcatcttccaggaactcctcttctgggtttgggaaaaattgagca

SEQ ID NO: 26573 - DNA, 1092 bp, Oryza sativa
tccaaactatagacaagagtaccgacccaaccccacctacggccggaacctccgggacaggtaggcaggactgagcccctagcagcaggacaccagccctgtgccatgacatgtcgactaccgggccgcagctcgtgtagccttcatttgcctagagatgtccatcaacccccgacttcatccatctccatccgtgcacttttgtttataaccagactgagccacaaactaagccttacccactagacatgtggaagtacggtagtgctttgaaacagaggcccgaagaccggtccttatatggccgaggtgctactatcaaaaccatgcaccccgaatgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcaacgaaggcccagcacacacaaagacaaacgggaaacagcggaagactagggcgacgaccacaggcgcttgacagcaggcacgagctagacaccaaagccttcatcttccagagactcctcttctgggtttgggaaaaattgagcaagaccgagtacaaccaccgtactcaacaagacacacccacaagtgcagaataaatgcaagggagtacaaaggagttataatataaagggttagggttgcagtaaacagcatttaaagacacttggttgcgcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccac

SEQ ID NO: 26574 - DNA, 1395 bp, Oryza sativa
ataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaaaataaaaatcctttattatttgtgaaaacccgctattctctcttgtcttgctgcttcatttatcgtcaaaatctggtctttaaaatgttgtttctctttttgtttttgtttgtagatggccggtagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacccttcaccagcgctacccggacgagttgcagcactcgccctaccgctaccacgctcgtcgcggaggagcccgcgactacgccaccttccgagacgccagttcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcagtggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacgctggtgtgtggtgtaactatgtcggagcctgtcttattttatttgcctaagcaacttgaacattaatgaaccaatttaatatcagtaataaatttaagaataatagtagtcgtgggtggttagttttaatcgtcagctctccttctctgtttgctggttctgtgaggggttttcagatggtgacgaccaggacaaatgt

SEQ ID NO: 26575 - DNA, 794 bp, Oryza sativa
  unsure (1)..(794): unsure at all n locations
cataaccgagggcacggctattcgaataggttatactctgatcagaggtgtacatctttactcacaagacacatcatcctcacgtgtaaccacgtgccacataccaccacggtatacggacggaagacgtgacatagtttccaacccatccaagctatagacaagagtaccgacccaaccccacctacggccggaacctccgggacaggtaggcaggactgagcccctagcagcaggacaccagccctgtgccatgacatgtcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccaaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataataannnnnnnnnnnnnnnnnnnnnnnnnnnnnnnnnnnnnnnnnnnnnnnnnnnnnnnnnnn

SEQ ID NO: 26576 - DNA, 1167 bp, Oryza sativa
  unsure (1)..(1167): unsure at all n locations
acccaagatgatgaagacgagccgaacgagccttcaatcgacctccgatgcttggaagaactagagtgacttgttaagtcgttgtcttagatcgttgtgttagtttgtttgctttaagtttgcttgtgtgtggctcgcatgtgatttacatcagtggtgggatgtaattgcatgcgtttgtttgcttttgagtgttaggaagttggtgagtttagtggtgtgagagtcttcagtttgtaataatgaaactcagttaagatcaataaaagttaaagtaattctctatcctaagtagttttcccccggtttctcttcttgtgccatgttcctgccagatggtgaatactcgcagcaacgggaatggtcccaacaaccccaataacaataacaatggagagaacccaactctggcccaagttcttgctcaacagacacagcttatgaacatgatgatgcagcaacttcagaatcagcagaaccaaggaaataaccatgcacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtatcttttgcatcacatcagttgcatggctctgcctttgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcaccaggagaagtttttgggaggacttaatgacgagctttcttacccactcatggttggagattatcctgatttccagaaattagtggataaggctatacgtcaggaggacaagtacaattgcatggagcagaggaaacgtcggattgctcacttcaaggcacaacaagggagtaatcagaagccgcgttttactttaggaccccagtctnnnnnnnnnnnnnnnnnnnnnnnnnnnnnnnnnnnnnnnnnnnnnnnnnnnnnnn

SEQ ID NO: 26577 - DNA, 7600 bp, Oryza sativa
tcccctggtccctagctccctccccaccgtcgccctctctctcccacgtcgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctcctctccctcggtcagccctccgtttcgcggggaaagcaccggagacgcgtcctcgccggcgtccagtggcgtcgccaccacttctccgtctccggccggctgctgttcgtcgccggtgcgccgaccgacgtcgccgtctcctccgttgacgtcgcagtgccgtcctctctcccggccaggccacggcgtcgcccgaatttcgccggaacgccgtcgtctccgcgccggcctctccttcctcctcgtcggctcgtcgccccgctgcaccaccaccttcaccaacgtcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgcagcggcgtggtcctcgtcgtcctcgtccccgtgcagccgctgccggctgtcctcgtcgcctcctcgccggtcccggttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaatattgaatctccactgatcaacgctacgccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcgcaaaaccatgcacccacagcccaccattcagtcgcattttagttggataattacgaccatgaaacatggccagatgtctcgagcacgcggctcaacaagaaactagaatgtctaatactgcaattatcccatcgactgagctagtggtaattaagcatggctaagcataaagttctagctaggtcatcaaagtaacacaagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggatcaacatgctcaaggagaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatggatttatataattaaactcgatttattgcgcaattattatttatttttacaaaggaaatggacctcgctgacgtcatcaaaggggaggggcggcgccggcaagcgggccccaccggtcagcggcacaagggcgccggtccaccgtggaccgggaccaccgaggcgatccaccgccggtccacgggaaccgacggcccggatcggcccaaagccgatcggacggccacgaggcggcgcggctggggcacgggcacgacatgaaaccggctcggccgagccgtggtgctgggcagcgtgcggcctccggaggcagcagccggcggcgccgaacggcggcgagcagccggaagacggcggcgctcacgggcagtggcgatgcacgcgaaagggaaggggagcgggaggaggggctcaccgagcgtgcgggccgacgaggcagagcgggaggtcgccggcggcgggaagaggcggcggcgctcctcggggaggcaacggcgacggcggttcggcggcgttccgtgaggaggaaccggcggccgatggtcggagggacctagggaaggaaatgaagaggttaggagagggtagggagttgcggtgcggcgggaaacgccgaccgaaatgacgacggagctcaccgggaggcacggggagatgagtccggcgacgaccggcgaacacggagggattgctgagccacggatgatggctgcggtaccgcggagggcgacggcacaacactgggcggactgaagaggcggtgcggcgcggccggaggcggaaatggcgacggtggctctggatgcacggtggaagggtggttgcggtggtggaatggggaaacggagcggaggccggggtagagcttggcacggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgattttatagctcaagggggcgaggagagggccggggagcggcggatttcgaggggaagtggggcggcgaagtggagctcgtggggaggtcaaaccggcgccgtttcttgcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttattttgttttctttttatttaaattgatgcaatgatctttgtgctattaaaactatttctcgagctccgaaaattcacggaaaattccggagagtacattagggcacaaagaatattacaaaatattcccggccattgatttttaagggaaaatttcaagttctcccattatttcacttgattaaattgatttatcttttatttaatttctagaaaatgtattattaatgatttttaatcccgaacgaaaatcggggcgttacaccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtctcgcctgcctgtcccgggggttccggccgtaggcgggattgggtcggtactcttgtctatggctaggatgggttggaaactatgtcacgtcttccgtctgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccttcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactggcgttcgggaaaaggcaattttcccggtcgcgacaagctggtatcagagccatctcgactgtaggataagccaagtggataaaacctaaggacatattttataaatgaaactatttccgaaagtccctttttcctccttttccctgtgctgtttgcaaaatgtttattctcttttcttcctccttcggattttccactagtactagatggttagttttgcaaagaagaagatgtcgtcaattgtctgccgaagctccagaaggctgcaggatccgctagtgaagcgaaggaagcagtgaagccagctgtgaaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacctgcagaataagtgaaacaaacaacacatcaataagaagagttagttcctttaaggtcctgtctctagttctggtctattctttcctggcttgtttcctctctcacctcaatccttgtaacagatgtttaacagagaaaaaggaaagaatgtcagcaggcatgcctccagtaactcaagttttcaactccatccaccactagcctcaagagagttaacaagggtacacccttggtccattccaagcatgctgcttggttcacagctaccattggttggaagtcaagaccaaaatcagtatgtgtttgatcgagcatttgccac

SEQ ID NO: 26578 - DNA, 560 bp, Oryza sativa
gcgtgtgtctttctaagccctcgtcctctttcgtgtgcgccaagcttctcccgatcagcccaatggccgaacgggcagtggcgcacatcctctctccgagcgctagcggtgacgacggggagcagaacccgcgccgccgagctcgtactccaccgtccccctctcgccgaagtcttggccgggagtaggcgctcgagaaggtcgaaagatccgcgacttcgccgcccgcgggtgatgaagaagcacggcgagacgggaaacgtcgcctcctcgtctacggcgatggcagcacgccccagggcgcgctttaggctgcgggcgcgctcttgcgtcacccgcccgtcgtccccgatccagagactccagcccaacgttggctagacgacatgaccaatttggtcatgacggcgcagcagcgcctaggtgccggcgggcggtcctccgccaccaaggcctctagcgctgctaccgccggctccgtgtcgtcaaggcggagggcgcggcgagcgacggccgttacccgccgttcgtgggtaccgagctcgaattcgccctatagt

SEQ ID NO: 26579 - DNA, 1190 bp, Oryza sativa
gcgccggtttccccgtcgtccggccgccctctcccactcccaaccctatataaacattccccgtgcctccctccacagtttcggccactagccgctctctctccccgcgggaatcgagctcgcgccatcgctctctctctcagcagtcgccgccgagctccggtccgccgccgtcgtcgccccggaccttctcccgcttcggagtcaccttcttcgggttcgccgcaacctcgccgacctcgtccacctctccgtttcggtcgccgaccgccggaacgccgccgtcccagtcagacccgagccgcgccgccgcctctatccgctccggtcgccgttcccgtcgtcgccgtcgacccggggtgagccgtggatcgccgattcgtttcccccttccctcccctctctcgggcaccgctccgccgcgccggtggtcgccggcggcgaccatcggggcacgagtgcgccgcctcccgtcggctgtgccggcgtggccgccttcgggcgcgccccgcggctgccgcgtggggcccggccgtcagccgcccgcgccctcgggtgcggctgacgcgtgggacccacggcgccggtcggtgcgagcccgggtgcacccggtccaccgtggaccgtgaggctgccgcgtgggccccacccccgtggacccggtccgcgcgcccctcccctcggctgacgcaataaaccctttttaaattaaaatttaaatgaagaaattcttaaatatttatttaaagagcatataaacttcaaatggccataacttggccaattgaactcggaattggaccgttcaagtctctaatttttccttaagaagtcaagaacccatttttgtgctttgttcctacttgttatatggagtttattagagtaaaagcctttttcttttccgttggtcgtgtagacgctgcagcttcggaagatccgctcttcgtggaggttgaagccgacgtttgggaaagtgagcaaggcaactcacatcatccttgaacatattgaatcctagtttataaaattattttgatttaaattaatgcattatcgctttatttaaattcccgcgttatcactgttttatttagccatgcctatttacctttgttatgaccttattattattgttatttttattattaccttgttcaccctagaatagggtaccgagctcgaattcg

SEQ ID NO: 26580 - DNA, 622 bp, Oryza sativa
  unsure (1)..(622): unsure at all n locations
nnnnnnnnnnnnnnnnnnnnnnnnnnnnnnnnnnnnnnnnnnnnnnnnnnnnnnnnnnnnnnnnnttttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26581 - DNA, 2008 bp, Oryza sativa
taaaatttaaatgaagaaattcgtaaatattcatttaaggagcatataaacttcaaatggccataacttggccatttgaactcggaattggaccgttcatgtctctaatttttccttaagaagtcaagaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggcaagtcacatcatccttgaacatattgaatcccagtttataaaattattttgatctaaattattgcattatcgctttatttaaattcccgcgttatcactgttttatttagccatgcctatttacctttgttatgaccttattattattgttatttttattattaccttgttcaccctagaataaacaaaaccccaactagtgggtactctattcgtggttccactagtatgaatttaggtagatgcttcgctgtttaattaggcaacattaggtggttttataactctagacttttgggaatattcatatcacttggacattatggaatgattggattattgtggaattggatgcacaccttcccctctattcaaaaccctcaaaatggttttaggctgggttcggggtgcatggttttgatagtagcacctcggccatataaggaccagtcttcgggcctctgttgcaaagcactaccgtacttccacatgtctagtgggtaaggcttagtttgtggcttagtctggttataaacaaaagtacacggatggagatggatgaagtcgggggtcgatggacatctctacggcaaatgaaggctacacgagctgcggcccggtagtcgagatgtcatggcacagggctggtgtcctgctgctaggggctcagtcctgcctacctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggtcttgattaataatattgtatagctctaagatcgtatttacaaaatagctttgagcaactaaatgtcttttaatgctgtttactacaaaccctaaccccctatattataactcctttgtactcccttgcatttattttgcacttatgggtgtgtcttgttgagtacggtggttgtactcagtcttgctcaatttttcccaaacccagaagaggagttcctggaagatgaaggctttggtgtctagctcgtgcctgccgtcaagcgcccgtggtcgtcgccctagtcttccgctgtcttttcgtttgtcttcatgtgtgctgggccttcgccgcccatgtaataaattatctatttacgcttccgcttgttaaactctgtattgtatcaacttttggtgtaccttgcctcttgggacaaggaacaatacacgcacgcaaggaacgcccgttgggtgatttccggtcgtgacaagttggtatcagagccttcttgaccctaggacgagctttagatcccaagccttagcaatattttcgaaataaaaatcctttcttatttgtgaaaatcctctagtctctctctgtcctgctgcttaatttattgtcaaaagctgatctttaaaatgttgcttttctcttttgcttttggttgtagatggccgac

SEQ ID NO: 26582 - DNA, 590 bp, Oryza sativa
  unsure (1)..(590): unsure at all n locations
acgccactggacgcgggcgaggacgcgtctccggtgctttctccgcgaaacgcagggctgaccgagggatagaaggtggctgcgaggccgagggagaattcggcgcagccggagggtgcacgggtaaggcggtaggtgcggctgaaggtggccggcgcggagaaaagaggagggcgacggcgggaaggcagctccgggggtcacctcgcgaaacggagggcaagccggggtggaggaggtgacggcgacgctggaggaggcgacggcgcggccggccggcgcacggtcgaggcggcaccggcggctggaggcggccggcgacgtgggagagagagggcgacggtggggagggagctagggaccacggggaggctcgggatggggctaaaacgagagaacgggggatgaggatcccattttataggatgggggagggagccggccacgggaggagcgggaacggcgacgggaatggtggccggcggcaaaggaaggcggccggacttggcgcggccgttcccggcgattgggggcaccattcaagggggaannnnnnnnnnnnnnnnnnnnnnnnnnnnnnnnnnnnnnnn

SEQ ID NO: 26583 - DNA, 966 bp, Oryza sativa
  unsure (1)..(966): unsure at all n locations
nnnnnnnnnnnnnnnnnnnnnnnnnnnnnnnnnnnnnnnnnnnnnnnnnnnnnnnnnnnnnnaataaatttaagaataatagtagtcgtgggtggttagttttaatcgtcagctctccttctctgtttgctggttctgtgaggggttttcagatggtgacgaccaggagaaatgttaacaccggtgaaggtaaccaacccgaaggcagcaaccccaaccaccaaggcaatccacctccgccaccaccaccagacaccaacgccattctcacccagatcctcgcccaacaggccaacatgatgaatgctttcctccaccaccttcaaaacccgccacaacagaatgctcccccaccacctccccaacactctaaactcgccgagttcctccgcatccgcccacctaccttctctagctccaacaaccccgtggatgcgttggattggttgcatgccgtggggaagaagttagacactgtgcagtgcagtgatgaggagaaagtcatcttcgccgcccatcagctgcaggggcccgcatctctctggtgggaccacttccaggctacgcagccagagggacagccgatcacttgggcccgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattctcaacgtctggtggacaagagcatccgcttggaagccaagcacaaggagctggagtcgcacaagcgccgcttggcgaatttccgcaatcaacagggtgctaaccagagggtccgctacaccaatccct

SEQ ID NO: 26584 - DNA, 678 bp, Oryza sativa
caaattcggccgcgtctttcccgatccggtcaaattggtagaggggaaatgatccccttgatctcctctatcttttctcttatagaaacttcgtctaattttgtttggaaatcgtcggattcgagtttgattcgtattcgtctctctcctctaaccctaacctttccttctcgtcgccgaccgccgtggacctccatcgccgccgcctagcccctataaaaggacccccgggacctcttctatccgccgccaccctcgcctcagctcgccgccgcctgtagcgccgcctccgcgttagcccttgcatcgccgtcgccgccgcgagttcagccgtgcgccgccgccgctccggtcgtcgtcgtcgctctggaaggccaccgtcgggatcgccaagtcgtcgccgtcctcgtccacccctgtcacgcccggaaattcactagtaatttccgaatttatttgtgcataaaatcctcgtccaggaatcagccgaggtacacaaactgacaatttaatatacagattcatcaaattaactaaaaggataaatacttacttaagaggcacttagtcctcaccatgaagaaaactgcagcggaaaataaaatctagcgaagctccggctccactcccacaggcagctcaactggggtataagccaaacgtcttctccttctggat

SEQ ID NO: 26585 - DNA, 472 bp, Oryza sativa
cggcacacgggtaccggtgtcgacaaccgcacaaaggggtacggggcgacaccgaaaggacgagggcggggaagcgagagaacggatccttaccaccacgcgacgaggcgtgggaacgccaacgacgaacgggcgcggcggagacagacgggcacaacggagacgaacggcgaggggacggcttcggcggcgatccttggacaaaggcgagacgcggccggcacgaggcttgacgacgcggagccgaggacggaggcgaggacggggctgcagcggctcgcttgacgaacgcggacgacggacgagaacggctcgacggagggacgaacgccacgacgaccgggaacgacgagaggacgacgacgacgacgacgaccggtgtaacgccccgattttcgttcgggattaaaaatcattaataatacattttctagaaattaaataaaagataaatcaatttaatcaagtgaaa

SEQ ID NO: 26586 - DNA, 1025 bp, Oryza sativa
  unsure (1)..(1025): unsure at all n locations
nnnnnnnnnnnnnnnnnnnnnnnnnnnnnnnnnnnnnnnnnnnnnnncaagctaccacagcaacgatgcatatgatagaaggtattttaaggaatggcttcaggttcctttgcgcaaagcaagttttgcaaatcttttcacaagcctaagaccttgcatagactgatcaaattttaataccagtgttcacattaaacaacgacggttctgtccaccatccattgtgatcccaaggatatcttcccgccattgagtcgtcatggttttctgaggtcgtccaccttccctcctctcaggaagtagctccaacagcataaaaatcatcatgcaatatcccatcccacacaagttaagaatttagagtctagccaagtgtaatacacgtcccggtgctcaataaccgtgagcacggctatttgaatagatttggtttactcacactgtagtggatgtacactttacccatgctcggtgactgcccaacacatgagcctcgtcccaacacatgagacgcgtcacgacaaagcttttcgataacctcgcattggcagtacccactccatgaactttacatcctcatgcactctaggcgtacacggtttctagcagtgagaggagttctggcgcacccgggaaggaaagactcatacatgcattaagttataattatgtttaaattctcacatggcagtcctaccgatggcgacaccactgtagacacccgcctcgcggttctaccaatggcagccccaccgtagagcccctgcctcacacatcaagaaaccactatgcatggataatgcctccgctcagctatctactccgctaggtctatacccatacgagaagtgcggttgtacgggggtcgtttcatgcttaacttcatagctcggtccttaactgaccagggacggcactagccttttccggacaccacccaaatcctccagccgccccagtcgaaaacaattgtttcactttattttcctttcacaaatcatgtcatcaatatcatggcaatgtgg

SEQ ID NO: 26587 - DNA, 1271 bp, Oryza sativa
cccactccatgaactttacatcctcatgcactctaggcgtacacggtttctagcagtgagaggagttctggcgcacccgggaaggaaagactcatacatgcattaagttataattatgtttaaattctcacatggcagtcctaccgatggcgacaccactgtagacacccgcctcgcggttctaccaatggcagccccaccgtagagcccctgcctcacacatcaagaaaccactatgcatggataatgcctccgctcagctatctactccgctaggtctatacccatacgagaagtgcggttgtacgggggtcgtttcatgcttaacttcatagctcggtccttaactgaccagggacggcactagccttttccggacaccacccaaatcctccagccgccccagtcgaaaacaattgtttcactttattttcctttcacaaatcatgtcatcaatatcatggcaatgtggcgctcatgtctccacatgccgcatttcaattaccttcccaaaggtaattgcccaagcatatagcatttgataaatatgagtatgcatgattctagaatagcatttctaagcaattgtcataattgactagggactcatatgtaatcatggttacaaagatttaagggtaaacaataatcaaggcatggtataatcacaactgggatgttcatcattgcatgcaattttatttgtaaacaaagtgatttcgcaattgggatcaacatgttcaaggaatagtgatgacttgcctgctcaggataatccttattattgatataatcttgatcaaccttcacctcctggatgttgcagacgttgcctcacgactaaccggtacacagattctataatacgcgagaaaaaccaatattcagacaacaaccaaatatgcacaaacagaatgtaattgttggggtcgaacctagggttgctcctattactcgcgcttgctaatggattccaatcatgctagaggctaaggcttcttaatctttctatcgtcatcatggtctatttaggagttaaccaatagtgtataaatgagatatacatctagctaatgtgtggtttagtctagctaatgactatggaaggattatggctacacatgcatttatctaaataaagtggtcatatactagaggttctcttatcggatggatttaggatcaatcaaattattacagtgaatcatttgtatcattattttattgatggaggttttactttaattatgaacatatttttcttgtcacaa

SEQ ID NO: 26588 - DNA, 1513 bp, Oryza sativa
tacacatgcatttatctaaataaagtggtcatatactagaggttctcttatcggatggatttaggatcaatcaaattattacagtgaatcatttgtatcattattttattgatggaggttttactttaattatgaacatatttttcttgtcacaacgaattatgaaaggataataattatccatgctttgaatgttagagttgtttaggttaatcatattatggttacagattatcccttaatgaacaatcctaatttacagttgaactataattataattatatgaggtcaagatttataactagtatttatctaatatacatgtttgtcatatactccctctaatttaatatatgcaacacgcaaattataatactataccgtacagctataatgggatgtatagtatatgtgtaagcaacaatatcttaatattgaatcatttatttgaatagctgctatttactttaagctacatagtacatgtgattttaagtggatttattagtgagttactgcctatacaacttaagggtcgatttccaacctaaacatatactagtgtataggaaatgtcgttaattaatttcatattggtgatttaatcatacaagctctgctattatctctcataaacaagttaaagactcatcaacgtgtgttcatattttagtcacaaaatctgaggctaaactttatgtaaataatttataagtcatggatttagttatatttggacatagaccaataaatggcactaatattttcctatacacccattaatttgaaggatttattataactactttatgtggttgctacagtgacaaaacatattaaagataattatactactgtacaatatccatttttatttattagcacactatttaggttaactattatctaatcatttgatattaattaattaataattataaatatattttattaaatagtgaattatatacaattggaaagcttatgaatttagatgaatttaggttcaagtttcactcaaatccgagttaaaatgaataagttatgctagtgtaaagattcaaatttgaattaatccgagaaattgcgaaaagctactgtttataaacgatttatttttaatacaagacatatccacagccttgtaccaactgacaagtgggaccccgagtttattcctttttcctaccgaattatttttcaatgcaaaattgcacaggtgggcccggcctatcagtggctcgaatggaggtcgtcttcaacctccagccgggcagaggcagccgcgccatgcgcgctgggcgcagccgggatggcacgaggccggcacggcggcggccggggaaggtgcgacaaggttccggcgacctcccaccaccgtcagcgacgtgcggcggagcgagggcgagcggcgcagcatggccaccatggctgagctcgggttacaagtggctaggtcaaaagagagggtttctgaccaatttgatgggagcatgagcatctacggcgcat

SEQ ID NO: 26589 - DNA, 4675 bp, Oryza sativa
  unsure (1)..(4675): unsure at all n locations
attaaaggggggctctagtttctatggaactaggggaggcctgaggagcgaggacttaccgagggatggaggaacaacgaagatcagtgttacggtggtggagcgtacaagaaggtgaagcacgcccacaaggtgttcgacgaaatgttttcgagggagtagaagaggcagagaggggaggacgagttcgtgggggctgggaggtgtggggagggaaggggaggcatgggtttataagggggcggaggggagaggtggctggtgcagtgatggtggatgggacgcgcccggcatgcggggctcgagccgatcggcgacgggacaggagcgcaggcgcagcgtggggctcggcgcgatgatggcgacggtgcagcagctgacggcagcggcgcggtagcgcacggggcgcgagggcgcataggcggcaaagggagggtggcgatgatgacgacgcgacgcgacgcgacggcacgcagcagcgacagggcacggggctcgagggcgcggcagcacgacggcgacggctcacggcgcgcggcgatggcgacgtcggcatggggctcgaggcggctagggccgcgcggcagaggaggggcagggctatggaaccacatcgagcacctagaccataatgaatagtgacttttcctatttatccaattttggggcctatttcctattaaaactcgtcccataaattctagatttcacacaaatggagtttactcaatatcttttaatttagatgatagtttaccaaattttaatattacccatattttatttttatatatatttttctacggcattatttaaatgaggtctagttctaaaattaacctggataattttggaggctttgagggttctaaaattaattaaaatatcctaatgtggccattattattacaatagcacattgaatgaacttattcgtataacaatgcattttatgtgggtctattcattctataaatataaattgagactcgatacaacattaatctaattgtttaattaaactctcacatattcttatttatatataaagcttaatttatttatatgaccattattttatatgagtgattttcatgtcatgaggaactggtgaaatgttctaagtatcaatctatatattctggtgaattacttatttataaacacgatcattatagtggtgatcatcatttcatgtgagattgaattcaaatgaattagatttgattttactatttcttttagctaatcatggcatcaagctatcagcatggttcgaatatttaatatttgatctgtgatttatgatagaaattaacatttgacttatacttgatttggcttgctttcttgagcagtaatatttgtagggttaataataaataacatattcttgtaaattatatctattgcttaaatgtagatcttttctttactttctttgtgatcatttacggtttggcaagcaatagtaatcataacaaccagcatgacgcaaaagttttaaaaagttcgaaattttagtgatttttattattgggaattttcaggatgttacattgagctattagatcaattttgcgagcttcaagccgatctatattcgattgaatcggcccaacagagatgtgatctaacttggctttctcttcatgcacgagctgccgattggattgaatcgtggcttcgatattcatccgctctcgccgatcggctatacgttgcttagccttcttcagcttaaattggtgttgctcaaggaatactgctggagtaatggtgtttgccgaatcgtctagggccagggcttggatttctgcaaatcgtgcccgaattgaacctcagtcggctaccagattgtctaatgaagattctagccgaagggatatgtcttcaagtgttttcttgacagtgtcatccaggggggctagagccttgcttgtggtttcttcctctgtctcatcaaaataatctttgatatcaaaagagaacaaatcggctaagacctgcaataatgatttaaagagagttagaggccaaatagacatagccgatctgagtatttgtgtcaaaggaaaacttactgggatagcaggagcagctggttgtacttcttcttcaacatggtgactccctacagccgatggagtttgatcgcttgatggttgttgaacaggagaaggaggaggaggaggctgcaaaaaggtaagtgtaagataagatcggctatgatcggctaatgagaaattaagaacatcttactggtggagctggtttgagagtttttgttgccaatttctttcttcacaacaattttttttctgcaaagacaagattaatgagtaatcggctgaggataaaatggttataaaagggaaccagggaaagatatttaccctcaagaaatgagttgtggcagaaggaattggaggagtctgcttgagcgaagcagatggtgtttgctctgtatcactcacttcgtctgcagcttgatcaacgtcttctccgatctctacttcatccagagctttttcaatggatggatctagggcaggcaagtcatcggctggcttggtcttctttgacttggttttcttctttggagccggggccgatgtatctacagccgatgctctggttttcctctttttgccagcatcggccggttctctgatgagcccttggagaagagttgaagtcttgggggcatgatagccgatgatagggggagatggcccacctccattgggaattagacatggggcatattcgatatctctgccactattgctttgatgtaggggggaagatttcgttgtttgcaaaacagaagagaagattagtcaagttatgaatcggctgacaattgttcaaatgaaattaatgaggacaaggtttacctgaggtgtaatatcaggaaagagatctgtcatgtacattgaggccggttggtggaatagatgcagcttccattcaccccaccatatgtcaaagtttttgctcctgaacctcgccagctctacattttcaatgttacccaaaggaggtccttggagattgagcagccgatccatcatcaaggttgatgaaatttcccctcggcattggattttattggcaaagaacaagccgattggtagttgacccattccaagttgtctggcagagctcattgggtgataaaattcataagaaacctggatattcctccgttgatgtacgctgacaggaagaatgcatgggctaattgcagctgagaagacttccctagatttttgaaatttttcatggttgatgtcttcgaatctgaagtctgatgggaggtcaagatgcactgaatcttcataaggaaaccaaactcgagcatctttttgaaagccctcataaaaactgcagaaccaaacttttagcaattcagccgataattttgctccagcatcggctggtgtggatgcatattcttcatatgacatgcatctacgatgagtgtgctcttctccatcatcttctataatcagctccagccttgggaattcagcttctgtcacagatggccgattgacgactttcatgaccatcaggttgagccaagattgtagcagccaccatggtccacctgctccaactactgagtcgatggctatcatggccgatgcattgtttagcaattggtataagtagccgaggaggatcttgcctacaggaaattctctttttgacactagagcctcggctacaaactgtcagttggttgtaaggccacaactggatccacagaaaaggaacttttctagccacatgagcaaaaaggccacatgctctcgaggagtaacagatccttgacccatgtatgccgccacataaccagaccaaccacctatgctcttggttctgaagtcgtactgattcttggtgttcagattcatgggattagccaacgaggacacatctagactaatgatcatggtaatatctatcaagattggtgtcatcagcccttggttgaacagaaaagcattgatggtattggaccagaagtaggtggcggcagccattaagggttcatctttggctgaattcgctatggtgagggcaagtgcctagccaattccaatctcatcccaatgtgtttgcttgctagccgatacacgtgtcacgaccggaaataacccaacgggcgttccttacgtgcgtgtattattccttgtcccaggaggcaaggtacaccaaaagttgatacatttcagagtttatcaagcggaagagtaaatagttactttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgagaaaaaattgagcaagactgagtacatccactgtactcaacaagacacacccacaagtgcaacataaatggagggagtacaaaggggttaaagtataggggttaggtttcgcagtacacagcattaaagacatttagttgctcaaagctattttgtaaatacaatactcgagctatgnnnnnnnnnnnnnnnnnnnnnnnnnnnnnnnnnnnnnnnnnnnnnnnnnnnnnnnnnnnnnnnnnnnnnnnnnn

SEQ ID NO: 26590 - DNA, 2283 bp, Oryza sativa
tattgcgtcagccgaggggagagggcgcgccgaccgggtccacgggaggggggcccaccccgcaaccttaccgtccaacggggacccggcccaccttggattccaccggccggcgccgtgggccccacacgtcaaccccaccaaaaggcccctgcggctgacgggccggcccccacgtgcaaccacttcgcacgcccggggcggcccatgccggcccgggaggtggaagcggcgcgcgcgcccctatggtcgctggcggcggctgagagaggggaagggaagggggaaaagaggcggcggtccacggctcaccctaggtcgacggcgacgacgaaaaaggcggccggagcggaggaagccgacgccggggcgacgacgggggtgaacggggatggcgacggtgctgcgaagccgaagaaggcgacgccggggcgacgacggcggtggaccggagctcggcggcgacggcagggagagagagcgacgtcgcgagctcgaatccggcgaggaggaagggcggcgagaggtggaaacggacggagaaggtgcggggagggtttaaataaggttggaagggggagagggcagccggggaggaaggaaaccggcgcggcgttctcgggctccatcaatggcaccggcgggattaggggaggggttccaaacgaatccaagggagagagggagggaaaattggggggaaagggagagggaatcacggggagtatttccccccccactttattgcacgcggggactgcgggatgtggcggatttggcagcggcggcggcgcttggcgcgggcggagcggcaggagcggcgggaggtcggggatgacgggtgggccccacccgtcagcgagggtggcaggcgggcccgcccgtcagcggcgcgcgcgcagcgagggaggccgaatgggccgcgggggagaggagagagagagaggggggagagagattggccgggccggcccaagggaggggagggggacttttatggtttttctttttataaaactttttcaactttgtttatttcttaacaattattatttgtgctctgaaaattccactaaaatttatttacacattttaggcttttaggaaatacacaaaaatcctctaagccttgtttgacttttactttgcacattgtaatttttggaggctttcacacggattttaattattctaggcataatttaaaggatgtattttagagtcgttttgggatgtgacaaacctaccccccttaaacggaatctcgacctcgagattcggaagaactggcgaagagatcgggatgggctgccttcagctcgtcttcacgctcctaagtagcttcttcctcggcgtggttgctccattggaccttgcaaaaacggattactcggttcctggtcctgcgctccatggtgtccaggattttcagtggtctgtctacgtaggtcaagtcttcgcgaacttcaatctgctctgagtcagcctgctcggacggcactcgaaggcatttcttaagttgcgacacatggaacacatcatgcacgttgcccaaggaggcgggcagctccaactggtaagcaacttctccgcatcgagcaatgatgcggaaaggacccacaaaccgaggtgcgagcttccctttcgtctgaaacctgtgtacgctccgcaatggcgtgacccgaaggtacacaaaatcgtccactgcgaattccaggttacgacgtcggttatctgcataactcttctgccgggactgtgccacctttagattatcccgaatggttctgaccttcgtttcagcttctctcaggatatcagtcccgaatacttggctttccccaacttggtcccacaatagcggtgtccggcatttgcggccatacaacgcttcatagggtgccatttgtatgctggcttggtagctgttattgtaggagaactcggcataggggagactcttatcccaggtcttcgcgaaatctagaacacatgcgcgaagcatatcttcgaggatctggttcagacgctcggtctgcccatctgtctgcgggtgatacgtggtgctgaaatttaatcgggtatccaactcttcttggagcttcttccagaagggagaggtgaattggcttccccgatcagatacaattttttaggaacaccatggagactcacgatcctagcgaagtagagttcagctagtttgttccctccataggtggtcttcacgggaatgaaccgagctaccttggttagtcggtccacgactacccatatagaatc

SEQ ID NO: 26591 - DNA, 4929 bp, Oryza sativa
  unsure (1)..(4929): unsure at all n locations
cacgcaggaagcctgcatctccccaaagacccacttatacctactctaccatcatccatgaggagtagccctgagcccctgacccggtctccatctcctggctgggtctatataatataaccatcacccagggcgtctctctcaatcataccatcacaaacaccaactgcaactggagtagatagcgctacctctctccgggctgaaagctactggccattatcattgttcttccagccatggatcagctgctggccctggcggtggcagtcccgctgtttgctcttgccagtgcacttgctgctgcctctgctacgccggtcaacaagtcctgcctcaatggtagcaccggcgccgccgtcagcatagggtacggtggtgccagcgctagcgctggcgccggcgccggcgtgtctcttggcaccgacgcgtactggttggcctgcccacttgccgaggagatcgtccgcgacgtcgtggagagggctgtcgccgccgacccccgcatggcggcgtccctcctccgtctccacttccacgactgctttgtcaatgtgattatctttctgtttgccgcgctacatgtgtgaagtggtcgtcactcgtcagggccattgatgtgagcatgtcgatgtgtgttttttgctagggctgtgatggctccgtgctcttggacgacaagccgttattcatcggcgagaagacggccgggccgaacgcaaactcgctccggggattcgaggttatcgacgccatcaaagccgagctcgagaacgcgtgcccggagaccgtctcctgcgctgacgtcctcgccatcgccgcgcgcgactctgtcgtggcagtaagccatatctagctaatagccaagcagatatataccacgcatgtgtgtaaaccatccaaactgtaattgttgctcacgttgtggttgtgtctttttcgaatgatcagtcaggcgggccgagctggcaggtggaagtcggccggaaggacagccgcacggcgagcctgcagggcgccaacaccaacctcccggcgcccacgtccggcgtcgccaccctcgtgcagaagttccggaacgttggcctctcggccaaagacatggtcgctctctccggtaaccaaggctcctccatcttcgaattcgaatacgttacagatagctcgcatatgttcatggattgcgtccatgcatgacgcaggcgcgcacaccattggtaaggcgcggtgcacgacgttcagcgcacgcctcgctggcgtcggcgcctcggccggcggcggtgccactccaggtgacctttcgttcctcgagtcactgcaccagctgtgcgcagtgtccgccggctcggcgctggcgcacctggaccttgtcacgccggccactttcgacaaccagtactacgtcaacctgctctccggcgagggcttgctgccgtccgaccaggcgctggcctcggccggagcagctgctgccggggcggaggacgtggccggcctcatcgcagcctacgctttcgatgcgttgctcttcttcgacgacttcgcatcatctatgctacggatggggaggctggcgccgggagcgggcaccgcctccggcgaggtccgccgcaactgccgggtggtgaactagctagctaggttgctgcatgaaacaagaaggaagctgattatgctcccaaaattaattaggagtatctgtgcatcagataattgcgccagctatatatgtatgtgtctgctagtttctcaatctagtcatgtatcgttaattagctaaaaagatgatagctggattatccattatcttaaaaaaaattaactaatggtgtctgatatttgatttgtttagttaatcagcttatctgatatatatatgactatcctgcatgtaatcgaataactatactaataaaatcgggcaagtcattttcagtcatatatattacaggatgtgatacaaataatcacattaaaaaaataaaaatgtttattgcacaagctatattctaaacaaaatttatagcgcacgtactgaaacctttagagcatcccagcagctcctctatccgattctccatccctaaattggcgcataggagcgaaaaaaccagctccagcagatgcgccatccagtcattcaaaactagcgcatgcgccaaaaccggagagagaaaggggaaatatagcatgtctctctcctcacgccatatcacaacgaccgcgctcccgcccccatccggagttcggcgacctctcctccaaagcgacctcccctccatcgttgtcgtcgccggcccgtttttgattttttttacagaggacggtggagagggagggtttagccgtggagtgagggtggagagggagaggcataccagatctagaaggagagaggggagagcggcgaggcagccgacggggagagaggggcggcggccagagtcgacgtccaggcatgcaacgnccccnatccccaaccggcgccgtcgccgctagggccgaccagcgtcgttgtcactgctcgggccgcctggcgtcgctcaccgcccggcacctccgttgccgctcgcgcctctcaagtccgccgccgcagctcaacctcaaaccccgtcaccattcttgcaatgacgctgtaggggccagtggtggagtggggattgaatgagaggggaggggaggggaggggaggggattagagaggagggaggcgagagcggaggattggaggagggagtgaaggtgcgtgtggtgtagcgaggcggtcgagggtgggggatgcgatggagctgtgcggcaagaggaaggggatcgatgaggagttgaggacctatgcagatcgattccaaccggttttgttttttattctttatacccttttcaccctttattaaggactaagtacattcagtggttgggttaatcactttattaggttctaaacaaatcagcggaagtcaattacccgttattgcgattaataacgcagattaaaatttagtagtacaaaatatatcccataaaacgcaaatatagggttagttgaaagatattattaaaatataggaggatgggatatgtatgatgtaatatagatgatctgttggagtgggaagcaatatgaatgaggaatattttttggatgaccatccatataggtatttagaggataaaatatggataagctgctgggatgctcttacaatgaaaaaggtgctaagttacatacctgcgtttcatcaatattaagcgatcaatgtcagcaaatatcatgctatctatttcaagatagataaacatgcaccgtattatgcacaatggcatacgttgtaaagaagcaagtaatcacgcggaagaaaacgagtcaatatggatagtttgtcagagaacattaattgctattaacaaatttatattgaaccaaaatatgaataaacatatcccataacttttataaattacacatatttatttacatggtgaatcattataatctaatacgaccacaataaaattcataaatgaatttgccatggttacccactttgtcgacgcactatgccagagcagctcacctctaacgacatacctgtgatgggccaaagtgatggtcattgataaccgtcacctttgatgggtcctacaggatgccgttatcagtgagccctccggctatagaccgtcataggtatcaagtcagctgttatgggccgaaaatgaaacccgtcagatgaacacctctgtcagattccacttccggcccgtcacaggtgacttgatacctgtgatgggccgtgcctctccggcccgtcagaggtgtggttcagtcacctcaaacaggttttaaccctaacctatttggggtgagttgcggtgtatatatacccctagcggccacctactttccatcccaacccaatgcattgttcacatttcgggtgggagggtgtggagtgcgatttttggctggaaatggaggtaaaaaactttaataattatttttttctaacgtatattatgcattgtgttttacactctttatgttattaattgcagatggaccgaagttggatgtacgatattcgccgttcgtccctagagtatagggagggggtcactgcattcattagttttgtggataatgacatgaaaaatagtatgagcaaatatatgttgtgtccatgtgtagattgtaataatgagaagatgttcgagaatagtttatgggttcaatctcatatgatccgtataagattcatggacgactatagatgttggagcaagcatgatgtttgatggtagtttgtacatgcttataaaatataatcacttgtatattgtgtattagggcctgtttagattccacccgaaattttacaccctgtcacatcgaacgtttgaacacctgcatgaagtattagatataggctaacaagaactaattacacagattgtgactactttggagacgaatcttttaagcataatttctccatgatttgataatatggtgctatagtaaacatgtgtcaataatggattaattaggcttaataaatttgtctcacggtttactgacggatactataattagatttttttattagtacccgaacaccccataaaacacctatataatacccgatatgacacgccaaaactttacaaccctatatctaaaaaccccttaatggttgattgcaagaaacaggtcaattagctaggtagcgattccaacgtcatcacacaagctaattaattaaatgattcatgcatgcatgtacgtacagaggtggcctgacatttggtcgggtagatgtgccgtttttttttgacaaattgaaccttttcaaaaacttatttcgaaactaacccctaccaaaaacttcaaccaaaaatagggccggtcgctcagcgccatgcgcattg

SEQ ID NO: 26592 - DNA, 387 bp, Oryza sativa
tgggacgttagcgccagccataatggcgctggccctgggcacctcagcgccaaggcacctagcgctaaggttggacttagccggctcggccatggcccagcccagcaagccttttggatggctgggctgggagctcagcgccaaggcgtctggcacgggcctggagtatgtcagcgccattttgcctggcgctaaggttccagacctgctgtaataagcagcacagctctctgcccagtcctgcttaacacaaccacaccataataaagccggaccaatctatccatctacaatatttaacccatacataaacattaattaatttgaaaataatctctaaataccataacaatcccaaaagggtaccgagctcgacttcgccctata

SEQ ID NO: 26593 - DNA, 773 bp, Oryza sativa
  unsure (1)..(773): unsure at all n locations
atcttcgccagagaagatggttggagctcatcaaggattatgatgtgggaatccactatcaccctggtaaggccaacgtggtcgctgacgcgctgagtcgaaaaagccgttgcaacactcttggcgtccggggcattccaccggagcttaatcaacaattggaagccctgaacctaagcatcgttagccatggattcttggctacgctggaagccaagcctatcttgctcgatcaaatccgcgaggctcagaagaatgatccagatatgcatgggatcctcaagaatatgaaacagggtaaagccgctggtttcacagaagatgaacacggaactctatggaacggaaatcgtgtatgcgttccgaatgacaaggaacttaaacagttgatacttcaggaagctcacgaaagtccttattccatccaccctggcagcacgaagatgtacttagacttgaaagagaaatactggtgggttagtatgaagcgggaaattgcagagttcatggccctttgtgatgtgtgccaacgtgtcaaggcagagcaccaacgaccggccggacttctccaacctctccaagtaccggaatggaaatgggatgaaattgggatggatttcatcaccggacttccaaaaacccaaggcggatatgattctatatgggtagtcgtggaccgactaaccaaggtagctcggtttattnnnnnnnnnnnnnnnnnnnnnnnnnnnnnnnnnnnnnnnnnnnnnnnnnnnnnnnnnnnnnnnnnnnnn

SEQ ID NO: 26594 - DNA, 755 bp, Oryza sativa
cttaacccaaggcctacgatgattcggaccgaactggcaacccgacctgggttccagctcgtcccaagccaacccaagccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatattttccaacccatcctagccataaacaagagtaccgacccaatcctgcctacggccgggatacccgggacaggcaggcagaactgagcccctagcattgggcaccaaccctccgccgtatgacatcttgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggagaggtgtgtgtccaattgcaggcatgcaagctacagttccaaagtgtccaaatgatattagaattcccaa

SEQ ID NO: 26595 - DNA, 4021 bp, Oryza sativa
  unsure (1)..(4021): unsure at all n locations
nnnnnnnnnnnnnnnnnnnnnnnnnnnnnnnnnnnnnnnnnnnnnnnnnnnnnnnnnnnnnnnnnnnnnnnntataaaacctatttaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattactcggttcctggtcctgcgctccatggcgtccaggattttcactggcttctccacataggtcaagtcttcgcgaacttcaatttgctctgagtcggcctgctcggatggcactcgaagacatttcttgagttgagacacatgaaacacatcatgcacgttgcccaaggaggcgggcaactccagctggtaggcgacttctccgcggcgagcagtgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttccccaacttggtcccacaggagcggtgtccggcatttgcgcccgtacaacgcttcatatggtgccatttgtatgctggcttggtagctgttattgtaggagaactcggcataggggagactcttatcccaagtcttcccgaaatctaggacacatgcgcggagcatatcttctaggatctgatttagacgctcggtctgtccatctgtctgcgggtgatatgcggtgctgaaatttagtcgggtaccaagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctaccttggttaatcgatccactattacccatatagaatcatacccaccttgggtttttggaaggccggtgatgaaatccatcccaatttcatcccatttccattctggcacttggagaggttggagaagtccggccggtcgttggtgttctgccttgacacgctggcacacatcacatagagccacaaactctgcaatttcccgcttcatgctaacccaccagtatttctccttcaaatctaagtacatcttggtactgcccgggtgaatggaataaggactttcgtgagcttcctgaagtatcagctgtttaagttctctgctatccggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggctgggcttctagcgcggccaaaaatccacgaccaactatgtttaggttcagggcttccatctgttgattaagctcgggtggaatgcctcggacgttgagagtattgcaatggctcttccgacttagagcatcggcaaccacgttagccttaccagggtgatagtgaattcccacatcataatccttgatgagttctaaccatctcctttgccgaagattcagatccgactgggtgaagatgtatttcaaactcttatgatcagtatatatttcacagcggttcccaatgagatagtgccgccagatttttaaagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggcgaggaaaccagcttttctttgagagtttggaacgccttctcgcattgcgggctccacacaaacttctcttctttcttcaacaactgtgtcatgggtcgagcgattttggagaagttctcgatgaacctccggtagtatcctgccaaacccaagaaactgcgaatctgagtgactgtcttgggttgcttccaatcggtgacggcggtcactgtttcggggtccacagcaactcctttagcagatatcacgtgccctaaaaatttgacttcggacaaccagaactcacacttgctaagtttggcatacaattgatgttcccgcaactttcccaacaccagacggagatggggctgatggtcttcctctgattgtgagtaaccaaaatgtcatcgatgaaaaccacaacgaacttatccaagtattccatgaacactttgttcatcaagttcatgaagaaggcaggagcattggttaagccgaacgacatcaccgtgaattcatacagcccgtatcgcgtagtgaatgcggtcttcggaatatcttcttcacgaatacgtaattggtgatatccggaacgaagatcaatcttggagaatacagtggcacctttgagttggtcgaacagatcatcgatccggggaagagggtacttgtttttgatggtgacttcattgagagctctgtagtcaacgcacatcctcttcgtcttgtctttcttctctacaaagatcacaggagcaccccatggggaagtactcggacgtatgtaccccttttctttcaattcttccaactgtgtctttacttcggctagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttggaggtgcaaagaaaacaaccggctgttccggccctcggtacagagtgacagtgcgcctcgcgcaatccactaccccttggaattgggccaaccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggannnnnnnnnnnnnnnnnnnnnnnnnnnnnnnnnnnnnnnnnnnnnnnnnnnnnnnnnnnnnnnnnn

SEQ ID NO: 26596 - DNA, 5147 bp, Oryza sativa
tacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccctcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgcttgtgtggtgtaccccggcttttcctgggacggggattaatacactggcgttcgggaaaaggcaattttcccggtcgcgacactgagcctcgcggatttgatcgagcaaggtgggcttggcttccaacgcaaccaagaatccacgacccactatgcttagattcagggcttccatctgttggttaagttcgggtggaatgccacggacgttaagagtgttgcaatggctctttcgacttagagcgtcggcgaccacgttggccttaccaggatggtagtgaattcccacatcataatccttgatgagttctaaccatctcctctgccgaagattcagatccgactgggtgaagatgtatttcaaactcttatgatcagtatatatttcactgcgattcccaatgagatagtgccgccagatttttagagcatgaaccaccgcggctaactccaaatcatgggtagggtagttgccttcatgaggccgtagctggcgtgaggcataggccaccacatgaccatcctgcataagcacgcaccccaatccttggcgcgaagcatcacaatacaccatgaaatccttgcgagtatctggcaaggttaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgcaaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcatcaatgaacaccacaacaaacttatccaagtattccatgaacactttgttcattaagttcatgaagaaggcaggtgcattggttaaaccgaacgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccctagggggaagtactcggacgtatataccccttttctttcaactcttccaactgtttcttgacttcggccaattcatttgctgccatacggtagggtcgtttgtacagaggagtggttcctggagcaagatctatccggaactcaatctctcgcttgggcggcataccgggtagttcttccggaaacacatctccgaactccctgacgatggggatttctgacagtcctatctgatgaagttctgaactactgacagaggttgggggtgcaaagaaaacaaccgattgttccggccctcggtacagagtgacagtgcgtctcgcgcaatccactactccttggaattgagccatccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtgaagccgaagaaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaagggggctctgataccaacttgtcacgaccggaaataacccaacgggcgttccttacgtgcgtgtattattccttgtcccaggaggcaaggtacaccaaaagttgatacatttcagagtttaacaagcgggg

SEQ ID NO: 26597 - DNA, 3703 bp, Oryza sativa
gatccgcccgccattgatgcgccggcgaggttagggggaaagtttccgaatgaatccgagggagagagggagggaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggagaccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagtcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgctggggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgtcgacaccacagcctttttggggatttctctcatagatgacggcgagctggcgaagttggtcagctctggggtgttggttgaggggcaggctttcgcccctgggaaggccgtggtaccgaagcccgtcgacaaccagacggtggtgttcgccggcttttttgaggcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgagcggttgaaaaccgcgccgagacccctggctacactcctactccaagtccagggcataaccagaccggg

SEQ ID NO: 26598 - DNA, 2875 bp, Oryza sativa
gccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttattcccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagct

SEQ ID NO: 26599 - DNA, 929 bp, Oryza sativa
gcttttgtttcggtgtgagaactaagtgccttttctgtaagtatttacgcttttattgacgttcgggactgtaaattacttgtcgttttgtggaccctgggtggtcctggacagggatttaatacacaaaatagtttggaaatttgggctaaatttctgggcgtgacaaagtggtatcagagccaacttgactgtaggttgagccaaatggtcaaaccgtaaggacaagttttttgaaaatcctatttgcgaagtgtctcctctcgcccttcggcatttctttgcgaaacagtttattaaaatttttcctccctgtccctccaactcttttagttgtcaaacatggaggagaaaccgccagcttcatgtctgttcggaagtcaattcaagcctcaagcttcgtgcagtaggagcaagaagttcagcccggagtcgtcgttccgcgaagatcaagtggagttttcccggagatgacctaaacccaatccttccctgaagagtagtttcgttagcttctagatcgtgtgttgtttgcttgtgtgtaggggtatggtttgcatcattggtggggatgcgaccatactaggttgtttgcttaagcaacttgaaaaataaaaatctactcacaacagatcagtaggcaagtggcttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagc

SEQ ID NO: 26600 - DNA, 685 bp, Oryza sativa
gaatggaaatgggatgaaattgggatggatttcatcaccggacttccaaaaacccaaggcggatatgattctatatgggtagtcgtggaccgactaaccaaaggagctcggtttattcttgtaagaccacctatggagggaacaaattagctgaactctacttcactaggatcgtgagtctccatggcgttcctaagaaaattgtatctgataggggaagccaattcacctctcacttctggaagaagctccaagaagagttgggtacccgattaaatttcagcaccgcgtatcacccgcaaacagatgtgcagaccgagcatctgaatcagatcctagaagatatgctccgtgcctgtgttctagattttgggaagacctgggataagagtctcccctatgccgagttctcctacaataacagctaccaagccagcatacaaatggcaccttatgaagcgttgtatggccgcaaatgccggacaccactattgtgggaccaagttggggaaagccaagtgttcgggactgatatcctgagagaagctgaagctaaagtcagaaccattcgggataatctaaaggtggcacagtcccggcagaagagttatgcagatacccgacgccgtaacctggaattcgcagtgggcgattttgtgtaccttcgggtcacgccattgcgagg

SEQ ID NO: 26601 - DNA, 664 bp, Oryza sativa
ccccgtggccctttgtgatgtgtgccagcgtgtcaaggcagagcaccaacgaccggccggactcctccaacctctccaagtaccagaatggaaatgggatgaaattgggatggatttcatcaccggacttccaaaaacccaaggcggatatgattctatatgggtagtcgtggatcgattaaccaaggtagctcgatttattcctgtgaagaccacctatggagggaacaaactagccgagctctacttcactaggatcgtgagtctccatggcgttcccaagaaaatcgtatctgataggggaagccaattcacctctcacttttggaagaagctccaagaagagctgggtacccgattaaatttcagcaccgcgtatcacccgcagaccgatggacagaccgagcgtctaaatcagatcctagaagatatgcttcgcgcatgtgtcctagatttcgggaaagacctgggataagagtctcccctatgccgagttctcctaccataacagctatcaagccagcatacaaatggcaccttatgaagcgttgtatgggcgcacatgccggacaccgctcttgtgggaccaagttggggaaagccaagtgttccggactgatatcctgagagaagctgaagctaaagtcagaaccattccggataa

SEQ ID NO: 26602 - DNA, 726 bp, Oryza sativa
  unsure (1)..(726): unsure at all n locations
nnnnnnnnnnnnnnnnnnnnnnnnnnnnnnnnnnnnnnnnctagagaaagatctatccggaactcaatctctcggttgggcggcacaccgggtagttcttccggaaacacatctccgaactcactgacgatggggatttttgacagctgtcacgaccggaattaacccaacgggcgttccttacgtgcgtgtattattccttgtcccaggaggcaaggtacaccaaaagttgatacattccagagtttatcaagcggaagcgtaaatagttaatttattacatgggcggcgaaggcccagcacacacaaagacaaacgggaaacggcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgtagaataaatgcaagggagtacaagagggttatagtataaagggttagggtttgcagtaaacagcattacaagacacttagttgctcaaagctattttgtaaatatgattctagagctatacatattattaatcaaggccgtgaacccacacgagcctgccttaacccaagggctacgatgatttagatcgaactggcaactcgaccctgggtcccagctcgtcccaagccaacccaggccaaccatt

SEQ ID NO: 26603 - DNA, 5829 bp, Oryza sativa
  unsure (1)..(5829): unsure at all n locations
nnnnnnnnnnnnnnnnnnnnnnnnnnnnnnnnnnnnnnnnnnnnnnnnnnnnnnnnnnntgtgacttgtcttgctcgctttcccaaacgccggcttcaacttccacgaagagcggatcttccgaagctgcagcgtctacacgaccaatggaaaagaaaaggcttttactctaataaactccatataaccagcagaaacaaagcacaaaaatgggttcttgacttcttaaggaaaaattagagacttgaacggtccaattccgagttcaaatggccaagttatggccatttgaagtttatatgctctttaaatggatttgcgaatttcttcatttaaattttaatttaaaaattggatttattgcgtcagccgaggggaggggcgcggggaccgggtccacgggggtggggcccacgcggcagccccacggtccacggtggaccgggcgcacccgggctcgcaccggccgacgccgtgggtcccacgcgtcagccgcacctaagggcgtgggcggctgacagccgggccccacacggcagccgcggggcgcgcccgaaggcggccacgccggcacagccgacgggaggcggcgcgtgtaacgtcccgcctcccccaggccgggccaacttacatctgatagctttcataggtcatagactgccctcacagaccaacacatgtcttttctgcacactttgtcctcactcgtgtgcacccggaaagccccgcgcccgaaggcggccacgccggcacagccgacgggaggcggcgcgtgttacgttccgtcttccccaggccgggccaacttacatcagatagcttttataggtcatagactgccctcacagaccaacacatgtcttttctgaacactttgtcctcactcgtgtgcaccccggaaagaatttcccggtcggtcacccatcccaaattgctgcaggccaagcacgcttaaccctggagttctttggagattggcttccggaaaagaagttgcaacttattggtatgagtattctattaatcctattaagccctaggccgggatgttacaacgcgcccgcgcccctatggtcgccgcggcggccataggtacggcggagcggcgcccgagagaggggagggaaggggaaacgaatcggcggtccacggctcaccccgggtcgacggcgacgacgggaacggcgaccggagcggaggaaggcggcggcgcggcttgggtggacggggtcgacggtgctccggcggtcggcgtgcgaaacggaggggtggacgaggtcggtgaggatgcggcgaagctgaaggaggcggccccgagggggaaggtggtccggggcgacgacggcggcggaccggagctcggcggcgacggcggagagagagagcgacggcgcgagctcgattccggcgagagagagaggccggcgagtgccgcgaaaccggtggagggaggcacggggagggtttatatagggttaagagagggagggggtggccggaggagggggaaacgggcgcgggagtcccggccgccattaatggcgccggcgaggttagggggaaagtttccaaacgaatccgagggagagagagagagggaaaaatggggggaaagggggagggaatcacggggaataattcccccctcttgattgcacgcggggcggacgggggcggcgggattcacggcggcggcggcggcgctagggcgcgggcggcgggagcggcgggaggaaggggatgacgggtgggccccacccgtcagcgagggtggcgggcgggccctcccgtcagcggcgcgtgcgcggggaggaggccgaatgggccgcgggggagaggagagagagggagagagatgggccgagccggcccaagagggggaggggttgaaaaaaagactttttagggcttttctttttataaaacctttttaactttgtttatttcttaataattattatttgtgctctgaaaattccactaaaatttatttacgcattttaggcttttatgaaatatacaaaaatcctccaagccttatttgacttttaactttgcacattttaattgttggaggctttcacacggattttaattattctaggcataatttagaggatgtattttagggtcgttttgggacgtgacaacagtcctatctgatgaagttctgaactgccgacagaggttgggggtgcaaagaaaacagccggttgttctggccctcggtacagagtgacagtgcgtcttgcgcaatccactactccttggaattgagccaaccaattcatcccaaggatcacatccaagttcttggtgtccagaagaatcaaatccgagggaaaagggattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcaggaatagaatgaatgaggaacgtacccacgatgacatccggagtcgtcagcacatcctcggcagtcacgtggttcacacgaccccgaatgacatccttaccaccgtggtttaggcggggaggcgcttagccttgctggcgccaggtgcatgatggtagcgtcatcctccgagctagcatccctaaaggttgcgtagtagcgggctcctccgtgacgagggtggtagcggtagggcgagtgctgcaactcgtccgggtagcgctggtgaagagtgccgatggcgaggagtgcggcgttctggcaagcgccggagaaagaatctccatccgcggtgactgccaacgaggtcctctcgggtgagcctgtgaggatcactgcagtgacctcccaagcagcgtggggctctgcatcgtcaccctcctgctccgggagttgcttgccctggtactccactccatgcggataccccaagacaacgcacatgccccgcagctccaaaatgaagccagtcaggtccagacgacgacggttgatgctgccggccatctacaaacaaaaacaaaagagaaaagcaacattttaaaggtcagatattgacgataaatgaagcagcaggacagagagagactagaggattttcacaaataagaaaggatttttatttcaaaaatattgctaaggcttgggatctaaggctcgtcctagggtcaagggggctctgataccaacttgtcacgaccggaaataacccaacgggcgttccttacgtgcgtgtattattccttgtcctaggaggcaaggtacaccaaaagttgatacatttcagagtttatcaagtggaagcataaatagttactttattacattggcggcgaaggcccagcacacacaaagacaaacgggaaacagcggaagactagggcgatgaccacaggcgcttgacagcaggcacgagctagacaccaaagccttcatcttccaggaactcctcttctgggtttgggaaaaaattgagcaagactgagtacaaccaccgtactcaacaagacacacccacaagtgaaacataaatggagggagtacaaaggggttaaagtatacgggttaggttttgcagtaaacagcattaaagacatttagttgctcaaagctattttgtaaatacaatcctcgagctatgcaacattattaatcaaggccgtgaacccacacgaacctgtcttaacccaaggcctacgatgattcagaccgaactggcaacctgaccctggggtcccagctcgtcccaagccaacctaggccaaccattccacattttagttgttaagcaggctttaagaattaaaacactaacttgggtacattgctagggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgagacaggtaagcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccaaaaactaagccttacccactagacatgtggaagtacggtagtgctttgcaacagaggcccgaagaccggtccttatatggccgaggtgctactatcaaaaccatgcaccccgagcccagcctaatgttataaaaccacctaatgttgcctaattaagcgacgaagcatctacctaaattcatactagtggtaccatgagtagaatgcccactagttggggttttgtttattctagggtgaacaaggtaataatatcaataacaataataaggtcataacaaaggtaaataggcatggctaaataaaacagtgataacgcgggaatttaaataaaacgataatgcattaatttaaatcaaaataattttataaactgggattcaatatattcaaggatgatgtgacttgccttgctcgctttcccaaacgtcggcttcaacttccacgaagagcggatcttccgaagctgcagcgtctacacgaccaacggaaaagaaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagagggcgcgcggaccgggtccacgggagtggggcccacgcggcagcctcacggtccacggtggaccgggcgcacccgggctcgcaccggctggcgccgtgggccccacacgtcagccgcacccgagggcgcgggcggctgacggccgggccccacgcggcagccactcggcgcccccgggggcggccatgctggcacggtctgcgggaggcggcgcgcgcgcccctatggtctccggcggtggccataggcatggcggagcggcggccgagagaggggaagggaagggggaaaagaggcagcggtccacggctcaccctaggtcgacggcgatgacgaaaaaggcggccggagcggaggaaggcggcggcgcggctcgggttgacggggacggcggcgctccgtcggtcggcgagcttgacgagggggtgaacggggacggcgacggtgcggcgaagccgaaggaggcgacgccggggcgggaaacggtccggggcgatgacggcggctgatcagagctcggcgacgacgatggagagacagagcgacgtcgcgagctcgaatccggcgaggaggaagggcggcgagaggcggaaacggacagaggaggtgcggggagggtttaaacaaggttggaagggggagagggcggccggggaggaaggaaaccggcgcggcgttcttgggctccatcattggtgccagcgggattaggggaggggttccaaacgaatccaagggagagagggagggaaaattggggggaaagggagnnnnnnnnnnnnnnnnnnnnnnnnnnnnnnnnnnnnnnnnnnnnnnnnnnnnnnnnnnnnnnnn

SEQ ID NO: 26604 - DNA, 2360 bp, Oryza sativa
aaggggactttttagggttttttttttataaaacctttttaactttgtttatttcttaacaattattatttgtgctctgaaaattccactaaaatttatttacacattttaggcttttaggaaatttataaagccttatttgacttttactttgcacattttaatttttggaggctttcacaaggattttaattattctaggcataatttaaaggatatattttagggtcgttttgggacgtgacaaacctacccccccttaaacggaatctcgaccccgagattcggaagaactggcgaagagatcgggatgggctgccttcagctcgtcttcacgttcccaagtagcttcttcctcggcgtgattgctccattgaaccttgcaaaaacggatgacccggttcctagtcctgcgctccatgctgtccagaatcttcattggcttctctacataggtcaagtcttcgcgaacttcaatttgctctgaatcggcctgctcggacggcactcgaagacatttcttgagttgcgacacatggaacacatcatgcacgttgcccaataaggagggcagctccaactggtaagctacttctccgcgtcgagcaatgatgcggaaaggatccacaaacctaggtgcgagcttcccttttgtcctcgcaatggcgtgacccgaaggtacacaaaatcgcccactgcgaattccaggttacggcgtcgggtatctgcataacttttctgccgggactgtgccacctttagattatcccgaatggttctgactttagcttcagcttctctcaggatatcagtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatcggtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagtgtcacgtcctgataaatccattccgaattaaaattcgttttcctaaaaggaataatagaattaattaaaattcgaaaagaaattggcaaacactaaaatacgtgcaagaaaaattcaaatgtgacccggagaatttttgttaaattctccttggtctaaaatgagccctcaaattttacttgaattttcagagcaccggaaatatttattaaacaacaacaacaattatcaaagttcaataaaaagaaaatctaaaaataatcctcctcttcctcctttgggccaagcccacccgaagtccttctctcctccctctctttctctccctctccttctctccctcctcttgggcccccttcccctcccggcccactccctcctcctccctctctctcccgggctgcctcttttccccccccctcccctcccggcctgtccggcccaggccgcctccccctcctcccctcatgggccgtgtcccggcccagccgggcctctcctgcccgagccgcccctcccccccccccgcgcacgtgcgccgcgcgtgcgctgagagcgcgcctggccgcgcggggcccacgcgccaggccgccgtcgtcttcttcctccgcccggccacctctctctctcttcccgtgaaaccctactcccttcctccctcaaatccgtgtgattcg

SEQ ID NO: 26605 - DNA, 585 bp, Oryza sativa
cgacgctgctcgcccactgcacccacagctcgattcgactcctcgccgaatagtttgagaatggaaggggttcagcgagagagagagaagtgttgggagagagactcattgcgttgagattcccacataacacgtgccacgctagtaacgaagtccttttgacttggtaaaggacttgggtcttgtgtaattttcttccctggtcgtggccttgacctcctggcctaacgcccatgacagaggatcagtagcttcattgttactacctccagatggtattatttgatgctttggacaaagaaaatggcttgagtttgataggttttggctgtcgaaacatcgagttatctttaccggagggagtaataattgataactaaggttttaagtctaataaaaatattatatgtgatcattgatttttcaaatcatatctacataaaaatattgtaagaatgtaatgtatgtaaggttttttttataacaaatctacaattgatatttttgacatataaaatcctagtacttttgcatatattattgaattgaagctgaccacatgcattctaggatgtgatctatttg

SEQ ID NO: 26606 - DNA, 510 bp, Oryza sativa
tttagatcaaccaaccaaggaagaatttgaaatttaagtctacagaaattcaaaagctacttcagttgagtaatcaaaatagtgaagcgatgttcaagattagtatagtagtgtgtgtgcatacctacttgatttctctcaaagttaaacattgtctttcagtataccaaattgttgtagagctgacttaaggttatctggaccatatccctcgattgaagtaattcctggtttgtcaaaggatatgacatcctgtaatgaataacttctggcagcatggacttggttaggaacagcattaaatgagcctttgagaataatggtcttgtgcacgcctcctaatagtccttcataatcagtatcaccactttcaccaacaaccactgtcatatttgacagctctaccccccatcttatatacaagtacctacaagagagcaaacatagattgtcacatccgtagtatagggaagctgaaaaggctgaaaacaaagttgatagatgatactg

SEQ ID NO: 26607 - DNA, 1017 bp, Oryza sativa
  unsure (1)..(1017): unsure at all n locations
cgtcacagtacaccaggaagtccttgtgagtatccggtaagaacaacactggccaagagactagcttttctttggaaagttgggaccgccttttcccttgggggccttcacacaaatttttctacctttttcagcaactgcgtcatgggtcgagcgattttggagaagttctcgatgaatcttcggtagtatcctgccaaacccaaaaagctgcgaacctgagtaactttcttgggttgtgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaataggttttataaaaaagaaaatcctaaaagaagttctttttccccccccccttccttcttgggccggctcggcccattccctccctctctctctctctttcctcccgcggcccatcggcctccccgcgcgcgcgcgccgctgacaggcgggcccgcccgccactctcgctgacgggtggggcccacctgtcatcgccctcctcccgccgccgccgcgcccgtgccctagcgccgccgccgccgcgaatcccgccgctcccgtccgccccgcgtgcaatcaagaggggggaattattccccgcaatcccctctcccgattccccctctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26608 - DNA, 874 bp, Oryza sativa
cacacgagcctgccttaacccaagggctacgatgattcagaccgaactggcaacccgaccctgagtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaacaattccatagtgtccaggtgatgagaatatcccaaagtctagagttgtaaaaccacctaatgttaccaaattaaatagcgaagcatctacctaaaatcatactagtggtacgatgagtagagtgtccactagttggggttttgttta

SEQ ID NO: 26609 - DNA, 940 bp, Oryza sativa
  unsure (1)..(940): unsure at all n locations
nnnnnnnnnnnnnnnnnnnnnnnnnnnnnnnnnnnnnnnnnnnnnnnnnnnnnnnnnctgtatagtatatcgcaataaggccggtgcttacagaaggcactgtgtgcataacattgttttgttgctcaatcggaatattttgaagtattgcttgggtccggtcgtccggagactccggatatgttcacctgtttgaggtttcaccgttttggttggttcgtctcagctctccttcagactactgtaagttctcgacaaatgttcactgatataaaaaccaaatacacaacccccctaggccaagcggttcatgccttcatggtttctgtgaatcatatgacgcagatatcctcatcccattgcaaaatatatttttttagtgaaaattaacaaactagaaaaaccaaattgaaaaactataccctacaaaacacgtattctttagatcccgttgcaatgcattccaagggcatagccacatcgcactatattcaaatattagtgttctacgataacaaacaatgcggggatttagttttttgttttgttaactaaatctatgatagctgaacggtcaatgcggttgccttttttttttctggcctttttttttctgtattgaaaactcatgtactacctccgtttcatattataaaactttctagcattgcccacattcatatagatgtcaataaatctagacacatatacatgtttaaattcattgacatatatataaatatgaacaatgctagaaaatcttataatatgagacggaggaagtatttatctatgctttctatataagtgagaccacaaacaggcactacgtctagtgacatcatcaaaatagttttaactgttggatcgacaagtttttcaggattaaccgttagacaaannnnnnnnnnnnnnnnnnnnnnnnnnnnnnnnnnnnnnn

SEQ ID NO: 26610 - DNA, 6449 bp, Oryza sativa
agattaggtggagtccttaagtcaattgtaatcaaggaatgaatcaaaatatactcaggcaacctttaggcaaaatatgaatctcttgagttcttctcgccaacctttagtcttcactcatcccaaccaagctcgggtgtgtgggtttcctaccaacctttactcaggactctttatcctctccttaatataatgatacacagatctcctgcgtgttcaaggcaaaaaaaaagccaacgtcgtctggctatcttaccagcggtgtttatcccccaataaaaccttgcctataacacccactatagtgttgtggatgccacaatttgacgaaactactaatgttggcttatttgcatcatcttagatctcgacacccatgtatcaccttaagtttaacgaagcaaacaaattaagtatttacaagttttcatgcctaaatagcccaacaagatgtgaggtcatcagacacatcagatgctggacagaaagggtaggattgtgacgagagggagctgggctatttgtttgccgaggctgcattgtgaggagtgctcagcgcgaccgagcagattgcttggtacagtaaagaggtctcggcgcttttagttcggggtttgattgattggaagttatgctctcaaatatacagctctgcttttattttgtcaccttctgttgtgttgtcaattattatgcttttgaaatttgaaaatctaattagctagcacttctcaactgaatgtcatccaactagaactgatttattttatttcattttatttatctagttatggtagtgcatgttctacatttgttgttgatagaacaaatagtccaactgcagtggacactgtttatgattttgaacacagttctgtcctgattcgttgtactaggatgtgttacatccagttctagattcgttttttatgggacggtgagagtaattgattttgaacactgtttatgatttatttatgatctatacgcctatacctagttaaacatgtatctacttcacctacaaagtaaaatggaccgtactaatcttaactttttaaaataacttaatcttacatgtatctctatctcagagcaatataacttgaactacaaacttactgggtcttagcctgcggaactcctaaaattcctccgccatcctttgatgcaagaggatttaatttggtttagtagttatgtcttttgaaacaaaaatgggccgtcacacaacgctgaaacggttaataatactatttgtttgacttattctaattttttgcagtttcaagtagcatttattctacgtgatcgagattgagaaacgagcagtagggctccctctctgcggttctatatcatctcacacggcaccaataagctttgcaccctggtgaacattgggctatcgttctatggcccttgctgcaaccagagatgggggatacagacttgcttctgtttatccaatgtaaaactgatgatgatgagttctctaactgtatagtatatcgcaataaggccggtgcttacagaaggcactgtgtgcataacattgttttgttgctcaatcggaatattttgaagtattgcttgggtccggtcgtccggagactccggatatgttcacctgtttgaggtttcaccgttttggttggttcgtctcagctctccttcagactactgtaagttctcgacaaatgttcactgatataaaaaccaaatacacaacccccctaggccaagcggttcatgccttcatggtttctgtgaatcatatgacgcagatatcctcatcccattgcaaaatatatttttttagtgaaaattaacaaactagaaaaaccaaattgaaaaactataccctacaaaacacgtattctttagatcccgttgcaatgcattccaagggcatagccacatcgcactatattcaaatattagtgttctacgataacaaacaatgcggggatttagttttttgttttgttaactaaatctatgatagctgaacggtcaatgcggttgccttttttttttctggcctttttttttctgtattgaaaactcatgtactacctccgtttcatattataaaactttctagcattgcccacattcatatagatgtcaataaatctagacacatatacatgtttaaattcattgacatatatataaatatgaacaatgctagaaaatcttataatatgagacggaggaagtatttatctatgctttctatataagtgagaccacaaacaggcactacgtctagtgacatcatcaaaatagttttaactgttggatcgacaagtttttcaggattaaccgttagacaaaagtcccctccacttcttcaccaattaaacaacgtcattaatcaccaccctatctaaatgctatatatttaatcaggtactcaattggacaataatacaaccaagatatcatatcatatttactattcccaaccatcattcaatcaattttatatacatatactaatagaaatatatgtatatacaagaaaatagaaatgagaattgcttagtaatttccgcaggaatcacttagttcaatatatagtattgagtgatttaggcctctctcaaagagagattcagttgctcttagtagaacaagcaggtagaagtataacacaacttgcaaaagattcttgaaatatgcagataaggactccaaaagaaaacagaaaagcaatctagcctcgtttcgcttcttctcctgattcagtgacctagacaatgaagccgacaacggctacggcgaaaacgaggtcgactgcaaaagattgcatcgagccgcaatacgggccttgcaaaatcggatgttgaagcgaactctatgaacatgagaactttcggtcgaaccttggagatgcctcgtcggagacaacacatgcccaatagtaatcgactaaactcggtagggtccaccatataccaagtcttatatagaaccgcatctcgtatatagaaggagtttccgataagaaaggacaaatagagttcaagttagaaacgaccaggactacttggatcgtatccatatttatctctctagttctacttagacaaggagacatctatgggtataaatacaagaccccctaggaggagaggggacacacaagccagaacaaaccaatacgccgccaaacatcgacatcagaattagcctagacagacccaatttggtgcatgcggaggccgacaaggggatctagcgctacctctaatctcgacgagttcgtacttgaggaggaagactaccctgtcgtcgactatgtgttggtgatccatgccgccaagtcaacgacagctagataggttatcccaattattgtacttgtatgattcggatgaacaaagagcaacaccggcttcggccaataggagtagggttgttaccttcttgtgaaggggcccaaacctgtataaaaatccttgtctatgtctcttttacctcaatctcacatataccctggtaccaacgacccccataccatgcaaataccataatcatgacctaaaatgtcgacagtggcgcgccaggtaggggaattttggtgctccaaggttttgacgagatgggttcaagagatggattctctgacaacaaactagtcgacgacttcggttgccttcaggtggtcgagagatgcctactcctggttttcgaccagtcggttgtagtgatttctctccacctattagttctctttaggtgattcagagatgcctcctcctagttttcgaccagtcggttgtagcgatttcttgccacctatcagttctcttcaggtgattgagagatgcctactcctggttttcgaccagtcggttgtagcgatttctcgccatctatcagttgtctataggtgatcgagagattcctactcctggttgtcgactagtcggtcatagcaatcttccgccacctatcactcaacttctattagtctagacgatgactacaactggtctttcgaccagtgacgtagcggtcctcgcacctcaactcctagtggttgaggtatgattacagctggtcttcgatcatcagcggcgtagcgattctcccactacctctatgatttattgaatacaactacacactcggtcttcgccttgtgtggtagtgacctcatcaacccatttgcgtcaaattctgtaagtgtttgtatgtgcaatatttttccgttgatccccttttcttatatcgccctatcttgaagtcgtcctattattcctttacgctattctaaatgcatattaactaagccgtgtaatcgggaattggctttcccaacttcatggctaggggctaggattttgttagcttcaacttggtttgttataagatttaagctgcctttgtggaaaaatgacttttccataaagacaggtgagggctaggaagtgtaccatactccaattattgagtacagctttagctagaatactcttttattgtcacatgcaaattcaatttattttcaattttcaaattcatattatatcgtgttacccttgagcgttcgctcgggggctatttgtatctaacaatttgttttgagttttgatttcaggaatgtcagacttcagggctttgtcgcggactttataactactcgattactcgagaatggttggtggagttcgacaaggattacggaataaagtaacgctgtacccgctgagacaaaattttctgacttcaatccaaattcttgattacggcaagataaggaattaagtcacattctcctcacctcctcggttgtccgagaatggttaagcgagcacaaaaactgatattccaaggtcttcggttgagaacatcaagtcgatcatttgcattgaagtcggaggcttctatcagggttatgaatagcacatatccaatagtaatcgactaagctcagcagggcccaccatataccaaatcttatatggaatcgtacctcgtatatagaaggagttccggataaggtaggacaaatagagttcaagttggaaacgataaggactactcggattgtatccatatttatctccctagttctacttggacaaggggacatctatgggtatgaatacaagaccccctaggaggagaggggacacataagccagaacaaaccaatattccgccaaacatcgacatcagatattagcctagacagatccaatctggtgcctgcggaggctgataagggggatctagcgccacctctgatctcgatgagttcgtacttgaggaggaagactgccctgtcgtcgactatgtgttggtgatccataccgccaagtcaacgacagctagataggttatcccaattattgtacttgtgtgattcagatgaacaaagagcaataccagcttcggccaacaggagtagggtcgttaccttcctgtgaaggggcctgaacctgtataaaaatccttgtctctgactcttttacctcaatctcgcatatactctacctcaatctcgcatatactttagtaccaacgatccccatgtcatgcaaataccgtagtcatgacttaaaacgtcgacaacatcaaaccagtagcaacaaccccaccggagatgatttgaaagaacggcgccacttcatcgttgtggaggaagaagagttcccaccacaaggcaaatctgtttgacatgtggatccaaacaccagtacaaacctccatagcaaccctgcgaacagcacaaagctccgtttaacttctttcgagttgtatacaaaaggggaagaagaaaacctagaacgagataaactcgatatataggctgcgttctttcccacccccaacagtgctcacggaaaacggagcgatccattagcacatgattaattaagtatctgctattttttttaaaaaaaatggactaatatgatttttttaagtaactttcgtatagaaactttttacaaaaaaatacaccgtttagtagtttgaaaagcgtgctaacggaaaacgaggagtaatagcctgaaaagaacgcagccataatgggtataaacccgatagcacttggcaaaccgtgacataatataatgcatgtagctctaggccaaccacgtcataaaaatgataccaaattacacctgacttctatggagaaaaaaccagttttagagaagtcatgaaagcatgctattggccagttttaaaaattactgtgcatagcaatgaattttaataaaaaagttcttttttgcagcgagcaaaggaattttgaaggtattaggttaacacagtgcatatatcacaaaaatgagtatgcttaagtccctataagacatacagctccaccacacctgaaaacttaagcgtgtagcatgcattttaatctactctcgagtgacaaatctcccggatggtgtagactaagtgcatcttatccg

SEQ ID NO: 26611 - DNA, 1161 bp, Oryza sativa
catgcaaataccgtagtcatgacttaaaacgtcgacaacatcaaaccagtagcaacaaccccaccggagatgatttgaaagaacggcgccacttcatcgttgtggaggaagaagagttcccaccacaaggcaaatctgtttgacatgtggatccaaacaccagtacaaacctccatagcaaccctgcgaacagcacaaagctccgtttaacttctttcgagttgtatacaaaaggggaagaagaaaacctagaacgagataaactcgatatataggctgcgttctttcccacccccaacagtgctcacggaaaacggagcgatccattagcacatgattaattaagtatctgctattttttttaaaaaaaatggactaatatgatttttttaagtaactttcgtatagaaactttttacaaaaaaatacaccgtttagtagtttgaaaagcgtgctaacggaaaacgaggagtaatagcctgaaaagaacgcagccataatgggtataaacccgatagcacttggcaaaccgtgacataatataatgcatgtagctctaggccaaccacgtcataaaaatgataccaaattacacctgacttctatggagaaaaaaccagttttagagaagtcatgaaagcatgctattggccagttttaaaaattactgtgcatagcaatgaattttaataaaaaagttcttttttgcagcgagcaaaggaattttgaaggtattaggttaacacagtgcatatatcacaaaaatgagtatgcttaagtccctataagacatacagctccaccacacctgaaaacttaagcgtgtagcatgcattttaatctactctcgagtgacaaatctcccggatggtgtagactaagtgcatcttatccgagtggcttctgatccaagtggttatttcttgtgggatataccgaagtaaatgtgataattgaatactgactagtgcaaatactcggctagtgaccctcgtggggcataacaattgattgaaagcttgagtgtaggagataggctcatggccatgaattcctattggcagtagtagaggaaacatatggcaaagacgaggtcactcataaacagtagcggtgtcggccaaccatgagggcaaagctatctgttggcggtgacgtaag

SEQ ID NO: 26612 - DNA, 2173 bp, Oryza sativa
ttggagttatggggaacctacagagatgctgagtccaaaaattcagagaattttgggcatgatatcggtgaaagcagtggtgcttatattgtgaggataccttttggaccaagagataaatatatccccaaagagcatctctggccccacatccaggaatttgttgacggtgcacttgtccatatcatgcagatgtccaaggttcttggagaacaagttggcagtggacagctagtatggcctgttgttatccatggacactatgccgatgcaggtgactctgctgctttgctatctggggcactcaatgtcccaatgatattcacaggtcattctcttggcagagacaagttggagcaacttttgaagcaagggcgtcaaaccagggatgaaataaatacaatatacaagataatgcgtcgaattgaggctgaggaactttgtcttgatgcatctgaaatcataattacaagcactagacaagagatagaacaacaatggggattatatgatggttttgatttaaccatggcaaggaaacttagagcaagaataaagcgtggtgtgagctgctacggtcgctacatgcctcgtatgattgtaagtacatctgcatcaactcttttcagtttgaatgcagttcattgctttaacaataacatttctgatgtttattgttttattaaattattaggcagttcctcctggcatggagtttagccatatagtgcctcatgatgttgatcaggatggtgaagaagctaatgaagatggttcaggttcaacagatccacctatttgggctgatgtgcgtggttcctttatattctacaataggatatctaggaataactttggtgatgtgccacatgagatccttgctatatttactcgctatcttgtttgaaatattttcagataatgcgattcttctccaaccctcgcaagcccatgattctagctcttgctcgtccagatcctaagaagaacatcactacactggtcaaggcatttggtgaacatcgtgaattgagaaatttagcaaaccttgtgcgtgagcttgtctaatgtggtttgcctagttgccctcattcttatttttctcattatctagtggtctagttagtaatgaagcttctatgtcctttctaggtgatcattctttttgtagtattttttatactctctagatgatgcttgttctcttcatttattttttctgcagacacttatcatgggtaaccgtgatgttattgatgaaatgtcaagcacaaattcagctgttttgacatcaatactcaagttaattgacaagtatgatctatatggccaagtggcataccccaagcaccataagcaatctgaagttccagatatttatcgtttagcggcaagaacaaaggtagtcaaatattatatcttcatatgttgaaatgtttcatatggtttctgcaataagtattctagtggactcttgacatgtggttcttgagattagttgtatggtgatccagataagtgttgacaataggatttatgatgagccatatgcattgatagttacataattgtcattttggatatttgcttccttttacctatcccagttttactttcagcaaggaactgattatgctgcttctatgcttctttatgccagcctcaatcacatcttcatgtttgaactaattattgtttgaatcttatcaatttcagggggtgtttatcaattgtgcttttatcgagccatttggactaaccttgattgaggttatgtactgctgtgggatttcctgttgttgctcaactttatatgtgaattaatatgcttatgcaatcttaacatcttgttggttggcaggctgctgcttatggtctaccaatggttgctactcgaaatggtgggcccgttgatatacatcgggtactgtggcccaatccttattatacatttttgctgaaactaaatgctccagttgttggtgtcatacatatttctcttattctgatcatgtttgtttgttcaggttcttgacaatggtattctcgttgatccccacaatcaaaatgaaatagctgaggcactttataagcttgtttctgataagcagttgtgggcacagtgccgccaaaatggtctgaaaaatattcatcaattttcttggcctgaaca

SEQ ID NO: 26613 - DNA, 875 bp, Oryza sativa
tacctcctgtgaaagagcttaggaagacaatgagaattctagcactgcgctgtcatgttttgtacaggcatgatggtagcaagttgaatgttattcctgttttagcatcacgatcgcaggctctaaggtcgactttttttgttcaactgctcttccattttttctcctcatgttgccatgttcctcattggagcaaaatattatactcagttttccactaaataaagtttacatataattttcattccgcaaagtaaacaagtaaagacttagataacatatattttttattgctatatttggtcatatatactcccatcaatatttatttttgtgagtgttaacatcatatactcagtttccaattctaaagtttgatcactgtctttcctgataataaatccataaaaattaaatgtataactacatgaacgtatttttatgaaaatgtactaatcatttttttcatgtataaaatctaacctttttgcatatagtagcaagttaagattttgaggattagcctaaagagcgaaaattaatcttagtggaaatctgtcacaaacaatattttgtttgttcttgtaagagcatgtattgtagtcccgtctgaacatgcaagccattattgacttttcatggtccccaatcaaagactttgacaaaagttctgaattgtgctttaccagtaaaaataataggattttgctagacaattttagtactatttgttctcatatactccctccgtttcaggttgtaagacattttgactttggtcaaagttaaactgctttaagtttgaccacgtttatagaaaaaagtagtaacattttcaacccaagataaatttattttgaaaatatattcaatta

SEQ ID NO: 26614 - DNA, 688 bp, Oryza sativa
cattttagaccaaggagaatttaacaaaaattctccgggccacatttgaatttttcttgcacgtattttagtgtttgccaatttcttttcgaattttaattaattctattattccttttaggaaaacgaattttaattcggaatggatttatcaggacgtgacaaatccacccccctttcaggaatctcgtccccgagattcgaggaggctagcaagaagataggttgggcggtcttctcttcttgtctgacttcttccgtcgcgtcttttataacaaacttgcctagcaaaacttctccactctggactgcttggctcgatctcctattgcagatggaatcttctcttcacctgacttgtccctggttgaacctttagctgacttcgactgggttgcggcacttgaagatggggcttcggttccagaactttgcatagttcatatctttggagtcaacctcatacaagttacccacttcacgttatgcgtcgatatcagcttgtcattactaggataccatgctcgttatcatgagaatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctg

SEQ ID NO: 26615 - DNA, 402 bp, Oryza sativa
ggcgaattcgagctcggtacccctatatttatattaaaaatacaaatataaatgtatttataaactcaaaaaccgaccctataaatatctatatatactggttcttaataaaaactggaaaatcttttataagaaaccgatatatatagtaagttatgagtgtttttttaaataaacgctcatcaaccgagaaaggacgcgaatcgtctgactttatatatatatatatatatatatatatatatatatatatatatatatatatatatatatatatatatatatatatatatatatatatatatatatatatatatatatatatatatatatatatatatatatataaaagaagagctgtacctctccaattctacatggggtaccgagctcgaattcgcc

SEQ ID NO: 26616 - DNA, 1089 bp, Oryza sativa
cttggatatacgttgtatactgatatggtataccagtgcgtatacggatagtttctgtatgcgttaaggaaatctatcacgaaatagatacagaatccacggatggaaggagttctactcggacaagactaggtttttgccataccgtgtggggtccgatatcttcgagtccaacttagagatcaactgacccgcggtataaaagggaccccctgggcaggacctaaggcattgaatctcaccgccaacacatccaccacagcctacgaagccagagcttacaggagccaagtcgccgggtgatctagtcgaaccaactcgactacggtctcgtcggtatcatcgagttccattattccctttgtaatctttaatttccatcacataatcccataccaactggattagggctattacctatcaaggggcctgaaccagtataatccttatctttcgtttgcttgatgtcgtattacgtagatcctcgttccaacgtaccccaatactctctatatccggtctacgggtatcccccgtcgacagtggcgcgctaggtaggggggcttggtgctcaaggttctactactatgacttcaagccttctcgacgacaacgccaaccccggcatcaaccaaggatcttcgacctcaacgatactggtgtggacccaagtcggcgaaatcgttttcccggtctataccacgatgccgatctcgactggcccagcaatggccggaagtgagagtgacgtggttacgaccttgacagactccatgtcgaaggatcctcccgcagaagcggaaaacggaacatcgacaacgtctgagcccgagaaggatcctaatgcgacccaatcttgtccctccgacaagaagtacgagccgacaaggacaacttccgaggcgacaaggtcctagtgtcctattcacaaaacaaggaaacacaccttgcaagcttgctgggttcttctcaacgtacaagccgaaatccgtgcctgcagagagcgcggaattcaacgtatttctccaacccgtgatgtctattgtcctatccacaagacgaagaatcatgacctctcaagctacaagg

SEQ ID NO: 26617 - DNA, 1626 bp, Oryza sativa
gaaccgagtaactcatcgtcatcgtcatcatcctcatcatcttcgtcatcagacagacatccacggaggacatatgatcgccgacaacccaccgcccccggcggcggatgcagggctttcagtcgtgctctacgagatgtccgatggcctgagagatttcgaccgggagcgatagagaagtacgatggaagcaccgaccctaaggagttccttcaggtctactccacatactctacgctgccggagcagacgacaacgcattggcaaagtatttgccggcggcgttgaaaggatctgcacattcatggctagtccacctcctgccctactcgatttcttcatggacagatctgtggcagcagttcgtcgccaacttccaaggaacatacaagcgccacgcaatcgaggacgacctacacgcgttgacacaaaatccaggcgaatcattgagggactattcggcactttaatgagtgcagaaatacgatccccgagatcactgatgcttctgtaatccatgcattcaagtctggcgtccgagatcgctacaccacccaggagttggcgacaagacggatcacaactgctcgtaagctattcgagattgtcgatcgatgcgctcacgcggacgacgccctgagacgcaagaacgacaagccgaagacggggggagagaagaaatcagccaaggatgcacctgagtcaagcaaaaagaatagtcgcaggagtgggaaacggaaagctcaaacagaggtcctcgctgcagaatatgcggacccacccaaacacccagactcacaaggcgacgatacgaagaaaatatggtgccctatacacaagtcggacaagcactccttggagagttgtttcgtcttcaaaaaggcgctcgcgaagcaactggcgttggagaagggcaagagagtacgtgtagtcgagaaggccgctgaagcagctactcaggactcagactcagcatacccagactccgacctccatgtttcacacatcttcggaggttccacggcgtactcctcaaagcgagagtacaagaaagtggagcgtgaagtttgttcaacatggcagggggctgcacccacaatgaagtggtcagagcagaagatcgagttctcagaggccgaccaccccaagaccgctgtcatcccagggcgatatccgatcgtggtcgagcccactattcggaatatcaaagccgcacaggttctaatcgacggcagcagctccattaacctactcatcgccaacaccttggacgcaatggggatcccacgaagcgagttgacgcccaccgatcagcccttccacggaatcactcctcagtcatcgtccaagccattgggcaagattacgctgcctgtgactttcggccaagcaaacaacttcctaacagagcagatcacctttgatgttgctgagttcgacacagcatataacgccatcatcgggaggactgcactcgcgaagttcatggccgcatctcactacacgtatcaagtactcaagatgcctggactgaagggaacaatcactattcaagggaatgcgatgctagcggtacagtgcgacaagcggagcctcgacatggttgagcacacccccaacccaccc

SEQ ID NO: 26618 - DNA, 1954 bp, Oryza sativa
  unsure (1)..(1954): unsure at all n locations
nnnnnnnnnnnnnnnnnnnnnnnnnnnnnnnnnnnnnnnnnnnnnnnnnnnnnnntgagcgacccaagaaagtgagcaaaacaaacaagacgccgaagccagatggtgcaaccaagatcgttccactctccagcgccaaccctgacaagactgtcaagatcggggcgtcactggatgagaaataggaactcgcgctcatcaccttccaacacgacaatgcagacgtattcgcttggcagccgtccgacatgccgggggtccccagggaggtgattaagcacaaactcatggtgcgacctgatgccaagcctgtaaaacaaaaactgcggagatttgcaccagaccggaaacaagccatacgagaagagctcgacaagcttctcaaagctggtttcatcagagacgttctccatccagagtggctagccaatccggtcatggtgcacaaggccaacgggaaatggaggatgtgtgttgacttcaccgaccttaacaaggcgtgtcctaaggatcactttcctcttcctcgaatagaccaattggtggactcaacagccggttgtgagttgttaagctttcttgacgcttactccggctaccaccagatcagcatggtaaaagaggacgaggagaagagagcattcatcatgtcgtttggtgtattctgctacattaagatgccgtttggactaataacgcaggaaatactttccaacgcacggtccaaggggcacataacgattagctcgggaacaatgtcgaggcctacgtcgacgacattgttgtcaagaccaagacaagcgactcattaatcgatgatcttcgggaaacgttcgacaacctccgaagataacgccttatgctcaatccaaagaagtgcacgttcggagtaccatcgggcaagctactcggattcctcatctctggaagagggatcgaagcaaaccccgagaagatcaaggcaatcgagaacatgaagtcgcccacaagactcaaggaagtccagaagctaactggatgcatgacggcattgagcagattcgtcgctaggatgggagaacgaggacaaccctttttgctctgctgaagaaacaagacaaatttgtgtggacacaggaagccgaagatgcattcatcgcactcaaatgctacctgtcaaatccccctgtacttgttgccccccaacctaatgaagaattattccattatattgccgccacaccatattctgtgagcgtcattattgtcgagagagaaaaggtgcaaagactagtttattacgtcagcgaagctctccacgacgcaaagacaagatacccacagatccaaaagctgctttatgcagtaatcatgacatcaagaaagctacgccactacttccaagcacacagagtcacagttgtttcctccttccctcttggtgaagtcgtgagaaacaaagtcgttgtcagccgcatcgcgaaatgggtagtcgagctaagccaatttgaagttcactttgtgccacaaacagccatcaagtcccaggtcttcgccgatttcgtagctgactagactatgcctgacaacaggtcagacggtcagaccgacaacgagacatggacaatggcgttcgacggcgcactcaatagccaaggagcaggggcagggttcatcttgacgtcaccttcgggagatcagttcaagcatgcaattcacctcaacttcagggcaaccaacaacatagccgagttcgaaggactactcgctgggataagagcagcaatcgcactaggagtcaagcgactaatcgtgaaaggggattccgaactagtcgcaaaccaagtgcacaaagattacaagtgctctagccctgagttatccaagtacctcgcagaagtcagcaagctagaaaaaaggtttgacgggatcgaggtctgacacgtataccgcaaggacaacaccaaaccagacg

SEQ ID NO: 26619 - DNA, 4627 bp, Oryza sativa
caagcatgcaattcacctcaacttcagggcaaccaacaacatagccgagttcgaaggactactcgctgggataagagcagcaatcgcactaggagtcaagcgactaatcgtgaaaggggattccgaactagtcgcaaaccaagtgcacaaagattacaagtgctctagccctgagttatccaagtacctcgcagaagtcagcaagctagaaaaaaggtttgacgggatcgaggtctgacacgtataccgcaaggacaacaccaaaccagacgacctagcatggcgtgcatccagacgagagccactcgaacaccttcctgggcgtcctgacgaagccatcggtgaaagcggcaaatgacgaagatagcacagtcgtccccgacatcggctcaggggctacagaggcagaacgcgctgttgccgacatcgagaccacagacgactggaggaccccactcatcaagttccttagtagtgacgagttgcccgagaacgatgcagaagccgagaaaataacccgacaagccaagatttactatatgatcggcaacgatctatacaagaaggcgccaaatggggtactcctcaaatgcatctcgttcgacgacggcaaacatctcctcctcgacatacatgaagggatctgcgggtcacacgccgccggtcggacattagtcgagaaagtcttccgacaagggtttttctggccgaccgcgctcaaaggcgcttgcgacatggttcagcggtgtgaagcctgccaattcctcagcaagcatacaaggctaccagcgcaagcgctacagactatccctcttatttggccattctcgtgctgcgggctcgacatactcgaaccattcccacgaggacagggtggctacaggttcctattcgtagcgatcgacaagttcaccaagtggattgaagcgacgcccacgggggaaatcaaggccgacaacgccattaagtttatcaaagggatattctacagatatggattgcctcaccgcatcataacagataacggctcccagttcatcagtgccgacttccaggattactgcatcggattgggagtcaagatctaatttgcctcagtttctcaccctcagagcaatggacaggtcgagagggcaaacggcatagtactacaagggatcaagacctgtgtctacgacagactcatgtcacacggcaagaagtgggtcgaagaactcccctccgtcctatgggccgtgcgtaccacaccgacaacgtccaacaaggagacaccattcttcctcgtgtatggctcagaagctatgctcctcacggagctacgacatcatagcacacgagtacagtactccgacgaggaccaagaggagcagcgaagcgacgatgtgaatctactcgaggaacatcgagaaagagttgccatcagagcagccagctaccaacaggctcttcgctgataccacgagaagcgcatcagagcacgcacacttttgatcggcgattatgtcctccgacgcgttcaaagccaagcagggcgcaacaagctctcacctaagtgggaaggaccatacacgatcacgcaagtcttgcggctaggtgcattcaagattgcagacggcgatggtcgcgagttagcaaattcctggaacattgatcaattaggtaaattgtcacgtccggaatttctatccaaaatttcaaacgcttacatgtgtgtaaaccctcgtccaggaatcagtcgaggcacacaataacaaattgataatagagtgcaattattactctaattaataagcgaatataaagtcattacagaggtagatagttcctctcaaacaataaagttctaagcagcggaaaataagataaacggcgcagacgactccatcccacaagaagcttgaccagagctacgcctaatcctccacaccatcagcatcaatgtagaactcctcctctgatgaatgattgcaaggtgagtatatgacatactcagcaagccacgcaacaaatatgcaaatgcaagggataacaaaggatggcataatatagtctcattttcataaacggcatttaataaatatttcagaatttaataaaacagtaaggtattaattaaacaatattaatccaacactatacaacatacccgttgcataggaccaaccattctgaacaaccattcccggctgcacagttctatctccaaaccaggaatgtaccattccaaaccaggagctaaacaaattattaccaaatacagcagcgcttattatggtgagaggtgtgaaactaatcacgaacgacattgttagacccgcccataaccgcgggcacgactattcgaatagttttactctggccagaggtgtaccactgtacccacaagacacaacctagcgacccccgtgggcttatcttcgccacttcacagtctggtgctctacaatgaactatattatacagaaagtaaaaccgttgcccacgttggctcgtggttggcacggttaatgtttcacaaccgaaaatcgtgaaccggtccttaattgtcatgagcacgaccatcaaaaccatgtactcacaaccaaccattatcaggttttagttggcaaattgattaattaaccaatcacgatcaaccatcgtgagctaccattaagccatcattaaataatagtgaatcataagtatcccatttatatgagctagtgtctctaagcatggctaagcatcctaaacactttagctaaaaccatataatgttcaagctaatccaattattaaccaagtgacaaagaataggtaatcaatagcaaaagggctgtaacaaaaacaataggttattcccacccaatgacattcaaaaataaatacaatagttgaatagaaacaatagctttaaacgggatcaacatgctcaaagggttgtttgggatctgtgtgacttgccttgctggctttggaactcttcaaagtcttctcctgcaaattcggactctccgggaacgttgtaatcaaagcagaaaagaacaaaatcaccaaaacagcacataaacaatcatgaacagtacatgtggatatttttaacatgtagatctcaattttagaaaaatttagagacttgaaccaactaaatccgagctaagatgaattagttatgaatttttaaagattaaatcggattaaatcatttatatggattttaattgaattatgacgcaataaagaattatttttgaaaaggaaaaaggatttattgcgtcagcggctcgggttttcggtggaccgggtgcacggcgacggtctacagaacgaacggccgagatcgatctaatccaaaacgaacggccgagatcgacttgatctaccgcgggtctacggctaacgtcagcgctgacgtcggcgatgacgtcatcaccggcggcggctcggccacgcatgctcgctggcgaacgacggcgcggcggcgcaaacggagggcacctacgggtagcgggcgacgcggcgaactcaccgatgacacagacgacggcggacggtcaacggatggcgacgacagcgaggtcgaagcggcggagacgatcgggttgacaacgacagcggtgctctggcgagaaacggcagcgacggaggggttgtcacatcctgattttcgtttcaggatttataaattatttaataaattattaatagaatttatattaaatgttctttaatttacaagtgaagttaaatgtgggaaataaaatttcttaaatctaaagcatggatggatttaatttttattaaattctccatgattaagtcaactctctgaaattttctcggatttttcggagctcaattcttaaatgatacaaagaacagttcagtaattatttgatcattaatgatctaatgataattgttaagagcttttcttgtttaaaatccttaaattataaattgttgtttaaaaggaataattagaaatgattttaaaagcttaaaagagaagatctaatttttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggtttttaaaagtctgttttggctttgggcagaaagccggcccaaaacctctctccttctctctctcttccctcggcccagtccggcccaggtcgccgccgctctcctctctctctcgctgtcgctgacaggtgggccccacctgtcagtcttgtcttcttcctccggccgccgccgcccgaaaccctagccgagccgcgccgccgtcgctttccaattccgtcgctcctttccatctccggccgaattgatagaggggaaatgatcttctcgatctcctcttccttttctcttatagaaactccggtcaatttcctttggaaataggcggattcgagtttgattcggattcgtttttccccaatctttccttctcgtcgccggccgccgtgggccttcgccgccgcctccttgcacctatataaggacccccgagctctcctctacccgtcacctcccttgcctt

SEQ ID NO: 26620 - DNA, 5799 bp, Oryza sativa
aaaaataattcattattgcgtcataatttaattaaaatctatataagtgttttaatctgatttaatctttaaaaattcataactaattcatcttaactcagtttaatgtggttcaagttgcaaaagttgtataaaataaagatctacatattaaaattttccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttctttgttttgcgtgttagcttgtcgtttccgttgttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttaatccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgctagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgtacagccgggtatggtttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatccttttagttaatttgatgaatctgtatattaaattgtcagtttgtgtacctcggctgattcctggacgaggattttatgcacaaataaattcggaaattactagtgaatttccgggcgtgacaggggtggacgaggacggcgacgacttggcgatcccgacggtggccttccagagcgacgacgacgaccggagcggcggcggcgcacggctgaactcgcggcggcgacggcgatgcaagggctaacgcggaggcggcgctacaggcggcggcgagctgaggcgagggtggcggcggatagaagaggtcccgggggtccttttataggggctaggcggcggcgatggaggtccacggcggtcggcgacgagaaggaaaggttagggttagaggagagagacgaatacgaatcaaactcgaatccgacgatttccaaacaaaattagacgaagtttctataagagaaaagatagaggagatcaaggggatcatttcccctctaccaatttgaccggatcgggaaagacgcggccgaatttggaaggggctgcggcggcgcgaggaggaagacggccctgacaggtgggccccacctgtcagcgggagagagagaggagagcggcggctgcgcactgacttgggctggggagagagagagagagggttttgggccgactttcggcccaaagccaaaacagggacttttaaaacctttttcaatttaaattattcatgaaatgcaattccatttattaaaaatacttccttggctcaaataaagcccagaaaaatctaggaactatagagtcaaatgaagtatttaataaaattttatctagtacacttttatattggaatttagtatttaaaattagatcttttcttctaggcttttaaaatcatttctaataattccaattaaacatcaatttatatatttggggatttttagggtgtgacataaattttatgtataaatcaatagtattcatatttgtaagacatcttacgatttcaataaagttgatttcaggtaaagattacggtcaaagtgttccttcccgacgatcccttaccacgacgacacctagcgttgaaaccaatcctcatgtccctttacgctgtcttgacaaggcctctgaggaacctaagggaacttcggctacggacgccctgagcggataaggccttgtcggatcatgtagaaacaaacgaccatgtaagatctggtcatgtaagagttctcgccgtgcgtattaaccaagccgtgtaatcggaaattgagttttccaacttcacggctgggggctagggtcagtgctttttcaaccaaggcaggtcaagggtccaagagctttatcctccgagaacgtttctccgacgacaaggctgggggctagggagagtgtatgactcaagtgactgatcaaagtcgcaaaatgagaaaacactcatacacaacatatccagagtaagagaacttagctagatagatttcttttctatttcacaagtacctcttacaatttgtaaatattccaaaatatattacatgtttccttgagatattttctacaggacacaaagactaccaggacggccaacgccaatccatggactgaaagaccttctcggcaagcggcgccatcgactgcgccagttggtcaatctctgcgggagtcctccgagaacgcgagaacccttcatggaggaactcgagctgcagctgcgggcggtgatctcggatacaggccagcacatgccctccggcatagtggctcgaccgacgacactcctgcttcagggcctcgtcgatgcgcttgccgatcccttcgagctatgtgcaggccccattcaaccatgagatgtacccggccaccgactcctcgggattcccgcgaggaactcggagctccctacagactccagccattgccatgcagcagctcctgagttacgaattgaaccatacctcgcgacctcggagggcttccacagcctggtctttcttcactcccgtcaaggtcttctcgagttcggccacctcaaacttcgtcttccagtattggattcgacgatttcggtcggccaacgcactctcgaggtctgcccagcatggaaaggactgagtcaagttgttcttgtctcccgagaacacagcaaacttagtcaatccgaacaaaagagtgaaggaagtaaagccaaaaatgcaaacctaaggacgtcatcgccgtgttcgtctccacggacagtctttgcgacatcctcctgctgcacgtacgtctcaagtgcaagtgccgggacgaccaccggcatctcaggctgcccgtgctgctggacatcctcgatgtcgacatctctacaacgacaacaaagtgctcggaatcacatgctaagaaaacaaaggaaacaactgcatacataaaagcagttcgaacccgcagaagtttttacagcatgtttgttaaggggtacaaggcaaacagaatcctactcttcaaaaagggggagaacatactcccccaagtcactgacttcctccatcacgcccttgcgcgtgtcatcggcagccccccgatccagagcccttttgaggtcaaggtcgggataggccagcttcacgcatgcgaggacgtggcacgccccagtgtagatcccgttggacgtctcctcgccgatcctggttgcatgcttgaaggggatctcctccatcgccgtagccagctccacaagcgaggacgtcagcgagaactcgtcggggttcgccgggatggtgatcgtgacgccgcactccccagcaagctggtgtaggctggtgtaagatacccgcaaccagccgcggatctctgacaagttgttcttgagctccgacatccggtgctcgagtccttgtcgctgcctttcgttgccagccaccagctccctcatcttcaggaggtcctcacgggcctccaccaggtctcgtgctggcttgtcggcgcgttggttagccgacgacgctgccgccctggcctcctcgatctcggcctggagctccccccaggtgagggcattagcaggcgggccccgagtgggcacaaggccgccggcggggccgcttggcgtcccctcccgatccctagtcacgaccacgacatcagtcgaggctactacaggggacgcgctggaggccgccccggacccatcctgcgccgccttcgcccgcgccgccctgcaaagaatttccactctttcataaaatcaggcgatcaaggtttcatgaatgaaaagacttcggaaacatctacttacttcttgtcgatcgtcaccagcctctgtcttcgctgaggcgggggagacgcgtccgaggcctaagcaagataacatcgtgtgaggtcaaaacattccgactacgcgctaaagaaaaccagagaggcctaccgacggattaggcgccttccgacgggtcccgagtacaaaggagaattttcctccccttcttcggaacgttgctgccgcttgtggtagcagcagcagcaacgtcgaacgccttattcgcgacgccctcttcgcgacgccctctttcaatgacgctgctgcctgatgatccgcaagcggcccgatgacatctgtcaaagggatagcctgcgtaacatgaagtcacaatgcgatcctggaagaaaaagataaaggagtcattgagtacactcacgttgatcgcggcttcgtgttcggccggacccttctcgcaaagagggacggggatgtcgctcgccatcgcagggccactgatcatcacctggccgacgcggcgtgccacggtgtcgctatccaaacctgtagatcgagaacaggaactcgataagtcaggggaaacaggcacatccggaacaaaatctggattacaagaaaaataccccgaggagaaacccgggtcgcgtcctccggcccagagtagtcaaaggccgggtgggcagcgactttgtaccccgacaacccccgtactcggaggtcatcgatgatgtcgatgaaagattggagggagggagtcaggtcgggtttggcggtccactcaaggatcttgtctggttg

SEQ ID NO: 26621 - DNA, 1227 bp, Oryza sativa
taaggcatcgaatctcaccgccaacacatccaccacagcctacgaagccggagcttacaggagccaagtcaccgggtgatctagtcgaaccaactcgactacggtctcgtcggtatcatcgagttctattattccctttgtaatctgtgatttccatcatataatcccatacaaaccggattagaggtattacctatcaaggggcctgaaccagtataatccttgtctttcgtttgcttgatatcgtattacgtagatcctcgttccaacgtaccccaataccctctatattttcacaattacattactctactctatgcaatgtaattgtgaaaatatactcatgtgttgctaccagataaaaatgcctaaagttaaattgatcgacacatctaaatcgtggcatatcaaaattatatttttcttatatttttcttgtactctatctatggttgtcctcattgggagcccaaatttgattatagctataatgatttattagcgatcaaaatatattttacagataaaacatttatatatgtgttcttagtgaattaaaaaacaatgctgaaaaccaaactacataaagaaaactttaaacttatgttttaaaaattaaattaaaattcaaaattatattagagaaaatattttttccatttatcaattgcatttgaggtcaaatatctagatatagacagtgaaaataaatagaagtagagcagatagggaaggaaaaagatctgaaattcgatgtgacaggaacttaaaatttaaattttaaaatttaaattttaggctgagtttagttccaaaatttttcttcaaacttccaactttttcatcacatcaaaactttcctacacacataaactttcaatttttccgtcgcatcgttccaatttcaaccaaacttttaattttaacgttaactaaacacacccttagtactggatccaaacatcacattactcctgtttagtgagcataattttgtaaagaggatggatccatatatactcgtatggtagtaggcttgtttgatcaaaccgatgcgacgcagagagagagaggttgggaagcacaacaagcaactgatccaccgatccatactcagccttatctcttcatcggttcatccggtgcctgttgtctctttcttctctctcacatacagtctctctcctcttgttttttcttcttctctcctcagcggcaggcgccctc

SEQ ID NO: 26622 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnncgtcatcggggtcgtccgccgtgagccggtcgtggaccgttcgatctcaaccgtccgttttggattggatcgatctcggccgtccgttcgcgtgaaccgccgcccgtgcgcccggtccaccaaaaccctagccgctgacgcaataaaccctcttttccttttcaaaaataattcattattgcgtcataattcaattttaaccgatttaagtgttttaatccgattaaatctttaaaaattcataactatttcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgttcttgattactttattccttgataccttgggttataataatttgactagttgagctttatttatattgg

SEQ ID NO: 26623 - DNA, 299 bp, Oryza sativa
ttagcagaggcagtctatggtgaagacgtaacctcccatcagtgacacgacaaaactagacgggtgtagaggagttgtcaccatgagtacatgttactatttttaaacgacatcattagaaatatgaattcctagcaatagcgtagaaatagccatggtatatttatagttacagaaataatcctcaaacgcacggatacaccattgtaacatttcactcaaaagtattccaaggtatcgtatttattcaatccaagggatgatttataaaagagagaactctgctaatatcttcatac

SEQ ID NO: 26624 - DNA, 463 bp, Oryza sativa
tttttttctatatttaatattccgtccaaacatttaatatgatagtgtaaaaatttttgttttgtgaactaaacagggctaaactgtttctaatgcctccagcttcggatcacgggagcttccagaagaattactacaaaacacctccagcttcgagaagaattactacaaaacacccgatcccggatcaagccacaaattgctctgctgacaaaagattaaagatcaatcgaattgcagatctcgagatgcttaacatttatttcaaatattgcaatggtttttaaacttaaaacagccagtcagtttaggctttacggagtatgtggctgaactgagaagatgttgtagtgcagtgctgtactgacaaggtgcttaaagaaatactagtgtgttttaaggtttggagctctgaactgacagcatgctgtactgcctaagacaacatgctgtactgacgagt

SEQ ID NO: 26625 - DNA, 675 bp, Oryza sativa
  unsure (1)..(675): unsure at all n locations
nnnnnnnnnnnnnnnnnnnnnnnnnnnnnnnnnngatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgnnnnnnnnnnnnnnnnnnnnnnnnnnnnnnnnnnnnnnnnnnnnnnnnnnnnnnnnnnnnnnnnnnn

SEQ ID NO: 26626 - DNA, 2214 bp, Oryza sativa
tatatttatatatatatatatatatatatatatatatatatataaaagaagagttgtacctctccaattctacatgccaaatcaccgatcaatatatatatatatatataaaagaagagttgtacctctccaattctacatgccaaatcaccgatcaatccctaccgtccatccgcatcgctatgatccctccgcatcgctataatccgtaccgtccatccgcatcgctctgatccctaccgtccaccgcgatttcaccctacccacagcaactctatcctatcgagagctgagtcttcgccgttcgatcccccttcctgccactccctgacccgccaccgccgccgcgtcctactcctccccacccacaaccgctgcatcacctcctcccaccaccttcgcgtcctcctcctccccatcgccgccacgtcctcctcccacccaccaccggcatgtccgccgcgtcctcctcccatccaccaccgctgccactgacggagccaaggtcgtccctagccgccgccgctgattcgccacgcatcaactccaccatcgacacccctgtgctcagtcctcaaccgtggtctccgctcgatgcacaagcagctgacttccgcgcccaatgccggacggccgtgctgcccaatctcgcacggatgcggcctcactggctctcgatgccccctgagcactaccgtcgtcgaggacgccactatgggccgctccactgccaaggccaagcggatctggtcacttcaccaccaaggctgccaaccccgagcccttccaccgtgagtccgcagcctgcttgattattgttgccgttgcctgggtccctcaccgccagggctgcaggcttcagcacactccaccgtgtggtcgctgttgcgtgcctctccgcgtcccatttggcggacagccttgagccttgttgatcaccagagacgttctccaaccctaggtatttaccctagcgatctcttgggttagtgccaattttgattgcaaatctactgcaaatgaatgtgccatgatgttgctcgcagttgtcatcgccaacagctggccatggtggaaactactgacacagtcctggcgcgcctaatgcatcttgctctgaacaagaaggaattcaccaaagagggcaaggagctggcaagcagcaataggcatgattgaaccaaacttaaatatgcataaatcaaggtgattctcatcttccaaatctttcccttaatttttcccctagggattagagattccaaatcgatattaacctgcatacagtaagaattatgagcaatttacagaagaggggaggatatcaggtagttataatttagaacagtttatatgtgcatttctgaatatatattctttgcttgctttttttccaatctgcgtccctctgtaacgggtgatgatctttgtgtttttcttatggacacatgattggtattttctgttgttggtgcagatgggtgagcaaacatggatggcgatgatatcctgacattcaaatgtgaatcaaccaacaaaggtcaccactatattgcattacatatgagtattatataagtgctctcttgccatccttagttcaactaaacattttcattttagcgttgttcaactttgacatttctataattttttaattcgtatgagatgatgccatattttatatgaaatgcacgactagctggcaatgctacaaagtaattgtctttgtaacttgtaagaattcgtatgctgtccaaagaaattagctgcagtgatgtgccccagttgttctcaaacccacaaccttaagggaataatttcatattttcataaaaagaatcattctgaaattttctcaagttttatttttactgcttgcagacagtgagttgacaccatccataggtgaaccaaacggtagcatgcaaggagtccctgttggcaatggtcaaatgcatctaacgccaaatggtgaatatatacaccaacgttatgaggtgcaaccggtaaaaatttcccatcgtttgagaaacattttttcctttttggttagcacttcccattcttcaatgtaagctgcaactgtggatgatggtgaaatattcccttcacatgcatgcaggatgctacaattaaatgcaagtcaatatttttttcacaaatatcacatgggtccttccaggataaacatgctctacttatttagtcagg

SEQ ID NO: 26627 - DNA, 603 bp, Oryza sativa
  unsure (1)..(603): unsure at all n locations
nnnnnnnnnnnnnnnnnnnnnnnnnnnnnnnnnnnnnnnnnnnnnnnnnnnnnnnnnagaagcccttgtcgctacgcttgcgtatccaacaagatgatcggagtgcggtcttgttctaggtcttgttccccagtcgactgcctgtggcatgttaatcgggcccttatattctttgtcttccgctgttgttctctgatagttgttggcctacctggccctaatgtaagtatttaactcttttagcctgaattaatttgtgatatgttgtgatccaactatgtatgtgtgtaccaactactgatccagggattggtacggataaacacagaagattccgatttccaaaatcgggggtctacactcaacttgaggagtgcaatgccgaactagatcttgaaaaacaaaagctagccgatcttccaaatgccattgaagaacagaagtccagattgagatcggctatcaagaatgtggctgacatgactaaatctctcaagatcatccctggaaccgatgcccaagacatccaagccatcgaagaagtagatcaaatcaggcaacgagctttgtcggctatccagcgctatctttctcaatgacatt

SEQ ID NO: 26628 - DNA, 683 bp, Oryza sativa
  unsure (1)..(683): unsure at all n locations
ggcgaattcgagctcggtacccttccatgaacactttgttcatcaagttcatgaagaaggcaggagcattggttaagccgaacgacatcaccgtgaattcatacagcccgtatcgcgtagtgaatgcggtcttcggaatatcttcttcacgaatacgtaattggtgatatccggaacgaagatcaatcttggagaatacagtggcacctttgagttggtcgaacagatcatcgatccggggaagagggtacttgtttttgatggtgacttcattgagagctctgtagtcaacgcacatcctcttcgtcttgtctttcttctctacaaagatcacaggagcaccccatggggaagtactcggacgtatgtaccccttttctttcaattcttccaactgtgtctttacttcggctagttcatttgctgccatacggtagggtcgcttgtgcagaggagtggttcctggagcaagatctatccggaactcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26629 - DNA, 329 bp, Oryza sativa
cccccctatcgcagcggagggcagcgaagtggcgagggcgacgaagtgccctcctctcatacctctctctcggaccgtcgggaggtcggcgcgcacaccccaccgcgcccaccggagctcgaggcggcaggaggaggggacagcggaggggagcctggactcatcgtactccggcgggagcagctcgaacgacgacggcgacggctgggggatgactccgacgactcttccggcctccacgctccctcgccggtctcctccctcctcagcccgctccctggcctcctcacctccttcctctctgcccgccccgctattgccggcatgct

SEQ ID NO: 26630 - DNA, 2409 bp, Oryza sativa
atggattttaatatttatgtgagacaattgttttatgtaattgtatatttatgtgagacgattattgtatggaattgtatcttttatgtgacacgattgttttacatacttgcttatatatttgagacaaattatgtgtttgtgcttgtaaggaattgtgtatgcttgtatgtgcctgtattggattagccatagaagatccggctgctgtatacttttagtggaggcaaatgattgggatggtacaataatagctaaatagcctttggatccaaacagcaagagggctattttgttagggggctattttggtgggataatctttagcccaaaaaatatccctgggatagttctccaaacaggcccataggaactttttcagtggaagtctcgcccagaaaaggaaaagaaaaataaaaatcaaaggcagctttatggctttataagagcaagggcagataaactttagctagcctactcgatatactgctatatttgcatggtatcatgtttgaagggtataaagtgtaacaactttgctacaagcccaatagcatggtcaaagcccacaatatgtcatatccagagagaacaagtctacattgactccctcaacttatgcccctggttgaatcgcatccctcaacctcagggtttacgattccgacgaaatccggtcggatttcgcgaaatttcgacgttccaacgaggctcgaaagtagaaaccgtttgagattccgaggagtttcatctaaatttaaatttaaattgataaaaaagaaaaaataaaataaaatcttataaatactatggtattcatataacttattgggatataaatttatgaaaaaaaagatgtattatgtgtatttactaaaacttacataatgaaaaaaaaattcagaaaattacctctattacaaattaatgatcgaaatttcgatgatttcgatcagaatttcgccaaaaccgaccgattttcgagaacttgtcggcaacttagggaatttatattcaaattttggtttataaaatttgttcggaatttaccgattttccaccggatttcgcgaaattccgaattccgccgatgcccggaacggaagggcctgtcggaatcgtaaaccttgctctaccgcaaaaccgatacaacccatcctccaactcataagaccgttgcaaatcgactcctcgaacggtttgggaggtggtttcgtccaatgtggcatctttgaccccgttaactagctgagttagcacatggaccccatatgtcagtgtcttgtggacagtggcagtgcctggtggtggtgcgcggcggtggccatgcgtgacggcaaacgaaggtgcgacagcggaaattgagggcacaagcgagaagaggggaacacgacgatccttactgatgcaattacgacggcaagcggcaacaagcttgaaaaggcggtggcctcgggttgatgtcgacggcggcgctccggtgatgtccaagtgaagcgaaggtgcagttgagattctctttcgtcttacgaaccaaacagtgatgacgacggacgtggtggcacggttggctcggctggagcggtggccttcggcgaagagtgcgcaaggaggcggctagggcatgggacgagctcggactagggttagaatcggaagaggggaccttaggcaagctatatataggtggaggagaaagagaccgggctagaaacagatggattcagtggcgaaaaactagggttcatcctgagttcttcgggattagaacggggccgaaattcacgggatttaacacaatattgatggggttttcttggggggaaaggagaggaaatcgagagaaatccgtttatgcaactaatttggaaggaaaagctcgttcaactggttgaggcgacaacggcatggagctataggtgtcgatcgagggcagcgagatctacaggttgccaccttcatttgccctccttggaagttggatccccagcgttagacaagctcacaagccactgccacccatctccctcaacttgctgccgctcgatggctactgtgcccgtctctgggtgccaaaacaacggagtccccaactcccaccctctgttgccggaccaccctattatctcgccgctgccatgctgccattttgccgtcatgaggaaatatgggtgagagagtgaggaaatatgggtaaggaaatgaagagaagaaagagaagggtgactgacaaatggttccatatgctaagtcaaccgaggtaaacatgacacctttgtaaaaactgctttgaagccactgagggagtcaaaatacattgattttaatagttgaggggttaagatatccggtattacagtttggggatacgagttagattatacatatattttgagggactcaaagtgg

SEQ ID NO: 26631 - DNA, 19445 bp, Oryza sativa
tatggtaggaataagttcactttgggtccctcaaattattgtcgagtcgtccctcaaattattgtcgagtctgaaattcgtccctataccaaaataccagatataacgagtccctcacaatttacaaaaccggatcatatgaggtcctaggcagtatttacgtctggttttagctgacatgataagcttagttagcatgggacccacgcaggccccaacactctcgtccaatggttaacactctcgtcttccttttcccttctccccatctcctctcctctctctcccctcttcggcaacaatggctgactcggttgaataaaagttggctccgcgccggtggagcctcgcggggcgcttgacgagcccggtcacctccacgatccttgtcgaccagtccgccttgggcacggcgccgtggttgcacacgtagtggactggcgtcggcgtgatgaaaccgtcaagcatgaggcacggcagcagcggctcggagttaaaggggtgcttgccggtgagccagacgagcaccgggtgccgacgcacccacgcgtcactgcgtcagaggtggcctcgtcgcatgggtcattgacgggaggctccacctcgaggcgcgagtggtacaactaccttcagtccggtggtatgtcgtcatcgtcgtcggagtcggtcttggagcccaaccgacggttgtcgccggtggatgggaacaagtcgatgttgctcgacgactcattgctcgccaccatggaacagcttgaccgtggagttccccgtcacgttggtttgcgcgggcaaccaacacaaggagcagaacatggtgcgccagaccgtcggcttcaactgccagcgccatctcaaccttcgtgtggcgtggcgcgcatctgcgtgacgtgctgcggcggagcggggtcatgggtgcctccccacctcgcccggccgccgcgcgccacccgcctctcctggccgtcgcgcgcccgcccacctctcccggccgtcgcgcgccgccctgcccggccgcttcgcaccgccctcctctcccgactaccgcgcgccgcctagcctcgcccggcctggagagaggacaaaggagaggggagttggggagagaggaggaagaagaggagggggtaagaatgacatgtggggcccatatgggtcccaccatttttgaatgaatttttttggtgtaactgacatgtgggaccacaaatagcaattttccaaataaaaattaccgcgtaagcgccacgtcactagctacgtcatatgaaaaccgagtcaaattagccacgtaggcaccacgtcagtgaaaaccgccataggacctatattgcaccggttttgatagttgagggaccctttatatctggttttctggttgaatgacctatattgcaccggttttgatagttgagggaccctttatatctggttttctggttgaatggttgaaggacggaaatcggattcactgacaagttaagagacctccgatgaacttattcctatagagtactagtagtataagcccactaacatggtcaaagtgtcaaagcccacaatatgtctgactggttagaactaaggtgacatggaacagatagcccaaatctaaagaattctacaatttgtgaagctggattcagtccaacaactcattcctcggttcctcgccttgacaattaacatagggaagggaaggaatcaactatcagtaagagggttagcagaagactccatagctctagctcaagtgacggacattgttgagataactgcatctcctccttgtgtgccctcaacagacaaccgttttgcgaaaggaaagtggattcagaccaacgaggacctgacttttatgtggtaataacagtggcttcagatcaacgaggacctgacctggttagcaaatatttcgcttccccttgtgcagttcacgactcacagcgaagataaactaagtctaccatcgtatcatgctcaccgaagttctgtagactgacgagaaggccttcgacttttagcagaacaaacagttgtgagtattatacaagattgtgtgtcttgattaagaaacaatatacaatgtgcctatgttctgagtaagacatgcaaagcaaacttgcagtgataaacacgtaacaaggataactattgggtctatgggggcaatgtagtctccagtgaggaacgtagcatccggtttctgatgggaaaccattattacctttactgttttaggcacagtaaactgaagtggaagccacaaacaaccaaattaaggaagagttatgcaaacactaaatggtactccctccatttttatttagatgacgttggttagtttcaatttgaactaaccaacgccaaataaaaaaaagagaggtagtagtagtagtaagttacagggagacgaaactcaatgttatccaatatcatagggtataaaaactccaactcagaatcaagctgaaaggctatactagaaacattatgccgtgatgataataactcaaaaagatcaatctcacattttatttgttgtcacaggatattcaaaccacctagaatgattggtcagtttgtaacacaatctagcttaaaggcttaaagctactaaatggaaagactgtggtactgcagtcaacctatatgacaatctattcagaaatagtgataggtccagcacactagagattttacagttttaaccgaactaaatttaggatatccacttatagtttactctgaacatggaacattgctatgtagttctaataaaactattttcttatatacttacaacggtgctatataacacttgctgtcttgagaacaaggattatattatgcttttcagaaaagaattcttgactaacaaaactaaagcgatttgcagcaactgaaatgtttaataaattctatcagttcagacttcaaaccatgcaaccaaagagggtttcttattgtcattgacaatttgacagacaatagtgagtaaaagcaatcggaaaggcagtcacaggtatccattcgaaacaattattcaattaagtgctagggcataaccacttattgtcatattatatgatacatatataaagtacaaggaacagctctatccacttatgtgtatagttagaagagcctcaaaacctagtactacaaattaaagattactgtgacacaccaagttcatcaactgcagttgaataagatgcagaaaaaggagttcatggtgacaataagcaagataacggccatggggggttaactaaagctcagatcttaccattcagcttgttctggagaacatccatcacagaagcaaagtcagccttcacattgattggtggattagcgtactggcacagcatgtccttgatgttcctgtcatggtagtctatcttcgattgtgtgaacttaagcccatgcgctgtactaacaaccactgtgcggtcattaggcccgattatgcgctggtctcgaagcttgaacaaagcagcaagtgcaaccccggtgtgtgggcaggcaaacattccggtgcggtcagcaagtgacattgcatccatgagttcttcctccgtagcttcctcaacaataccgtcagttgccttcagggcgaccactgcacggtcgacagatactggatcaccaatctgtatggcagatgcaaatgtagtttcggctacacgtggctggaaatcagtccaccctgacttgtagaaccgatacaacggatttgcgtttgcagcttgtgcgcatacaagacgcggcacacgatcaacaagcccaagaacacggcacatctcaaaccccttgtagaaggcatagatattcccaagattgcctcctggaacaatgacccaatccggcacctgccaatcgaactgctgcaatatctcgatggctgccgtcttctggccctcaagccgaagggagttcagcgagttggcaaggtaaatcggtagctcggcggtcacctccctgatgagccgcatgcacccgtcaaagtccgtgtccagcgagagcacggtggcgccgtggcgattggctggatgagctgctgcagagagatgcggtcggcggggaggaacacgatggcggggatacctgcggcggcgcagtacgcggaaagcgcggcggaggtgtcgcccgtggacgcgcagccgacgccgttgatggggcgtgagagcggcgcgcggcggaggcggttcacctggctgacgagcaccgtcatgccgaggtccttgaaggagcccgtgtgcgagatgccgcagtgcttaacccagaggtcggtcatcccgccgaggtgctcgcggccgaggcgctccgcccagaagaggttggagttgccctcgaagagggagacgatgtggtcggagtcgatctccgggagcacgaactccttcttggaccacaccccggagccgtagggccacgcggtgcgccccacgcgggagtcgaagaggtcgcgccagtaggagcccgggaagcgcgcgagcgcctccatgtcgtggcacacgtcgaggagccccccggagctggagcggtagaccacctcgtccagcgagtagcgctcgtcggggtcgtcctcgggcgtcggggggaacggcacgtaccacgccgagaagtcgttcccggggccgcggagccgcgcggcctcctcccggatgttctcctccgcggggcggcggtgcctcgtggccgtcgtggcggcgtcggaggcgcatcgcgcgcggtggggcgcggcgcgcagcgggcggcggaggtgaggcccgccggcgaagggcctggggttggacgagtgtgggtgggcgaagaggagagagagggacgacgcggtggcggtcgccatggcggaggaggcgaggtgcttggcggcggaggaggaggggatggggggagtaattagggaggaggatgggtgacgtggatggggaggttttaggctttaggggagggatgattcgattgatctggacgttaattgggcgcgcagccgttaggaggccgacaggtggggcagattctttgtgatggtatatttgcgtttagtttttttactctctccgtgagcttaaatccaaatacagtaacagtagtcaagctagttttggcttgctactaatgtagataccatgtcatctataaataatgctaataccatggacaacaatcgcaattttgcaacattcatattctatatactcccccatcccaagataaatgtaattttaaatttaacttttatcctaaaataaatacaatcccacatattacttgctcacattaattaatcgcattacatctcaaaattttctccatcataccttcaattaccctctcagtccctaccagctcttatttaatagggatacttaggtaatctctctattattttcctcacacactttttaaaaatatacttacagtggaacagagagagtaagcaacttcatgcaaaattggtcgtgaagcatcggaagatcattatttcaatcttatagcactaagaaaaaaaaaatcccgattcactttttatgaaatgatccggttccctttaatggatattgcaaggctcaattatcggttttcttccatttagatcgataaacgtgtactcattctaaaattgcttatatttatggatgtaggtagcagcttactgttcgcattccattcatattgcattgaaattttagcaccttaggtgctggggtcgactccccatgggagcaaatttttcaggatttaacggtattgtgctttcagtagtaggcgacgtgcccgtcgacagtgagacgcctaaagtgacttcaccaatctctaggatttgatttgctggtccagtctttgaagatgcttataggggtagggtttgcgtacaaggggcggatatacagtagaagaaggaccggtgtcaggcgacaccgacgacttttggcaaaactatagcaaaattgtttacccatatgttataacaccataatctaagcatgattagcatactatagcaccgatagacacattatgacaccaacgaatcgatttcctgaatccgccactgttgcttacgcgtttttataggggtgagtatgcgtgcattgtgagtgtctgttgtactgtgtatttcttttaaaaaaagtgaatatccactgagctgtacgctatcctccatttttgggacaagagcgaactaccatcgcatatttggaacgtggaaaatcgagatcgagaggacaacgtcatgcaaaatgattttggatggatagtaactacgggctggaggaatcgtcggggaccccaccagagccgctgcagcactgctcccacacaagatcaccatatctctgaaaatggacgcgattctacatttctacgcaacaaatagtggcgaaagcgaacggcggttcagcagcatattccagcggtccagccggctcctgccgtgctgcaaaacaatatcttgtgccgccgttgctacgggtttatgagctcatggcgtgcagcggccttgcaagaacaagaggagaatgcacccggtatggctcaattcagtgtgtgcaagtaacaacgtattcaaatgagtgattacttaatcaacacttgtatatacatatagaaagtgagacaaggtactgtggaacactgaaatcctgtttaacagtatgctgacgatttccaaagtatagattaccaagacaaaaaggcttctctctctctctccccctaccaggtcaccaaattacagtgctacaattgttttttgaaatcaatacaaggctacaaatgtaaggaacagaagtacgcatgtagtgtgacgtctctaacttccctgtatttaagctgctggtgaaaatcaccgtaccaagttgctgcagctcaaataatctcttccgtcctcgggagctcaggatttcctgagagtaaaatgaccaccatgtgtgcaagtgtctactggataggaaacattcagatctgacataagaatctttatgttataagaataaattgaacactttatcatctattcaacatttcagaggactgtgcggtgttcacataagttgcgctcttgttgaatccctcaagtgccattattctaactgcctccaagcccctatggaaagcgaaatcaagctgcaaaaagagatgtgtacatcttaaacaaacagtgctatgcccagaacagaaaatgaggtaaatatgaaaaaaaaaagggtttcttgaaagcattctaattaaaacctcttcctgttcttttctgttaaatggtcggagaacaaaattggcaggatccatcttcccaggtggtcgtccaatgcctgcaagatatcaccgcaagaatattttcagacatggtaactgagttgaaaaaggagagaagcgctataccaattcttagacgtgggaaatcacggttctgcttcaaatggttgataatgcttctcaccctgcaagtggtgaacatatggatgagaggttccccaagagaagatgtgggagaaacaaatgtacaattgaacatcctaaagtttgtctgatgcattttctcacaactatgcaccttagatcagttcttaagtaacaatggataatgcattgcattaggacaagtagaaagatggtgccaacggtatatgatgagaaattaagaatatccttttgcttaggtgaacttcagagttatctacctccaaaagttaggtcttcagcataaagttagtaaaataatcactgagttaacacatgcaggtaatgagtttcgaccattttgtaaaagaagtagaagagagctgagaaattaagaatatccttttgcttaggtgaacttcagagttatctacctccaaaagttaggtcttcagcataaagttagtaaaataatcactgagttaacacatgcaggtaatgagtttcgaccattttgtaaaagaagtagaagagagctggagtacccattatgaccgccatgtccacctttcggcagtagacgcaattttgcaaagggcaagtctagatcatcatacatctgcagagaataaaaaatgaatgaagaatcaaaatatagcaatctgttaaaaaaaacagcaaccagaaactcgaggatagcactttaccacaagaacttgattaagtggtatcttgaaatatgagaccaactgccccacctgtataactcgatttgtcaaacgaaaaaggtaaaaaaaagaaggaacaactagtagtgaaggttgttttggaatcagtatacttacagactcaccacttgcattcataaaagtttgtggcttggccagcatgataggggcatctccaatacgacctaaatattattttctgttatgaatgtttgatagcactaccttcagaatttcaaataagtatatgcacctgctcatgtttaatattcaagcatagagtatcttaaacaaatagcatttgtttataggtaatatttatgaaaaccgcataaatattgttagagttgaaaaggtaatgtgcaagacttgaggaacaaagtacagctctgggaatccagatagcatggcttctttcaacacaagatgtatcagttgaaaagaattatattaattgtcaatattaccttttcctaccattgccttgaactgcatactgctgagggatataccttcagcttctgctataacatcaatcatctcgaatccaacctgtgaacaatatgagcgacctcaaggttagcaactaaattagatacataatgcattggtgcactcatattgggactgtgtcatgcgtgaccatttattgaacaaaggactgaagttatgtgcaatatatatattccacgaaactgatactgaagacatagaaactgagaatcagacgaaaaaacattgtatgaattagatgcctcaaaaagcaacgcataatgaattttgctgccctcaaagtgagatctcctttgtaatatatactgtcaacaaaaacttgacaactacacattgaaatgttcttttcaaatacttcatctaacatgtggccatttccatacttgcagaatgggatcgagctcttcaacagtcagaaagagcgcgagtatgattatttcgtctatgaacaactaccagttcgagtattcgaccctaataactacagggagtctagtacaagcagctcaaaatcaggcaacttacgttgtggcgagtcccttggtacactttcccggggttcccgagcccgacgaacaaccacggcttcagcgcgccgccgtcgcccgcggcgccgcggctgacgaggaggccgctcggcacgcggtggcagaggcggggaccggcaagcatcttgccctcgcgcgggcgagtgagaggagggggcaggggattcgggaagcagaggcgccggagagcagccgcatcgccgtagtcgccgccgtcgccgccgcccgtgaggaggaggaaccacgaattggcggccggctcggaaccaggagcgcttttccatcgtctactctgatcggacggctatgagtaacccaggatcggaatccgacggttgcctccgagccctcgatctcggccgcgaggcttcagaatccgacggtggaaatgccccgtgcggcacgggctcgagtcccttctctgttctctctctctcgctacgcggtgggcgcaagggcgcaaagcgacggtcactggcgtagcgttcggccgaagcgagcccgtaggccggaggagccagccgccatcgtcggcgactaggccgctatcgttacagctaggctaatagtacagctacttgttacctccaaaaataaccacatcattctattctagcgaatgacacaagctaatcaatacaataatagagtgcgggtttatttggggaggttaaaatcatgagaagcagctgattgttaaccagcttataagaatctgaaaatagctaagagtctgactgttagtttattttctggattctataactatagcttcttaaaatctagaccaaaatctagactgtttggggaaacttctagttctgggagaagctgtagcaactagaaactctccccaaacagaacctatatatacatctctacgcacttcccatggctaggtttgatttttttttttaaaatcttcacttgaatgttgcaattggctgagagcagcagcaatattgggagcagtgtacaaccgggctgtaaattagtcaccgagcttctctctcttttccattcaccctccagcttactcctcaaacctacgtggagtcagtatcgccggcgctatgagtgttattttaactgctcttagaaggtcaattcttgcgtcctgcataacccgtgtcggaggccacagccgaaaactgcaggtgttgtggcggtgaaccttcacttttccatgtcaaagagattgccataacttacgttaaaaaaaagattgccataactttttttttgcgctaagcttgtagttgtaaccgctagttactaatgctctctaaacatcctagcttgctatattttaggatagaaccggtacttactacaatagccactctctttgagctacatgattacacggaaaaaagaaacaattctcacatgaatagcaaatatttaccttgtttcaactccttagattaaacatatatttccaccctatcttcatgccatcagaaatgaatggccacatcgttacggtatatttacaaacgaaaaataatttataaatatattttttatatacgtgttcttagcgatttaaaagtaaaagctgaaaaaataaacttcgatgtaaaaccccaaaatcaactctaaatataaagttaaaaatttaaattttggctgatacttataaacataagaaaaggacgagggacaaactcttccatgctagtagtaactgttcgtgctgttgtcaaacagtagtctcgcgctactgtttgtattcttttcgaaaaaaaaatgaactagctatactgcttttttatatgtgctaatggaatcctagctactccgtatttgaattgacaaaattaaagcagcatgtcatgcattctgcagttctctgcagagagaaattggatctgcgcacagcagggtcggtttagttgtcacatcgaatgtttaaccgtatgtgggaagggtttttgaaacacgaacgaaaaaactaattttataactcacatgtaaaactgcgagacgaatcttttgagcctaattagtctgtcattagcacatgcaggttactgtagcacttatggctaatcatggactaattaggctcaaaagattcatctcgcgatttcccccctaactgtgcaattggtttttcttttaatctatatttaatactttatgcatgtgtctataaataaaagttggatgtgatgtttttggaaaaataatttgggaactaaaccctattgccaaggtggatgttttccgcgagacctgcaagtcttccccgccataacgtgtacgtttgcacattctcaagcagcaccagaagatgaatcagtttagcgaaaactccatgagacggacaaaaaatgtgacagtcatgcgttattattactcccatccctctctaaacgatgtacaaactagacaggggatgtcctgtcgattaggcaagaccgcaagactctttccctaattcccagcccgtcaactggttctttatgagtcacacacgtattcagggtttcacactgacgatgccatgaagtgcagcagagatataccagtccagtgtgatcagcggtcgtgtttcttccagtccagtcgctttccagcaagaacgtgtccagtggggggcgctaactatcagtctaccaccagtcagcccccgaaggaaaaatagacaaggcagcaacagttttagttcatactagtctaatctttggaaattggaagcattaacaagtccgtagccttctttttgtccacaactagagaaaaaataacatgagacgtttctccaataaaagttagatagaaatttagatatttgtggcatatttttcaaactgctaaataatacgtttcatgtaaaatttttctatatgaaaaattactctaaaatatcagataaatatattttctcaagtttgtaataaaaaaacttaattagtcatacgttgatatcatctcattttatataaaatacttaatttttatcttcatcttcatctatatgagtttcattcgaacatgacgtactacgctgtgtattcaaggtagcactagcaaattaagctgtacactcacaggaacaaatgccaatttcgtttccgtactacgttcccccttcactgttttctttggtgagatgaaaaaaatgtcatgctaattaattaagctgtgtccccgcaaaaagaaattaattaagctgtgcactctcgatcgatcggttcggcaaaagatttattatttcctctttcgcctattctttcatcacggtcacaaacgtgaacatgcacgtacagggaagcagcttgtgaacgagctcgctcgcatcaacttttaggccgcctttgatttaaagaaaaaacatagaaattttgaaggattttaatcctacagaaaaattttctataacaccctttgaaacaaatgatcaaatcctatcatatcctttggaatttctatggaatggataattctaaagagattttcttgaggaaatttaacaagagctccaacctcttgaaagctttccttttagtctatctctttcatccgattttcttcccttttgccgcggttcattcaaacgatcattcctgtgttttgcaatcctctattttacacttgcattcctattagggcccctttgattcgcaggatatgaaaaacacaggaataggaaaaacacaatatttgaaatggtaggattttcaaatcctacgggaagagaaaacagagaaaaacgtaagaagatcctttgatataggcatagggaaaacaaaggaattcgcaccaggaagaattccaagaggtcttacctcttttttagtttcctttggaatccactcataggaatgcaatcctatggaatttatacttgccttttctataaatcaaagaggcttgaaggaaaaaaatcctttgaaatcccattcctaaaaaaaatcatttggcattactttaaattaaagaggctctagaatcctacgtttttcttattccttcgttttttcattcctaagattcaaagggatccttagtttgtattccttctccagttttcccaattcagctttctcgtttttcgtgcgcacgctttttaaactattaaacagtatgttttatattaattatttttttaaaaaagctaatacttaattaatcatatgataatacgatgcatcattttgcgtgcagccttagtttccatggggggcaaagtctctggtcggtcttcccgatgtacgtggtctggcttctccagtctccactatcgcaactcccaggatataagcttggccaccacgccatgcacagctaccagcctcagccagctgccacctccgattccatcgagctctcctcctgccaatggcgctcgtcttcttcttcttcgtcgtcttccacctcgccgtgctgatggctgcgctcctgctcgcaagcgcgccggcgttcgccacggccgacgatctgtcggcgctgctggcgttcagggcgcgggtgtccgacccgagcggcgtgctccgccgcggcaactggacggcggccgcgccctactgcggctggctcggcgtcacctgcggcggccaccgccacccgctgcgcgtcacggcgctggagctgcccggcgtgcagctcgccggctcgctggcccccgagctcggcgagctcaccttcctctccaccctcaacctcagcgacgcccggctctcgggcccgatccctgatggcatcggcaacctgccacgcctcctgtctctcgatctctccagcaaccgcctctcaggtaatctcccctcgtctctcggcaacctcaccgtgcttgaaatcctcgaccttgactcgaacaacctcaccggtgaaatccctcccgacctgcacaatctgaagaacattatgtaccttggattaagcagaaacgagttgagcgggcagataccacgtggcatgttcaatggcacgtcacagcttgttttcttgagccttgcttacaacaaactaacagggagcattcctggtgctattggtttcttgccaaacattcaggtgcttgtactgtcagggaaccagctttcagggccaatacctgcatcgctgtttaacatgtccagcttggtacggatgtacctgggcaagaacaatctctctggctctatcccaaacaacggaagcttcaaccttcccatgctgcaaacagttaatctcaacacaaaccatttaactggcatagtgcctcaaggctttggggcatgcaagaacctgcaagagttcattctattcagcaatggcttcaccggtggcataccaccgtggctggcttctatgcctcagttggtgaatgtctccttgggtggcaatgacctttctggtgaaatccctgccagcttgggcaaccttacaggtctcacccatctggatttcaccaggagtaatctgcatgggaagataccaccggagctgggacagctgacacagctgcggtggctgaaccttgagatgaataacctgaccggtagcatcccagcctctatcagaaacatgtctatgatctctatccttgacatatcctttaactcattgactggatctgtgccaaggccaatatttggtccagcccttagtgaactctacattgacgagaataagctcagtggggatgtcgatttcatggctgacctgtcaggttgcaagagccttaagtatcttgtgatgaacacaaactacttcactggtagcatcccaagttctattggcaacctttcctccctccagatctttcgagcattcaagaaccaaattactggaaatatccctgatatgacaaataagagcaacatgttgttcatggatcttcgcaacaaccgatttaccggggaaattccggtatcaattacagagatgaaggatctcgaaatgattgatttttcttctaatgagttggttgggaccattcctgcaaatattggcaaatcaaatctgtttgccctaggccttgcctacaacaagctccatggccccatacctgatagcattagtaatctaagtcggctacaaaccttagaactatcaaataatcagctcacttcagcagtaccgatgggcctatggggccttcaaaatatcgtgggtcttgatctggctggaaatgctttgactggctctttgccagaagttgaaaatctgaaagcaacaacatttatgaacctttcttccaatcgattttctggtaatttaccagcctcacttgaactatttagcacactgacctacttagacctttcatataactccttctctggaacaattccaaagtcctttgcaaatcttagtcctctcactaccctgaatctctctttcaatagattggatgggcaaatcccaaatggtggtgtgttctcaaacattaccctccaatctttgagagggaacacagcactctgtggtcttccacgccttggtttcccccattgcaaaaatgaccatcctcttcagggtaaaaaatcaaggcttctaaaagtagttcttattccaagcatattggctactggaataatagcaatctgcttgctgttttcgattaaattttgcactggcaagaaactgaagggcctgccgattactatgagtttggagtcaaacaacaaccatagggctatctcctactatgagctggttcgtgccacaaacaacttcaatagtgatcacctactaggagctggaagctttggcaaagtcttcaagggcaatctagacgatgagcagatcgtcgcgataaaagtcctcaacatggacatggaaagagctaccatgagttttgaagtcgagtgccgtgcacttcgcatggctcggcaccgaaacttggtgaggatactcaccacctgttcgaatctggacttcaaggcgttggtgctgcagtacatgcccaatgggagcctggacgaatggttgctgtacagtgacaggcattgccttggattgatgcagagggtgagcatcatgttggatgcggcgctcgctatggcttacctacaccatgagcactttgaggtagtcctccactgtgatctgaagccaagcaacgtgctgcttgacgcagacatgacggcttgcatcgcagactttggaattgcaaggttattgctaggagaggacacctccatattctccaggagcatgccaggaacaatcggatacatggcaccaggtaatcacttgtcgatttaccgttcatctttggttccactgaaatcgccaatttctgcagatcccccttgatctttgtttaccatgaacatcacagagtacgggtcgacaggaaaagcatcgcgaaagagcgacgtgttcagctacggggtcatgctcctggaggtcttcacggggaagaagccaaccgacgccatgttcgtcggagagctgagcttgagggagtgggtcaaccgagcgctcccgtcaaggctcgccgacgtcgtacatcctggcatctctctgtatgacgacacggtgagcagcgatgatgcccaaggtgaatcaaccggcagcaggagctgcttagcgcagctgctggatttggggctgcagtgtaccagagacttgcctgaggacagggtgacgatgaaggatgtgactgtgaaactgcagcggatcaaggaggtattacaagcctagatagtcttgtcctgcagccctgcagatgataacccaaagctggcaaggccatgtgtcatctgtggtggttgcaaatgctgaactgcatcatgaaagctgtagccttccttgaaaagatacctgtaacagtagttgagttgcaggtttgcagccatctaacaaaaagtaatatactacgtgttagagagttgtttagggcttaatcctccaataacctgccaaagaacgcaatgaatatttctactagttttcaaaggaccactgaaaaatttcagttaacccaacaatatatgagaggtccacgattccatcatgatgcccacagcccaccctccatcgtacagaaaataagcaaacaatgcaagcaagcaattaaatacttaatggaagggaagttgtgcacgtacagcttctcttgtattcaatgtactactatcaattatcagtgatcatgacgctgtttgatggctccatggatatggatagtctagcatggggaagagcgactatcatcaacttgcttcgctgaacctgaccgccttcaataatagacatgtgaaatggcggttggtgtgaaatggtgcgttggtgagcacgattcagagcatagtctactcaggattgaccaaacacatggaaagtgttgcttctcttagactcttagtcaactgctgaataagggttaagggtgtgtttagttggggaaaagggaatttttggatgtcacatcggacgtttgaccggatgtcggaaggggatttcggaaccgcaagacgaatcttttaagactaattaagccgtcattagcacatgtgggttactgtagcacttatggctaatcacggactaattaggcttaaaagattcgtctcgcgatttcccccataattgtgcaattagtttttcttttaatctatatttaatgttttatgcatatgtccaaagattcgatgtgatgtttttggaaaaaaaattttgggtaactagacgggccctaataagaaatggatctctaggatagaagcgcttcagtatttttacagttctttgatacctgaaacaacagccaggaacaaacttttaaaaagattgtcctgaaaaaaatcacaccagatgtttcattcgtgaaaagaaaaggcataagtaatggtgccaagcataccaagatagtatcaaagatggaaatggcatatgaatatacttggagtttgctttcaaaaaaatatacttggagttagattatctcccagtttttatttaaaaaaaaatctagctagcgtagaacgactatttaagtgattttctgaaaaaaaaattaaaccagatgttttattcttggaaaatcaaacaaacataagtactggcgccaagcatgaagcatcaaagttggctgtgtacacccatgttggtgtagagaccgggttttaatctattattaaaaacagaacagaaaataaacgaagctatcaatgacggaaatgacatactcctacagctttgctccttgacttctggaagaggttgtttcttggaaggaattcatttttttccttctttctattttgaaactttgaagtgtaccaagaaactgcagtgtacaaccagctctgaaaaatgaaagtttgttttcaaacgaaaaagtctaaaacgctttcttcctttcacacatatttccactaaaaaaaacaactttttgaccattcaacacaatgcacatgtcaattgcacatcccacacggccacacttccaataaaaccaccaatagaaccagcacactgctcatgcgtaattgtgtatcctcatcatcaaccttcattccttcactaccatggctcttctctgcatcagcatggtgctcctcatcctattggcaccatgcgccacttcactcacccctccatacaacaacacagacctcgctgcactgctcgacttcaaggagcaagtcaaggaccctaatggcatccttgccagcaattggactgccagtgcacccttctgctcatggattggggtctcatgcgacagcagcgggaagtgggtcactgggcttgagtttgaagacatggcacttgaaggaaccatcagcccgcagattggcaatctctccttcctctccagccttgtactcagcaacaccaccctcatcggacctgtgccaaccgagctcgataggctgccccgactgcaaactcttgttctttcatacaacagcctgtcaggtaccatcccctccatccttggcaacctcacaaggctcgagtctctttatcttaatagcaacaaattctttggggggattccacaagagttggcaaatcttaacaatcttcagatattaagattgtcagataacgacttgagcggaccaataccacaaggcctgttcaataacacacccaacctgagtaggatacaactcgggtcaaataggctaacaggagcaattcctggtagcgttggatcattgtcgaagctggagatgctagtcctagaaaataatcttctctcaggctccatgcctgctgctatcttcaatatgtcctacctgcaagccatagcagtcacacggaacaatctcagaggtccgattcc

SEQ ID NO: 26632 - DNA, 1253 bp, Oryza sativa
gacaacaataggatcactggaagcatccccagtacattggctaagcttaccaacctactgatgctatctctcagaggaaaccagctaagcgggatgatccccacgcagatcacatcaatgaacaacctccaagaactcaatctctccaacaacaccttgtctggcaccatcccagtagaaatcactggattaacaagtctagttaagctgaatcttgctaacaatcaacttgtcagtcctattccaagtaccatcggtagcctaaaccagttacaagttgtggtattgtcccaaaactcgttgtcttcaacaataccaattagtttgtggcatcttcagaaacttattgagcttgatttatcacagaactctttgagtggttctctacctgctgatgttggaaaactgacagcaattactaagatggatctatcaagaaaccagctatcaggtgatataccattttcttttggtgaactccagatgatgatctatatgaatctatccagtaatctactccaaggttcaataccagattcagttggcaagttactaagtattgaggagttagacctttcctccaatgtgctttcgggtgtcatcccaaagtccttggccaatctcacttatcttgccaatttgaacctatctttcaatagactggagggtcagataccagaaggaggtgtgttctcaaacatcactgtcaagtcattgatgggaaacaaggcactatgtggccttccgagccaaggaatagaatcatgccagagcaaaactcactcaaggtcaatacaacggctactaaaattcatattacctgcagttgtggcattttttattttagcattttgcttgtgtatgttggtaagaaggaaaatgaataagccaggaaagatgccactaccctcagatgcagacttgctgaattaccagttaatctcataccatgaacttgtccgtgcaacaagaaacttcagtgatgataacctgctagggagtggaagctttggtaaagtcttcaaaggccagctagatgatgagtccattgtcacaataaaggtcctaaacatgcaacaggaagtagcttccaaaagctttgacacagagtgccgcgtgttacgaatggctcatcaccgcaacttggtgaggattgttagcacttgctctaatcttgacttcaaagcactagttcttgagtatatgccccatggaagtttggataattggttgtactcaaaatgatgggctgc

SEQ ID NO: 26633 - DNA, 1777 bp, Oryza sativa
tcctaacgggctatgggcttcattgtttcctttgccttttataagccaaagctaaaatttaaattttaaaacttaattttgaatttgattttgatgtttattcaacgtattatttttcagctttggcctttaagtctctaagaacataaatacaaaagttttactcacatattatttttttaattgctaataagacattacggcttataataagtcgtaagcaatccatggggacccatatgtcaaacagtcgtctggttccaggatccagaattagaatgaacaaacagcctatgagatttgtcagctgtggtaagcttaggatgcatttcgggcttgcagcacagttcggatgatctactgatgatgtagggaggagattccacctgaagtatatatatactagattgtttgagaaattttgtcaaaccgtcgtaaggttttcagaattcagagtgaacagcctatgagatttgacggctgggcgaacaaaggatgggttgatggttgctgccattctagtccattgtgaatgtgcgatcgtgcagatgattggtacagtacgttctgatgctggaagaagatatcccacctgaaatatgaggccactggagctagcaatttaaaagggagcgttacaatttctatggccatggaagacgtgaagtcccgaatccaacttcgagcaaataataaggttctgctgcaatatgagccacaaataaactttccaacggggcaaataactagattttgatttcagaaacaggcacaacgggtaaatgtttgcaagctcacaccgtactagcgtgcgcattgtgaaaacctgacattgaacatggcaaatacattattggtttctgaagtcctcggggcctggcacttggaacgaaaatactcgctgaactccaggacaccatggactcaaggtccagtctctgaactgatcaacctccttgtggagcaccaaacctgtagcttcataaccgacccacttgatgatgatccacgttccacaacagctgagctgggcataggattgcagccttatcttcttccagatatcgcaaccagaactgcagttgtcctggcacgcaaaatgtgtatgcaaaaacaactgggtggttgtattctgggaataatctggcttcacctgttcagaagttgctgtggcttgtgaactgtgctgaaagacctatagttttgtaatgttgctttcagacagttgacaagatggagaacggcctgcacctttcaactcttgctggctgttgaagtctcgagtatttcatctgctaactgaaattaaagactaatgatactcatgacttcaaagacaggtgaacaactgcattcttcaaaatctccaacactgcatcatggaagagaaggggggaatttaagaaataagtatcgtactctaagtggttaaataattgaaagcaatttgtagtcaccaaactcaccctgtcttcagccaaaaacccatcgaaactgcaaattcatgatctagacaaacattcacatctcccacctgataccaaagataatgtgtgggttggtgcaggcaaaccaatgagagcaaaaagggactaaaatgacatcaagcttttcagatagatttaccgaatatatgatataatcaacaaaattcaagaagttccatacaaaaacatgttgcctgcaaacacaatatttatgatgttaggaggaggtttagaagaagataagcaaactatccagattcatggcaatctagaatgtcaatcttcaagat

SEQ ID NO: 26634 - DNA, 1887 bp, Oryza sativa
ataatcatgatttgctccttaagttgtgcgtggcctgtttttatctcagagctaatctcgcacggcaagacctgattgaacgcataggcattagctatttatttcctgcctttcgagtagtaccacactagttcagcttctgaaagaaaagaaaagaagctgcaaataggctgggcactactagctttatcacagaatgtatgaattttctttcttgatgaaaaatgaaagcagtacttgtcctctgtttaaaaaaagttagcattatgccgttttgattatttcatgataaggttaacgttctgtatgtttcaaggagaaattcatgtctcatagtattggtgattcttcttttcagttgctgctcaaagtaataccagaatatgttgtcagtgatattgtgacatgttttttcaaatagtaagacttgagctctactcatcagttcatcaaggaaagatgggactatgaagactactctaagcaggtaaaagtaaggctgtgtttagatccagaggtgaaaagttttggcgtgtcacatcggatatacggacacacatttgaagtattaaacgtagactaataacaaaacaaattacagattatgtctgtaagttgcgagacgatttttttaagcttaattaatcagccattagaaaatgtttactgtagcaccacattatcaaataatggagcaatagacttaaaagatttgtctcgcaatttacacgcaatctgtgtaattagtttttttgtctatatttaatactccatgtatgtgtccaaacattcgatgtgacagggtgaaaagtttttgtgtgggaactaacagggcctaagccaaaattcaaaagctacctagctttgctctgtggcataacctgaccctgtatgcgaaagcatttatatgtcaccttttgctagttgattagttgatcagagcatttttgctgcaaaccatcttctcaagccttcaacagagcctcaacctcctcctgcactatccatagttctgcagtgatttgcatttaatgaaaagatatgtctattcctctcttttgattcattacaagcgtgtggctcagatttgcaatttgcaactgatactacttacataaagccttttatatggacttgtcaattgtaaaaacctattataattcctcagagttcttttcttctgaaccattttgattagtttccagatgcactaaagagggtatttcaggatatttcaccaggtgagctccattgcttccacagagagtagtaatttgacttgatcttgtttaacttgataactacttcattcattggaactctgtcatcaggtgcatctcttgagcaaagcaagcccaactcaattatggatgctagacagatattcaagatgattgaatcctcagatagcttactcgaatcctcagtaccacccgtatgaccatcttgttgtagactacagtcggcgacatttgagagctcatatgggaatgcttgactaatccattgcctgaaggtcaactcattgacgaacattggatcagttggttttttccttgtgaagacttcgaggaggacaattccgtagctgtatacgtcacttctgcgtgatgcttttcctgttgatcctaactctgtttgcaccatgtcaaaagagaactggtcagcttaagttagatgaaacaagaatacagattgtacagactttacaagggtaatcacctggtgccatgtatcctacagtgcctggcatactggttaatgtgataaagtggtcatctccaaacagccacttggaaaatccgaagtcggccacaagcgccaccaaatcaatgtccaaccaaacaatggttgggttttaaatcaaaatgcaggacaacctcaaag

SEQ ID NO: 26635 - DNA, 465 bp, Oryza sativa
ccccatggttaagtatgtgaaggacatatccatgtcattcaaggaggccatgcaaatcaacagccaggaattgaggaagcgtactattgagaagcaggctgcttcagtgagaaattgtatgaagatggccttcgagtgtggaattgagcaaaccactgagaatatttttgcaatgtccaagatgtttgagaatccctaccaaagggagttcttcgttggactaccaaaccatgagcttaggttcaactacttcagcaaatggagcagggataacaacctggtttagttaggcacctcttttatgtggtccgtttgttgtgtccaggaaccgtttggagcttttgttatgtgctgttaatttgaacctcctttatcacttttgttatgtgcagttcgactttgcagctgttaatttgatgttatggaagtattatttgggttgtttgtgttgcatcgatgaactta

SEQ ID NO: 26636 - DNA, 2698 bp, Oryza sativa
aaaaagatagtaacattttcaatcaagacaagtttattatgaaaatatattcaattattgattcgatgaaactaatttattattataaatatcattatatttgtctataaacttagtcaaacttgaaacagtttaactttaactaaagtcaaaatattttataatctgaaatggagggagtataatgtaatgcatgcagtatcgtgtgagcgagcgcgtggtgcgaggcctaccgctgaattgcaggtaatttctccatggctgacggtgctgtagttaaaggcttacggctacgctaagaaatactctctccgtctcataaaaaaacaatctagtattggatgtgatacatctactactacgaatctggatatacatctgtccagatttattatagtacgtataatgtgtcatatccagttctagatttaccttttttttttaagaacggagggagtagagagagatacacatcatgaactattgttacatctgcattggcaacaccagttgcgcgttaggaataagccgacactgaagaaatttagtgggcaagggcaaatgaaagattgaagggccttggtttctttaaccacgtaattttttttcttgaactcgtaaaagccttacgcattggcatattaacataaaaaagaattttgtaactgcaacctgctaatgtagatcatgggttacaaaggagaggaaggacacaccgacacactaaatagactaggaaaaggaaccagactcataagaacaacaagcaaaaaatgagaaaaggagaaagagccaatgaccactactccattaaaaaaaactaattctagctacgaatcttgttcatattcatagctatgattggatttttgtggaataaaagggtaagtgccaaaaaagatctcctagaggattagataatgcagcaacccaaaactctccttacacaatgcgattagccactgtctccattgtgaaaagtatccccttgatgatacgagtgtttctttctagccacaagtgctaggttacaaggagatcgagggagtcgaacctcctttctattgtgatcctgtgttgatgattgaccaacaccataaaccttactctcttcatcttaaaattttgtagtattaggttgtgtttaatttgatactagttcctttattttgacgcggagaaagtatgagctaatggaaaagctatcaccatatagttgtacgctgtcgcggctttttattttaactgttgtatcattttgttgcttactacttcctccattccataaaaaatataatcagaattgattttttttaccatgtttcttcacccttggtggcagaaatcagataatacaatgcccccagaagccaacagcttatctctgatccagtcctgacccacccaagtagaacagtggctcgtgcagcttccaggaaggaagtgtccaaatgcatttgcgtctgtactaccaagaagtaactatactagtagtacgagtagtactagacaggagacgatctctatctccctatgggcagaatcaggttgatttgttgctgctattgaaagcggccgggtggtggccgagattttgtggcgcgcgcatcgcccgtcgagataacgtcgacttgggcttggctggccggggaggaccacgtacgcggctggcaaggcaacgggacaagcgatcttactcggtattcggggtgggatatgcgtgtgttgcccttgggatgctttccgcctttccggtggtgtgggcagatgggcacgctggttcggcttcggcacaaatggatcatattctaatgcatgtgcccgagtgagtacctgacctccttgtttttaactacttttttaagtgccaatttgctcgctgcgtgttcgttgtttaaaattgtggagttcggatgagaatcatggttacaacgtggactacaaaaatgaaaaatcctagagaaagtggatgaataaataagcagtgtgagcatacttcacctgtactttaatatttgtgcaaatttgtggagatgatatgtgtgtgtatgtgtgtgtgggagctttttacaatcctttaggggagaaggtaccatatccttgaccgttaattacgcgtgatctaacagctcaaagagcccggtaccgtccaaatattgcgcccatgcgagagcaagtgtaccaatcgtgttttggtcgtgggagggtaagattataattttgcatcaacctttcccccgattccgattgagcgacctcccgatctccctcgtacgctcgtacaccacctccctgcctcctccattgaccgctacctccagcgcatcgccgcattggtgtcgaccattgcatcctcttctccagctctcttgcgaacatcaacggtcatcacctcatctactccctcccattcatgatccgatgccgccagctaccatctgctccactcatgctcaaccacgatgccgtctgccgctgcattcttcgctcatgcttgaacaccgagacctaggttactcaggtggtagccacaatattatatcccttttaattaacaattagcacaataattttggcaatatagattattttgtatattacctatgtacatacacaggtggatcaaatgtataataaaaaatattattaacttatatgtttgcgaagaatggtgatagacgagtttacacataactgg

SEQ ID NO: 26637 - DNA, 6149 bp, Oryza sativa
tactagtacctggacgagtgaatgcgtcatgggaaatcttaactaaaactgctttggttctacgatagtaggtagatgcgtccaatgcaatcgttgcaacaacagctagctacattttgctccatagattggcacttccgagtacattaacattaccatattgttgtgactgtcacgttttcgattgtttctcgcgtgacgcactaacttggctcactagctagtttagctggtagtggcggatacatgtacttcacacgcacaagtactagtgtatagtttggtgcatgtccatatcatcatgtgtagctgtccaaagtccaaacaccagcagattatctcttaggatccttggcttgtctttctttactagtgcctactaatctcatgtgctatatctcaaaactaggaaaaaaaatgttccaagtctcgtttaactacaagaaaacagagtccactgtcaaaagtcagaagagcgcttcttaatcaaactatgctagctgagcctatgcgttctttaattagctcgccagcgctagattacagtcagggaactgaagtcagaatatacatttcaggccatcagatcactacactagttatgttcaaccacaagaacagtgtgctatctactacaactagccacagtgctgtagtcaccggtcaaaaagactacacgagaatctccatgttcatgcgtgcgaacaattaactcctccaagattgtctattgaaactccgaaattaaagtgattcacaaacagatccagtacacacgcacaaagcagaactgaaaggtgttctagctaccgtcaatcagtaggctgatgatatactacaccaaataccagagaattaatttgtaagactaccccattgtttaggaatccgtctgtggaaaacaaacttcacatggaaaggagaaaagaaatggcgcaagtacagctccaagcagggcaaccaccaccaccaccaccaccccgcatatctctcgggtcaaaagtgcgtcttaaacaaatcgctgaaccaaaccggagtcaagttaaatatgcaaggcgcgcccaatgatctcatctgccgacgacgatgacggaaagctagctagagcccaacgcttttctgctagcagatcgctcacattcacaggaccgatgagctctagagtctagagcgtctagatgatggatctgtacgctaactaccgccatgtcagccagataaactccagggattaatctgttcacagacggctccagcatgtgatgtgaacgtacgggcttacgtgtgcacgcagtagatggaaggaagagctcgtagtagtaggtagattaactaacaaaagggacaaaagcgaaagctcgcgtacgatttgctttggtgatagggaggaacacatgcgtgggcggctgggctcgcgcgcgcgtgctgcctgtacatgcaggatgagcccaaaaaacccttcccctcatgtaacgatctagccgcagggtacctagtactggacgcggagagggatactagcgcagtagaaaaacgtgcttgcgcgcgggcgcggcttgcgacgacgagataaggatggggggacggggcgccgtacacgtccgggcgagtgggattactctcgatcggcgtggtgcagtgcaggagcaggacggccggtgcgcggtgcgccgtgcgccgcgtggtgtttcctttggttggattcggatgagatcggcggggttttagcgcggttctcctcgacctaatggctttagctgtggcctttctcgtacgtgccgtgccgtgcgccgtgcgtctagccacgtttcgctgcacagtggggcgcgcgcgcgcgcggaggaggcgacacctactacgggcctgttcggtgtgactagatagcagccagccgctacagtagcaacatgcaatttctacataaccgctgatccaatgcgaccctcagcccgcaggttgatctgtgtacctaggcgtgaagcgtgataggttggggaacggttgaatcgctagctgccgcggcgcgtgcgtacgtaccgatcgtacgtgatcgatctagctagagctgcgcaagggacattattcaatctagcagtgcgacatcccggcatgcaccatcccccgtgggacactaaaccctcgtaatagagtcccgattgataattcgatatggatgccggctgaccctccgctaacaagttttaattcatatgcctgtttaattttctttcactagtatgaaaaatgttatcgtgctactatatcacaaaataattacatttcaaaataaattaaagacagattagcaacaaatataatttaccatgataatcctatttaatagccgcattgtatgcgcatattccatacgtacacttggttaaaggaaggttgagaccataagccaacttaattgctattcttgattaaaagaaatgcagtatttcacctcaataaaactacattttttagattaaatgatacaaatgtactcctctgttaaaaaaaagttccaattttagaatatatctggacattatatatgtccagatacatctttaagattataatttttttatggaaggagtaattattttaggacaaaggttgcgtatgttaacgactgtcgaggagtgatcctctctagcggaagatcgtgagatctcccttttgtcagttcggccggaggaaggagcttgcctctagaaattgcgtatccgccctgaaggctgctaggtagcgtgtgcgcgacaagattatacaggttcgggccgctatggagcgtaataccctactcctgtgtgtgggattaaggttgagtgttacaagggttcctaaactccggagagcgttcccgcttctcttctcctagagctcaggcttactgggagtcgtcccctttctcggtggacagggtcctccttttatagctcaaggggataccacatgcaccgcctctacctactcttctacggggtggggaccaaccctaccttgaacgaatcatgatctgtgccttcgcctggaagctaagccgcaccccgtccttgagcgggacccagcgccgccccccgtgtgacacggggtacaacactgtcattccctcataaatgggtgaagacttggggtggtcctctcgtggagggagctccgaatgacactccgatgggacgggtcacacctacctccactccgccggagacagaagcgacgtgggggcacagccgcccgtccaatcggtcgtgtctggggacaggtcggtcacagaccggacagtcctgactgacgtgcgtcagtcgggcggtaccgcacgtctgcccctaccacattaaatgcggcgaggggcagttggggcgccgcgcgcattgatagcggttcagcctaggtcccctccctgctcgctccccccgccacatggcagttgggcgagggcctcggggcaaggcggcacgagggcccgaggggcatgacgtggcaccccgaggccccccggccgcttctgcgatccgcgaggtccaagggtatgaccagactgtagggccacgcggctggatgggaagataaatttccctcactttgcatatccccgggcccatatatccgacaacgaccctcaaaatttataagttgtccacatgcattctcgtctttaaacaaaaatataccccaagtatctaggcccagcatccgtctcagggcatactttgcacctcttgattggtgacttccgaaaattagcatcaacattagggacatcgcataaaattaagttaggaggttataatgacatcgacaatgatcatgtaagaaggtagtaattattccctccgttataaaatatagtaagttttggtttttagaaattgttctaaaatataataacttttctatcaacattctctttcgaaccaattataccttccaccgttcaatttcttcacttacttccatttttcaaccaatcacaatcttctctcatttaattctacttactttcatagtagcatgttcaactctacaaatttttatattctaggataagatagtagtaaatagagttcatcaacatcacccatggctgcattgcttaattaggctatgttcggctcccgcacacacaaaacagagcgacatattttcttataattaactactctctccgtccctcaaaatataagaacctaagaccggatctattcatattcatactactataaaatgttccatccgattctaaattcttatattttgtatttttctaaaaaaaatatatacgaaagttgcttttaaaaattatatcaatctattttttaaaaaatacttagcaagttttgtattttttttcaaaaaatacatcatttagtagtttgaaaagtgtgcgcacggaacacgagagatgtgttgggaataaataccgccgaacataatgcactagcattagaagaagccaaagaggattacgacctcgttcagaactaggaatttacatccttttctttctcgttctctacgcgcatacttatcgagctactaaataatgtgttatatataaaaaagttattttaaaaatattataacctattttttgttttttaaaaattaatacttaattatttatacactaataagttacattgttttctgtgcgggataagtaagttatgaacatagccatatatgctagacaagtaagttatgaacatagccatatgtgcggggaccaaagaaagaaggctgaggaggacaaatcctttcgaaagagttggattggatcgaatcaagcaaatgatgaaacagtgcaccacgagaaagggagaaatatcacagagagcaaactattgaatggttacatagccactctttttctgagcctattggtggtggtaagtggggatgaggtggttttttttaactgctatatctattgactttgtttttttaagcgggcagtgaacattgcatgattttgttttaaaaaaagtttgggatgagaaggtggtgcagcggcctctaaactgtttaactgccctatatcatcctttgcttttttttttatcaaccctcaatattgtaccaccttccaatgtaatttaggattgaactttcattattttgatcagtgatcacccatctcactagtatgttgtatagctctactcgtgatcacaccgttttatcatttgtcacgtttcagcaatataaatattgatataacttgtcaaacactgtgaataaatttggtctaatttagcatctatccctgccatcagagtatttaccacaataattgaaatatgcaaagcagctagatagttactcctaccgttaattatttttcaaactcagacgtgtgctgtttctatgtgaatgcaggccagccaaccgcccaacctcaaaaggctgtttagcacacctggtattgttgtcggttgcttgtcacccttttctatgaggggaatgaattcgtcagccggctaacgatcgctttcaggctttcactctctccactccagtccaaatctagcaacaagacaaccccaagtttcatgcacctccgctgggataagccacctagctctccccgtcacacacacacactgggagtacttcaaatgttttcatgtgagctgatctgataagggaaggcaacagattgtctcttctgtttggaaaattccaagcgcttcagtacactaaaggcagtctcaacccataatgtctataagcaatgtctatagtgccatatcaataagacatcacaatataaactacaatctacaacccatggtttcttaaagtgggccattaataaatacatcatctcacttctctactaatcatatttattcttcatctattatgaagacactattctttcccaatgcaaaacttgatagtatctagtggataggttctcatgttgaagctgtgtcttgtatgagacccagtttcttcctctcttcactctctctcttaattaatatagtgccatataagctaagagttctacatgacaatatagttaatgccataggcaccatcttagatagagggttgggactggcctaatccgctcggaacttcagaagcattagcaaccagatgtccttcaaaacttccatcaataaaccccgacgcctagagcgata

SEQ ID NO: 26638 - DNA, 2300 bp, Oryza sativa
ggcaatgccaggcggtcagccacccgtcctaacaacagctgcagattgttctcatcagggggaatgcacttggcccatgtgaacgccacgccccctacctcatacgcctgcccctctgccgggcccacccctcgaagccccgtaccacagcgacacctgctagctttctccatgcttcgcttcctacaacagtagaggcagcctgcaagcctgatgccctgatcagcgatcacacaccacgcgtggtcgcgtgctgcgggttcctgtatactactacagtaccatccttactactcctatacaggtaatctgaaatagtgctaagcagcttgccgaagctcaaacacaaacctatactgtagctgacacattggacgtttcacatttttatctgcaatgaagaatgtactacggcagtgtttagttcacaccaaaattaaaagtttggttgaaattgaaacgatgtgacggaaaagttagaagtttgtgtgtaggaaagttttgatgtgatagaaaagttagaagtttgaagaaaaactttggaataaacacgatgtacgtactccagtagatgagatacgggcagttggtcgcgtttcacaacacctcctgtacggagtggtggtgatccaggtatgcatggaattgtgcatctactcctctttacaaaacaaattcaccaagaatccagccttcagtcgtgttggtttatttttagaataaagagagcacctcctatatacatgtcatctatgtactggataatgttacgtcacgcacgtcacgctataaagtggaagaattttgaagggaagaagtggtaacatggtgtggtgaagtgcaagaccgtatttttctttattggtatacactctttgtccaaaataaatttttctatgtccagattcatgtataaagattatcttattggggatgaagggtgtgctagttatgggctctcaaaaatctgaaaagtatcatttctttctctcttttttaccactttaaacaatggcatactccatctattaaaaaaatagacttacaagacgtagatcggtgcatttcctatagttatggtggactaatccgttagaggacctaacaaaggctacacgaaagttagaaaggcaatggctaaaaataaggttgtagctatataacactaaaaaatttcaacataaatattttagttacattataactaatgcataactagcatgtaaaaatatcaaaccaaagtgctaactcagttgataaggcacacatttagctgtagctctgatcgtaggttcgattcctcctactatcgcattatagaatttgtttcctactcccttatctgtacaaattttgaaatgaatccaatgatttggagccaaatttgacagtgtcaaaaccttactgtccacgttacctacccaaaaccacgcgtcaaaaggaaggagcaggagcggagagaaggctctatacgctccgccaacatgatcgacatgcaagtttagggctgatagtgggctccgccaactgtcgtgtgacaagaacaagcataccaacccctgtgggttaggttccacttatatatgcatgcatgggcaccgtgtatctctttacggttaaaaaaggagggtcaataccactagaaaagaaggaagagctagtcttagaacatctctatagtctccacacataacaaatcggctttagtgcctaagaacaaaagtacaccaatatcctatatacattttagcaaggaatctagacaagaatatataagtagagtgttacactttccagtggcatgttcagtaaatgggttatgaaattggaaagtggagcacctgatgtatgcctggaggtactgagaaggaaatatttgaggaattgaaattttttcacaagaaatgggaatggtggctctcaattttggatgggtttgctgaaatgcaaagggtggctttccaggctggtcacaaaggaagtgcacagtgggagagatgtgagtttttggaaggatgtttggtgtgataatgtacctctgaaagtcaaatttcctgatctctttgaaattagtcatgatcaaaatgctactgtcaaggatacggtggtaggcagagaatggagcttggagtttagaagaaatttagatgaacaaagggttagagaggttagggagcttgtagagttaattggggaagctcaactaggaactgagaatgacaaggtctgttggcctcatactgaaaaaggggtgttcaccacaaaatcaatgtatagaattttaacttttgggggtatta

SEQ ID NO: 26639 - DNA, 7337 bp, Oryza sativa
accccatagtacgcctttcatttacttattaagttgccaaaaattaaactacacaggtagcatattttacctggattttacaacatcgatgtttgttcgccttttctttttaaggtatcatcttaagttacttagatgaaaatctagtcatgtttccaatgacagtgccggacaaatattttggagtgtctagcgttttatgctattatcttggtttttaaggtactagaaaaatatccgtgcattgcaacgggtgaactctactttaatcttattattgttatacggtatagctagggtgaaattcactgttgaaattcgtttggatattttttttagaaaattataggttacaattaggagtccgacttttatctcaagttagtatgtgagttttttaaaaagagatttattgtacgactccatttgtattttcaaaagcaatagaacttaaaatccgtttgtattttcaaaatcgaacaaacttaaaaaaccaacttaaatatggatgacttatcaaaataccggtaaaaatatcttcaatttttataatagtagagattatcttgcttttatttaagtgagttgctgtaaaaataacatcatgatatttcttggctgtttgcagagaccgaatataatttcatttctaacaaaattatttttattatctactccttctgtatctaaaaaaccaaactaatactagatatgacacatcatagtactgtaaatctggatatatctttatctagattcgttgtactagaatatgttacatctcgttctagatttgttttctgtgggatggaggggggtatagtggtggcggtagtgaatttgccacccccacctactctcatggtaattttttaatttagcgcttaaactctcttagtatcaaaatcaatcaaattttaatggatagtcacaaataaagtcaaattaagatgaatatttcttatagcaaaatgatttattgatactccctccgtcccaaaataagtgcagttttgtactattcgcgttcaacgtttgaccgttcgtcttatttgaaaaatttttatgattagtatttttattgctattatatgataaaacgtgaatagtattttatgtgtgactaaatatttttaaaattttcacaaatttttcaaataagacggacgatcaaacgttgggcacggatattcacggatgcacttattttgggacggaggttgtaagtaacatatttcatggagaatacatattttatttattttaagtaatattataagatatatttttttacttatagtaaaacatgcacatataactagtctaaaaaaatactactactattctttatctgttgcccatcaagaagacgcaccaagtctccggtttagaccccccaagtcttcccccccgcgcaacagcactccggttttagtaatgcatacgccgcagttttaaattgcctcattaactttgtagtggtaccttgcttcccccactggcacactacctagctggatcggggtatacatccaacagtggcatatatctggtgtgtgttgtgttgttttcagtttacacaggagtattaaaatcccacgagacgagaggagagatagcacagctaacacactcatcactagcagccgcgcgcgtgagagagaaactatggagagcggaggccgcgcatgcgccacgcaagttgcaacgtgcaagtcgccgctgcaattactctactggttcgtagcgagtccacttgcgcgcgtcgcggtcgcggcggccatatcgctcgcgccccggttgctgcttggctttggcattggcatacgcattctctctcaaagtacgcccgcgtcgcaacaaatctggccaaatttctcgcgctgttgttttcgcggcgcggcccgggccgcgggggtaccagcgggcgaacggcgtgtacggccaaaaagcacagcgcacacccacatcagaaattctaaggcaacttgcaggggtttggcacgcgccgacttatcaaccaccactactcagtactcaccatcgcgaacgttatctcttcgacgcggatcgaccggtttgtttaagatagaaccgatcgacgtgcaagggtgcagcactggagggggcaaccaaaatcgtttttttcatgcggctcagcgacccgcctggacccacaggtctacgaaaatcatcttttttcatacgtagagcccaaccgcatgtgaaaaacatgatttttatatgcggtaacctatatcaaccacatacaaaaatagttttagagaaaaataaaataaaataaaattccccaaaagaaatttagcataaatccaagatttccattctaccgaaaccctagctcctcatcgtcgttgcagcggccaccgccgcaacccacggtgccacttctaagggtgggggcagccggatccgcacaccaccaccgctcccgaggacgggggagtcagatcccctcacccccaaggctgcctccgcctccgctaaggccaccatcgccgctctctcggacgggtgcagctggatccgcgcgtcagcaccgcccgcacccgagaccgccttcgtcgctcactggcggcgcccacctgcgaggtcgtcacctctgtctcagccgttggaggtggagaagagatggggtaaagagaaggggaagagatgaggtggagtgggagaggaaggcgaagagaagcggttttggagaagaagagagaaaaaaaagagtgatacggtggagataaggaggagaaaaaaaaaggtgtgggagaaaaaatagtgcggggatgcgtagggcccacttgcttgctgctccaagttgccggcatgaaaaaatctatttaatttttcatacaatctcttaataagtctgtctaaaaaatagacttattttcgtacgtgatctcgatagtaaaagaaatatcgtttttataatagttccagtaaaccgcaacgtttagttctcgttgtttcgcacatcatttcatttttacctgtcgttgaggatataaacactatatcgatctaacatgtgccttgaccgttacctcttactaatttgtagtggtcgtacgtcaaggggtgagattaatgtccatccccggtgtcaaggtctagactttgtgttgtttcccactaatcttcattacgattacatatatacgcggcgtagttcagtgaacaaattaatgcattccacactccactagggattgggtatgccaccaacaagatgtgtgcgcgtagagcatatgatagtttgttactccctccgttttacaatataaattattttagcattttccatatttatattgatgttaataaatctagacatatataaatatatatgtttatatttattagcattaatatgaatgtgaaaaatactagaatgacttacattgtgaaacggaggaagtacgcatctagagtacgtttttatcgtagttagtacctcctccgtcccataatatatgggattttgaatttttgcttgcaacgtttgaccactcgtcttatttattttttttaaaaaaatattatttattttatttgtgacttactttattatctacagtactttaagcacaactttttgttttttatatttgcaaaaaaaaaattaaataagacgagtggtcaaacgttgcaatcgaaaactcaaaataccttatactgtgggacggagggagtaccttttgttggtagctaggttaatctatatcgttttaacacgagaaattcaaatatttctgcagctcagctggcctccgggttgttgaagtttgacaatacaaatgctaaaatggtactacctctatttcaagttataagactttctagcattgcttatattcatataaatattaataaatatatatacacatatatgtctagattcattattattattttatatatatatatatatatataaatatagataatactataaagtcttataatatgaaacagatgaagtatcatttttcttccctttcaatgtaggccatcgataatctccaatgaatgtattttattgttgttattcttcatcttatatctagcgccaaggaacaatgaaaacatgtatttaaaaaatatcaataaataaaggagtaaatttcactttacgctatgttattggccaaagttgcacaattgagtaggttgactcgttttttccatcgacgctaggaaccttgcaattcgttgggaaggagctcctacgttaccggatactcctcctaggccacgtatccatattggatacggctacagatacggatacgtattgcatacgccccgatacgtatcccatacgtatcggccatttttacgattttcagataataaaaaatatttccgatacttctccgatacgctgtaaccctaaaatcatcgatcaaaatccccagccaacacacagcgagcaaaaacccaccaacagcgccacctccccgaccccaactctgctcgcctcttcctcgcgtcatagcgcagcgccgccgccgccacgccgtgcagcaccgccgccctccgccgccgcaacgccgcacagcaccgccgccctccgccgccgtgccgcaccgccatccccttccgctgcgccgcgccgccgtcgccctccgcccccggccacagcgccgagcgccgccggccgcagcctccagggcgcagcaactccttcgtcgggctgccgactgtcaaccccagcctccgacgacgggctcaactgcttctctagaagactagaactcctacgtatagcacattatctatgggagagctacctgatgggcctgatctcctgtcagagtgctaaaagatttttggtgcattggacctgttcgatgatatggcactatcaatgatacaaacaccaattaaacttatttacctattgacagttgaacttgatatcctgactagttcatgccctgtaatgctatctcttttttctctatttatactcttgcagttatttatgttttctttctatattttttattttttaaatatatataaacgtatccccgtatcagtgttttctaggaaatgccgtatcctcgtatctccgtatcgcgtatccatatccccgtatcaagataacatagaggagctccatccccattgctctttgttgagtccgcgttgttgtcgtttgtggttatatccataacagcagagttagcaatcaaatctaacgtgcttctctctctagctatattatgcactgctactgaagatgcatgtaggaatcgtgcacggacgtacaacaatggctggacgctcagataatggcgatggcgctctgaccaagtgcgtgaaccaagaactgcatcatgatgaacattttagttttatttacaagtggaaaaataaaatctccagtgctggcaacgcacgtttatattaccattatggatacaattttgagatgatatcatcaaagtcggagctaaggaaagtaagacattttccaaccgaatgagagcctcattagttgctcatatttcataataaaccaaaacatctttatttgcagcaaattaaaagacaatactaaaaataaattacgttgaaaatatcttaaaatcaactttaaaatgaagttcaaaattcaaatcttgacttttgctttggcgtattaggctaactgatggggctctgagtgaaggagaaagagtggaacttgaaataatggatcagaaccctttaatgttatattagcattgattgaaacacaaattttaggggccctagtttttggaggcctatgccatctctttaccttgcacttatctagatgtgggcctatttatatttttaaaaatctaactatatgaaggttttttgcataatataatctttatatatatggggacaaagtatatttgaaaccaaagatagcactagggcatcatctttttcatgatttattactacatacaccattgctaccttggtcaccatacgcataactgatttcaattaattgtatatttgtgttcatggtttttactttccaaaagtttttccacgctaaatttgtgcctcagttcttttggcatcatgtaataaagctatacttttctttctgtcatatggtacaaaacatgtcccagtatacttttacatggtgtttccactttccagttccttgtttctatcacactcactaggaccaaagaattcccctgttgacgcaatatcccacctgattcctccaaaatttccagaaaagacgcatactagtccatgcatggcacaacagaacactccacaatgcacaggtcatcacacgcaatatatatccacccgaacagaataaaccatggatatttaagcaacactaatgcagccattgctttgatcaaagcaactgccaaagcaaacccaataaaaagaagaagaaaaaagaacacagaaaggggccaagtgtgacatggcgagctgcccccaagggcacattttccaggccaagccagctcacatcaccagagcaacaagaacaatctatcctccatctttatccagctaccagctctcgatgaagccatcccgcggtatccatgggctgagctgactgcccccacaaaccaacacttgccactccctccctcatctcccctgtgccgtgacgtcgttctatccaaagtccaacacaacagcagggcattttttatacggttccagcccccgaaaagaggaaaagataaaaaacacacacacacacacaccagaacaaaagtagtatagcaaaccatcagcttcctcctccttccctccacgcggacatggtatagccgtatagggggcgcagtatggtagcccccattgcccccatacacaaacacattccggcatctatcgcaagccaaaccacccacccacaccccccacccaccgctcctatatatccctcctcccccttcgtctccctcctctcctacttatcctacgcttgccgcctatagcatcgccaacagaaggaagcaagagatagttcgagtcgagttgagttgcatccgtccgtactggggtagaggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctg

SEQ ID NO: 26640 - DNA, 2542 bp, Oryza sativa
gcttcctcgccacgcgctccaaggccgaggtcgtcgacatgctccgcaagcacacctacttcgacagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccggcgacgtcgtcggcttctaccgctccgccgccagtgccggcgacgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatagagttagcactattagctcgatcttctctagctagtgtcttttttgctcccatgcatcataattcaggtggtagctagcttagtcccttgttgatcctatctactaatctcacttggttttttttgttaatttattcgcccatgttcttgcttgctttgctgtaaatcttttcatcccaagtgtacactaatgaagcatagccctagaaggctagaccaactgacacacaagaagaagaagaaacatttgaaattatccatcatcatatctgtcaaatgtcaattaaccacaaccaatggagatatttccccatctgcagcttctttttctcctttagcttctctgatgcgtttgtgcagtccgcgagacgtgacgtgttgtgtgccgagaccgatgatctctctctctacctgcacctttgccccaggtgcatgcatgtcccggggggtgccctatgtttgttgtttgattggaaagggaaagctcgtggtggcctggagctatctgatgggcgcgcccatggcggtatgcatgcacaaattgcacacactgacacacgtagctgtagacatgatatgctaaacttatcagcaacaggtgggaagccggaaacagtgacttttgcagggatatgctcgccaatagagaagataaaaaagaaaatttaaaagaaaaggagagagagagtgagagagagagagagagatctggaaatgaacaaaagcaacgcgttgcaagtactactgctctgttcccacggcatctaagcttatcgcgcatgcttttgctggtcctggcgccgcattgcaacaaatcgcaagctggggggaaggaatggtatggtatggtgggtggtggtctctagctatccagatgagcccggttaggtgcctgttcgtgccttgattagtttaatcagctgtgcatgcaaggcgtgatcttttggcatgtgcaacacattgacgtcgagaggtgatcagagtgccagtatatcatgcttgatactaggagtaactagccatggtagtgagtacactaccactagcaggctagcagctacctccagctcagcctgaggtaggattgttggcaatggtaccggccatatctgaatcttgctgtgatcgatctcgaattgatacggccattggaatcaagctgctgcgctgatgcggcatatgcacacaccatcatgtcacgaggagactgacgagaacccatcatgtcacgacattaaaccgcaccgtttaatgttgtcttgacgacgacccggccggcctgggcgaaaacgaaaacccagcggaatcaacgttgtttcgacgaccggccctcccggccaggcgaaaacggcgtccaggcagccggtggaatctttgattggaacacggcgctggggtttctggaagaataattggtggagacttgtagtagtaggagtagtatcagatcgggtactatagcttggagcaggaggccggcaatgatacgcctctctctagtactgttgcactgatcggtcctgatcggtccgtgcaaaatctacgggagatgagatggagatgctgctactacgagcttgcaatatcagcgacgacgacgtacggatgcgaggtgatccactggtgattgatgggtcaggccctagtcaccaacaggtagtagactccaacgtcgccacgtacggagagagagagagagagagaaattatagtgtgtgtgaaagaaagagagttgctggcaggcacggctcttgaggagatcaggggggcctccgacctgagcaacaataagagctaagtcagcccacta

SEQ ID NO: 26641 - DNA, 5662 bp, Oryza sativa
gtagtactatagtacatatacaacgtacttaagtgaagtacaacacatggtgatggtgagggttttccaaaagaaaagggacataaagtagagataaggattgtatgaattgccaaaggatctactccctccgtttcacaatgtaagtcattctattatttcccatattcatattgatcaatatgaatgtggaaaatgctaaaatgacttacattgtgaaatggaggaagtagctagttttggcgtacaaaagagaaaagtgacaaaaataatcgcaaagaataaatgaaaactgacaaaaatctttaaagtcagctagctacctttatatgctgctgcagatggaaaatgtgctccaaaaacgacgatcatctgctagtctctgtttagcaccaacaattaaaccgcttaagttttagtactgattagccctatattaccagattgtcaataagctagtagttgtttgtatggttgtatcataaccaaaacaaattggcataacaatttttttagatcagaataattaaaagttgtctactagatctgaacaatgtacctggtcagtctttccactcaatcaaactgtcaaagtagtttcaccaaatagttgggctcgtacaggttgatactagtattaattaggtcaagtaaaccttgcatatctacccgtgaagttaatagtacatctacaatgcaccacgctgattaaaccacaaaccgacaagcccgtgagtactatgctatccagcgttttcatccgtcccggtggttagcatttgaccgtcaaaagctataaacttcagaaaaccatacgcatgcgtagacatcaatctactgtttgcagcaaatgcatctacaaagactcaagaagtcacgagtaattaatctatcgatggcttaattcgaggacttcacgccacgattgggtcagccgtgcacagtacagatcggcacaacacaacttgtcttaggacttaggcttaattactttggacgccggattagcgtccgagtcaatccccgtttgtcatcatgtagcccatccggctgatcgatcgattgaataatcactctctctgaaagtcatgtgcatgttgctgccaacttcgccttccgtggtgggctctgtgatttgacaaagcttgcatcagacagctggaggacgagatcaaagagttcaagccacacagattgagactagattgtggactgtcccctctgcattccttttttttcttcacctaattttgcttctttaatttggtcagtgatcttttctctcttctcgtaagtttttggcagttgtgcagcagagatgaccaaagaacccaatacaaacatactttagttcagtgagactaccatctaatcagctgttatatgcacgacagaatccataccagaatcaacaattttcttcataccagaattaaacaatgttctcccaggtttttcggcaaggagacgacctaagaaacctgagaattgacacatactactcctcaacatccctgaattattcgcaatatagcatggggacaggtatttggttgttgatatattaattcaggtccatatatcaactgtaatctggtcagaccacagatggacgcatcactgaattttttgatgggggcgggtgccacagaaattgatgaattgtgcatccagtggtcacagacaattcaaaagtatgctgaagaaaaatctctcaatgtcagaaaaagccataaatcgtccaccatttaaatctgattaatttgaagccccgcgctggaccatctatctgttgcggcggcttcaatggttccagcatataaaaaaaaaacagcatgcttgggtgagaagtttgagcaaatttgacctggtgttctggagagctaagacaaatgtgatgttcacaagaaagttacatttatgaaataatctaccaccttttgttgcctaacgtggttgattatgtggagaggaaaaaaggagtaggtttcagctgtggtgtagtcaaagtaatggcaacataatggcgacccatatcttgttggaaagacattatcattcgtgtcacaacaaaattcttctctcggagtcatctaaacagctcatatctggctcatctccactaaaagttttctgatcatctctcggtcttagattaatcgagagccacccgttgcccgttggtatgtcaggttcagctcgcaggtttttgtctgttccaagttaactaggggcaggttaggctcaatttggccatgttgctccgatgcctgaatatgttcattgattcaaactttaccaccttattcaaagtatacagcctgtccaaggaggcagacagagcaacatggttttttcttggaacaaggtgagcaaactcagagcaacgtgccactgtggtagattcagatggacgaaatgcaagtgtcggcgacctccattaccttgcaaattcagggggaaatgttccgatgatcatcacctgattcacatggcaggcgaacatatagtacagcagagaatcatattattcatattcaagggtgaggtcatcagggcacttttggctgacaccaatgataaaagataatgaagcatcatttcagtgttcaggccatgttgatctcatgtttctttgtgtcacatgagtactactactgcagacgacgcatctgcatcagcacatatatgctccaaaacaaaatgcgtgtcatgattacagggaccagacagataatttagatatatgatgccgatcctctactcacatttacacgtactggtatcacatgttttatgctctgtgacacggaatttgcacgacgcatagcgacagagagaatgtgttcatgttggaacaatgaaaaatctcttgcaaaagctagaagcctgatatgcttgcagcttgacatagcctatccacccaaaactcactttgttcaggagtcgcaatttgatcggcaaactcagaatgctcaacagatcgcagttcagtgcaggcttcgacgactgaggctgcccgttcctggctcagtccatcggcggccggtgatgggattcgctgcatcaggcggccggatgttttaggcagcaggtttgcataaatgggccgtgccggtcgcactcaatcccgttcagcccgaattaaaatgggccgcacgcaagccactgtcccgtttcggcccaataaacgtggcacgcatgtaagccacaattatgcggcggcctaacgaaaaagagaacacacgctatccagagttaacggataatgctgggcgtcggacgtccgacgggagggcagaaaaatcggacatgtgcctgctattacattcaaagaatctttcccccacatgctcacatctcttatttattcaaaagattttttctcgtaaattatttatctaatctactatttgattgcaccactaaattcgttacaattaaatcttttcaacaataccacacatgattatatttcgaaaaaaaatatttaagttttttaattgattttttaatggtgcatatgtgtctcttgatgttcaaaccagtagttttacaatgtttcagctagtgtacccatgatgtttcactatgtacggattaaatgttgcagtgaattttgatattatggaacgtgccgcattgcaacaaatcacccacatattttggaaaccatctattaagggatttcgtttcattttttgtttcacaaaaaatgtttcacctaatgtactcacaatgtttcactatgtatagatctaatgttgtagttaattggaatattcttttgcaacaaatcacccacatattttggaaaccctctattaagggaattcgttttatttttttccaaaaaaaatgtttcacctagtgtactcataatgtttcactatgtatggatcaaatgttgcagtgaactgaaacattcttttgtgtttttataaaagatgaaacaacgcccaatttaaatgattgaaacattttcgatctacttagtaaaacaattccgatatacttggtggaacatcgtgcaacatttaaaaataattcaataataagctaaaaaaaatttcgtcggaatatatccatatgtggtcttgttttaaaattttaattgcaacgaatttaatggtgcaatcggatcatgaattagatatataatttaggagaaaaaatagtttaaagtttgcttaaaaactttaaccaccctaacgtacgatccgtagacgcccctagagttaacgggccgcatgttaagccgcaaccccgttccaggctattcagagttgagacgtgttcagatcttcatgaaagtgaaacatttccagttttttatgatcattgtaactcaaagctgcttgttttatggatcctcatgaaacatgtcctatgatcactgtaactccaagcaatagcccttcttatggatccttatgttaagaacacaagctgatgtttgtttcacatcatcacattagcacacttatgtgttatgctcaattttaaaacaagcattttttttgaaaggaactagcacaagaatgtgcttattcattgaatatagcaagaaaaaaaatacaacccctaagggtaaagaaaaagcaaaaaataaggaaagctgtacactatacaaactgcgggatgatctctccaagacacttggcgcctgccaaggcccacatgccagcctcttcttttatctttgaaaggagatacgaggttgtggcttccttataatcaaatatcctcctatttcgcaccttccaaacttcccatacgatgagtagaatcagggtgcagagtcccttcttagggacgccagacacagaggccagtattttccaccaatctttgaccggttgcaccacccccagcgtcggagttctagctggtgaaaccctacccatgtcgcaacgaggtttcaaatccttctcgtatacctgcactcggcgacgaggtgcaaagccgtatcatcttctcttatatgcagagagggcacctgccattatttttccaaccccctggtcacaagccggccagaggtccaaaccctattctgtatgataagccaagcgacaatgtgaccatctactgtcaggcatacttccggatacccaaatgtaggtgcattattttaatctggtatagatttacatgagaaatagctaacatcatcatgttgaaatgtacaagtaacaattctacacggtatatgtaccaaagtgaacctgaaaggtctccgtataattctcagtctatcaaaaagtacgtcaggtatgtctgctacaacagtagcaggtttttatctcgttattgatatctacgaccagcttccatgaaatctaatgcttggccttggcccgtgtttcccatttccaatccattagggcttctaaaggacccgttcggcagagagttagggcgatccacggacgtgggttgcgcgttgttctccagctgatcagggttgagaatgtgccgggcgtatgcgtgaggccataatcctgtcatcgaaaatttgaacaatgtaaagccgtcagaaacattaggagagacagatatctgaagctcgagaatatacaaaattacagtacaacttcagatatttcgtacagaacatggtattatcaatcacgcgatgcccaggaaattggccataaaa

SEQ ID NO: 26642 - DNA, 5771 bp, Oryza sativa
gaattcccagattaggttaagcaatccaattcgcaagataaatcagatggatgttttgcctgtccatcaaaagaagtacagaaatcatactcagaaccttgaattcgtgctatttaacaatagttgtacttgtccctagaactctaagaactagccatgcatccaggatagccgaacctcagcatcatcagtaattagcatcaacacagcaatacggttttcttctgaaacggacatgagagatgggacaccgaaccttacacgaagcgttcacgacggaaagaacggccgccttggcttgccgcccggacaaatctctcgtcgtctcccttctggcttctcttccacttctccttttccccggacaccatgcgatacgattcacaattgagatatccttccgtgcgggggatgaaaaagtagcagaggccagaggcgattcgctcttggctgctataatttagttgggacgtttgaagacgagtgggagagggcaccggccggcggcgcggctgactcttggaattcaaggatgtccaactgtccaagcataggaattagtaggaaggatcggcagtcgtagagggcggttggaaattgaccggacggtcgttagcttcctcctcgaggcgggggaatttggtgaatttgttatctggggaagggggaaagcgcgtgcttccagatggatttggctgagtttggttgggttgttggccgggccacaagcccacgagggagaacaattgccaagccccccatcccaggtatggttttgagtttggtgcatatcctgtaacaggggcaccaaaaaaaattgcagccaactatttcaaaatataatcggtttcagtattgattgtgaaaattttgacattgatattgatatatatatacaaggtgtcctacagatcatgcaatttgaaaacgggcataatgggtgcgtttttgtactttgaaaatctgttcgaatatctgtagtattagacattttagggggggaggggggggattcattattactagagtttagaaaaaacgagaacaattatcaaagttaaactcaataagttttcatagaaaataaacaagtttgcagctaaaatttgcatggatatcaagtatttgatgcaaaaatgatattgctttgttttctttttttaactagcaaaatgcctgtgagttgcaacggagagaactactaaagacaatgcccgcaagttacaacggaaaaagctaatatagatttgtcatgatttttaacctgtctaagtgattgttgattctgatgcaaccttttcaccttctcactttctttcgcagtcagatacataaatctttttttcccccttggaaggcctggtcagatacattctattattagttcacaggaacaaattcaacttaattagaaagtataataagattttgaatcgaaaagtctaaccataataggctccttgaaatgctatgaaacccccttgtctatgtactccgagatttttgatgtacagcacaatgacatgataggtggggaatctgtgattgaaacaagacggaatatcagaatatgaaaaatttagcaatacatacctagtttttcttaaggacttacctggatgttaacaaatcataggagcttatcgtgtggtttgacttgtggaggcttaatgtgctgaaccttctcaaggcaggctaacaagtccgcaccttttcgtaggatcatgagcagaatagttcggagcagcacagttcctcctgtctctgaatagattgaaataggaggttgattatagcatacttgaggaatcactcctcagcttgaagagggatgtctcaatccatcatcggcttttctcccccacacagaactgtcgtccctgaccctgaccacatatttctttgattcgcccacactgaaatgaagaacattagatgaatgcgaaggggaagcaatggcaattaaacatgcataccatttcgaaccgctatatgattataagtgaaggtcgtcccgtgctatcattcccgggctcccggctgccatctccacgctcgaccaatcaatcacaaatatgtgaatgtgagatcggtagtaggttccccttccataagagaaatcaggcggaggatgggtagtagtatagtaggatgaggctactcactttctgattaattttagacggaatcggctgggtcagagaaactcgccgcaggtgacgcgggttgcatcctccccgggcagttgcggtgagggaatggaattgaaccgtcatagcgggatggagcccgttgccggcagcttccagcggcgagcgcggaaacccgattctcccaggcggcagcggcagcggcgtggctcgtgacgggcggtggcgcgtggattaacctgtctcccgctatgtcaggcgatgcagccatgcagccatgcaggcgatcgaatcgccagccatggagcaaatcgtaatagaacaggattggtgcgagtgggaccacacacgatctatgcggactcgttcacttctgtttgacggacggcgcgatgcgatgcgagacgagacgaagtcggtcgcatgaaactgaaataaaatcggatgaaaaaccagcacgacgatggatgaagtgcgcgatgagtatagaatcatattcaatttttataaaagagctaaagattttaccacaatacaaagtttagaaactacatgtgagtcaactcttttcagattatgtaccggattaatgaaatggaatatttgcttcccacttccaaaaaatacattttctaaaaattaattctatcaggccacttgttcaatctatttgtttgtttgtaaaatatttaatttatccgtgtaatcaagtagataatttgccgcaacaatctgctcaataatctgtttcaaactaaaagcaataaggttctagtagaagaacacataacaaaaagggaaaagtacgaattacccccccccaactatcgcagtcgaccgaattaccccctgaaccacaaaaccagacattcttcacccccaactatgcaaactagacaaattaccccctcgacccaatccgcggtggttttggtctacgtggcgtacgcgtggcagtctagtcagcattctattctatttatataaaaaaatatgggacccacatgccatactcttacactctttctctctcactcactctctgtctcactcttcctctttctctctcacgggtcggtggtggcgggggatgaggagtggaggatggcgacggaggagtggaggacgacgacgaagggggacgacgacatgcgttgacggccatggaggtgaatgcgaccgacggcgttctacttctgtggcagcgtcggctgctgatgttgctccgtgcgcgcaggtgtggtcgccgtggtacacgacatcgccgccctacccctgccgccaacgcccccatgtgtgcccatttccacctccagttgcctcaagatgccttgcatctgcaccagctccgccaccagcacgcatctctcggcaccgtccacacccgcccacaacctacccccgcctccgtccgtccgtcccgcgccgccacggcctcctcgtcccccgccgtccccgccttcgtccgtccatcccgcgttgccgccgcctcctcgtcatggcctctgtccatccgtcccgtgccactgcggcctcctcgtcccccgtcggcgccgccgccacctcctcctcgtcccccgcccgccgccgacccatgaccgtgagagagagagagagagagagaggaagagtgagacagagagcgagagagagaagagagagagaggaagaatgagagagtatgacatgtgggtcccacatttttttataaatataatgctgactgggctgccacgcgtatgccacgtagaccaaaaccaccgcaaattgggtcgaggggggtaattcgtccggtttgcatagttggggggtgaagaatgtccggttttgtggttcagggaggtaagtcggtcgaccgcgatagttcgggggagtaattcgtactttttccaaaaacaaatgttacagtatgaagcaaaggctctagtacaatgtagtgatgtactaccctatatataggaacaattttatataaacttatatccatcaaaatacttcataacatactaagatagtggcaattgtcggtcatagatttatcagagtcaatcccattgacaaaacatctaaaaattaatatgagattaaggttatcacacaactacacaaaataggcagagtttttagtatcaacacaataaaatccaaatgcaaaggactagcaatttattaagactccaatcatccaatagtcactaaattatctaagatttctccaaaccattgcacactaatattaataaagaatagttcagactcaatgatgttccatttaaatctatggaaacttaacttgacacctaaaactttgaattttatgaaaaataaatttccggtggcatgaaaaaaaataaggattttgttctttcaaattgtgttcatctaatgcctgtaaaaccatgtacgattattatccctaagagtgagggattggaggggatctatttcacatctattgtactgtggatttattctcccttaataccctccaaactgaataaggccaaagagatatattggaggagatttatttcataacaattctggtgtggaatcattcctcctcaatcccctccaaaccgaacaaggtctcgtatagttaggaatcatgaagggtaatttgtaacataaaaaaaaatacaccaattggaagatggtccatagagtgaaccgtatagaagattgaactcaaaaaggttaatacctagctaaaatcgtgggtgatatacagacctcattgggaagcaagtacttcaagatattacattccaggcaaagttttatgggtacagtataatggaacctgcatgtacggatgaaataaataggcaacatcacaattaaacagaagtgttagaaaaaagtgtacggaacacatattggtaacaaatgtgaatggttgtatgaaaagtgcacgtcctacaaaagaacataaccagtcctttttcctgcaaaaactaattatcaaattgataaatggatgaattcttaacaatcagagctaaaagaaaggaaaatttatctctttcctagccatctattcatctgttacattcaccccttaaaagtaccggataatcaagcaaacagaaacaaaataacataatatccaacatatctagacacacggatgcacacgcatgcatggatcaatcagatattgaacggcccctgtgggtcgagctgccggcacatctcaatgtaagcatagtacaacacgcgggtcttggcgccagtgcagtgattcttggtattcttgcagaagaacttgaggccttctagtgtgcaacagcccagcatctggccaaggaagaggaacaaccagttgatctcacgcttctcgtttgggatctgtggccacatgcaggccttcttgccgcacgagccgcagtctggcagccgcgggcacatccagtgctccggggcacggtcatccatgatgtggatgttggctgcaacatagtcgcgcacctcccggaactttgcgtccagatcgtacgcgatgggcacctccgcactgcaacgattgcaggtggctttgccctccacagacgtgatgcccttcagcaacatgctttttagggtgcaatgcaacactggcagatcaaccgatgtcaccca

SEQ ID NO: 26643 - DNA, 9737 bp, Oryza sativa
gaagaccaccggccgtgttggcgagggaagcagcatggggacgaccacaggagttggtgaggaaagcaacgtggggcccgcaactaggaatgatgagggagccggcgtaggggccaccaccagggacggtgagggaggcggcgtgggggcgctagagtagatggatccgagggtgagggtgaggggatcttcgccgccgccgccgccaccatggcgtcccttcccatccattcccctcctatagtagctactaacctattttatttgctgcatttaaagcctaaagagctagggttttaaggacaggttagagccgaggcaggcagatcggaaggttggccgcgtccacatgaacacaaatctaagatatcaaaccacagaaatagcaggtgtttgcttgcgtccacacggggtcacacctcgtctcccgaagaagattctaacaaaccgtgacaaaatagtatagacggcattttgaccatatctctcgtatgcatttaaattaatctctattaccgaaacggtacatgttcaattggtctcacgaatacgaaggaaaacaatccaattcgagtgaagtcttgccacatatttcgctgaagatggtatgaatggaactggtgagaccttgtaacaactaacgaacacaaaacatatttggcacaaaggttttatttggtttgctaccatccaatggattactttcaatcatataaaccaacatatttggcaatgcctttcttttttccacaaaccaaatggactactttaaatgttgctgaattttcggtgtaattcatttaggtcatgaactgaacaagtcctaataaccgcatttaaatgttgtcaaattttggcatggttcatttgaaatgtcaatttccctttgttgaaacagccaattcaacaacaagttatgatgcgttataaatacattccacataaccgaactcaacgggacggacgcgttcaaacttacaaggggcgggaggactacaatgtaaacaaaagttttctgagggatcttgttagcagtttaccttaattcaatgttttgtgttctattggatagctttagcagtttattttgccgattcacaaaataaactacccatttcgagcagtttagagcggctcaattaaatgaatggtctttacacagtgaagttttacgagcatatataatgtggaatgcaatcatgaaataaataggccacatcaaaactacaaaacaaaagtgtacggaacatatattggtaataaatgtaacacacgataagtgtataaaaagtgcatgtcccataaaagaacataaccggtccttcaattttccaacaaaatgtaattcatcaagaccaataaaatatttttaactattgatactaaaatgaaggaaggataatctcatattgtgtcatccgttaagttcacccgtcaaaattaaattatgcatagatgcattgattgattagacattgaatagcccctgtgggtcgagctgccgacacatctcaatgtaagcatagtacaacacgtggttcttagtgccagtgacacagtgaggtgattcctggtattcatacataagaacttgagctagtacagagagcggggaaggaggttgtggcacctgtgataatgaggaagagagagcggggatgatgatgaagtgaggctgcgtggaggagaccactagctgcgtcggcaaatgagacaatgtggggatgaccactggcgttggcgagggaagcagcgcggggtccacgaatagggacagtgagagaggtggcgtggggacgctggagtagatggatccgagggagaggggatcatcgacgttgttgcctccatggcatcccttctcttgttgttccgcttgctgccttaacccctgaagagctaggttttaaggacatgttagaggcaagacaggcagattggatggttggccgcgtcgacatgaacacaaatcaagatatcataccacagaagtagcaggggtgtgtttgcgtccacctatggtcacgccttgtctcgtggagaaaactataacaaaccgtggcaaaatagtagtatagacgtcattctgaccatatatgttgcctgcatttaattaaatcaatctctattaccaaaatgacgcatcttcaactgatctcacgggatacgagggaaaaaaatctaattctagtgtagtctcgctgcatatttcgcttaagacggtatgcatggagctagcgagaccttggttttccacatgtcagtcacgctctgtttggtttgtaacaactaaaaacagtaaacttatcaaattactgataaaggtgggcaaaggttttatttgctttgctaccaaaaaagcattctagtggattattttcatttcatctaaaccaaaatatttgtcaatgcccttctttcttctacacaccaaatggactactttgaatgctgccaaatttttggaatgattcatttgggtcatgaccaaacaagccccaaaagccgcatttaaatgttgcccaattttcaacacggttcatttggaatgttggtctttttgttgtaacaactaatttgctatcaaccgttagttataatgtgttataaatacattccacatacctgaactcaaaagcacggacacgttcaaattttgagaggctggaggactacaatgtaaagtaaaatttcctgaggggtcttgttagcagtttactttgatccaatgttcggtgttcattgaactactatattggatggttttagaagtgacaaaacccaatgaaaaccaaatcctttgatgtagaacatcaggcatatgtccagcgctagataatcatcctttgcatttccaacaatagcattagtctaactttgttttttcgtctttggcccaaaagcaactgcctgcttggttcatcccatttgcagtcgtccacatcattggggatctacggttgttagggtatgtggcacgctagtggcttcatgtcactctccctgaacggctgtcgttgaagttgtcgctcgacctgctcaagctcctctctcgctggtgaaacgcattcgccgttgatattccccatgcacagggatacgtggtgcagctgacagcgatggcaggggtgacatctcaatgcttgttgttggtcctatcatcgatgttggcttcaaattgggcaacccagccacactcttcatcttcatctctgctgctactgcaggtcgacaacatatcgatgtcttgctatctcagaatagctacatggatctcatcgaaatattgccctgctctttctttttctgcataaagagccatcattcgatgccttgcgtctgcttctttctcgatagtcgtaacgctttactgaacctaggcaacaaggagccaggttgtccaaaccttgcaaaggactacgacgcgccggacaattcctgcttcatctatgctcgcttccctacttcttcgcaggcgaaaggacaaggattgcttccacgcagcacttgacatgctcaaggcatttttgctggcagcaccaccatttgacgaggctaacagctgaggccgacgaacaccagcaagagcgacaggaagcctgaaacggtatcacataccccgacgcatggtggctctagtggtcaaagctcctagatgttgtggacatctacgaatgagatgaatcgaacaatctgtcttctgggcctaagacaaagacggtgtgtccctctggcgtagaaggatttggttccttcccaacgatagactagatttcttctattttttgctaatttagatatatccatgccatatcgatcttttgaatagttattaaaaacataccggtgattgaactggtgcgtccgacggttcactagtcggaccagcagtccatcgatcaggacaagggtgcatactaagtttttatgtagaagatttcataaaattgtgatggttgtaggtttgatgttgatttgtgcacgaagagggttacatgttgtagaaaaacatgcttggctcacatttcacgtttgaccaaacaatttgtgagaatttagatcatcaggacaatacttatattggctcctcgtatataggggtgggcgttcggttggaccgacaaattcggtctcggtcttcggtttttcggttagtttggtctttggaaactcaggaccaacaaattcgttctcggtctcggtcagaccgaattttttcacagccgttggagagtagagacggaggcgacaccaaggcagaggcggcgcgatgatcgatgggtgcccgcgacaacagcgcaatggaggcagaggcactgccggtgctggaggcggaggacggaggcagaggtggtgccggcactggaggcggaggcggcgcacagggcggcggcgacctacggaaggcgaaggagcggctgcgggaggccatccgggagcttcaccatcgcgatcggcatcaccagcacgggggaggaggggatagggatgggaagggcccggtggatggagaggaggatgatggtggtagtgggttagataaggtcgtggagtggataaggttttgcttttgctgaggaggtattgggcctaatgggccagtgttatatttcggtttttttcaattcgattaaccgagccccaaaaccgaattgaccaaactaaattcggttagtagaaagtgctgaccgaatttttcggtctcagtcatttcggttcggtctttttctgcccacccctactcatatacatttcatagcttaagtgatgcaaatctagtcttactatcttggtttgttagctttggtgctagttgctaccgtcgtggactcatagcagtagtgtttgtaccacttccaatttatttctaccattttagagcgttaatctagggaagagcacggagggttagaccaaaagtgtttttaccactttcaatttgtttcgagtttttttagagcgccaatctaatcaagagtacaagcgttcgcaaaaaatctaataaagagtacaaaggtgtagactgaaagtgtttgtaccactttcagttcattcctatgtattttaagcgtacccctccattcagcccatgaaattgccaggaccaaacaaggcaacaactccatcaagcccgaggcccagcacgcacgcacgcgcgcgctagctagacaacaacaagtcgaggcgccacgccaccaaggcccaaagcgcggcctcggcaaaagaacggttgagctgaccggatcaatacaactcgtcatcgcgtggcgtcgcagcgtcgcctctcgtcggggagcacaaacccggccacgcgccacggcgccagcgaggggaggaaaggaagaggccgcgtcgcaccggggcacgcacgggcggcggtggccggtggcagctgcactgcacgggctctcgagccgtgcgcatatgccccgcccccgcgggcgcgcgcgcggctgccttgcgatcccatccacggatcggatggctgtctgtctggcagggcagcggcacgcgcggaccggtctgggagggcgccgccacgcagacgcggacaaaacgaggcctccctcctcctccaccgccggcttttgcagatgcgaggacgttggcaagtttttagtggaggtggaggagtacccattttttttgtgctaccggccgctctgcatcactgcgtggcgtcgacctctcgtcttccagcgaatgttcggtctctatccaggttaaaaaaaaaaaaaaagcactcctattggtagattgatagttgcattttctcaccggcagtaaaccaccacttattattagtgacagatcaagggtagagatactggtgtaagtgccacgagaaacacctgaggaaggccgggatgctgccaaatgttgtttcgacacattaaaatatcccacctctttctcacgaaagaatgaatagacaaatgcgtgtcaatctatatcaaagcatgtgtagcgttttggacgctctcaagatgtcgatctttacgtaaaaggagcaggacaacgtacaattatgccccatcatttcggcaaggagactatgaatcatgaactcgttttcattgcacatacccctcctcaaccatctttaatcattgtatttttttcaccctatatattttcttttctcaggatgccgaatgctatgcttgcctggttgcattgtccttcgtagatcatgtacagcagtacaggcccataccgtaaaaaagtaggcaggcaggcactgttcactattcaggtgtagagagcattttcatatgcatgtctcacttctgagtttgactgggcttttcggcgttgctttgcttccaacctgtaaagcctcattaccattcagtaaaaaaaatgaagtttgaactgctcgtgagaggtagatgctgtagcagtatccgttgccacttgccagtgtctcatgtttcttctactagtaatgccagagagaaatttcgtcagcctcatcctaacatgattaatcaatgtaaaggtattctactagcagcgtcatcatctgaatatctgtccgcacaatgatatgtcttttttaaaaagaaaagaatgtacgctgatgaaatcatcagaagttagagtaggcatgctacaaaacgccaaactgaaaatttgaaaatgcatatagcatcacaccataagatattaagatagagtacagaaatgttgctttcctccaatcgcttgcatgatgagattcccacgggagatatatatcaatatatgcatggctaattggctgcagcgaaatgatcgagcccgttttaatggatgcgccgtctcgcaacgtccaacgtctcgtgttctttcggttggtcatccatcgaaagggagagatgcgagatggaaagctcaacccgagctaccaatctctctgtctgctgctaataatcctcagctcctccttatccaaggagctagctttggatgagcctgaatgcctgatggctccgggtttgtgctttaaatttctttgtataattccattaagataacggctgcatattttctacagtcggttttatatccatccttgtgatcatctatgatccatgacctctcaaccatcagtagtgttttggatttttggatgcaccgagtaacctactgtcctaccgatgtgtcatgcatgtgtgagtactgaaagctgcccttaaatggtactagtagtatttgcttacatacatcaccctattggacagattagccaaaagatatataggagtatatatatagctggccagttcttgtgtaatcgtgtggtctattccttgtgtaactaaaaatctgaaacagcttcccctgttatgggaaacaataccttttgtctttgacaattcatattgaaagcacggccagaatacggaaaacatcagcctcgacaaagaagggtgaaagctcaatttagtccattttacagcgcagtctgaagaaagaaagccgatgctgctcagcgtcactagtcactactgcctatagcttcctgctggtcaccatccactggacactgctgcctttttctttctaatcttcctccatgaattgaaccatacagcgtgctacctttgtttaggcaaaggacacacagcaaaccaaagtataattagaagtagggagtcaattacaccacgcatctgaagacaaggaagtgaagaataaagatgaggtgagctgaagcccaagtgcaggaatgatacttaaccctccatccctgccctccgtcgcttgcttgcttgcttgaggtcgcgaccagtgaccacaggcccacagtgagtgatagctgagataggaggcatctcctctttctttctactgcctcgtcgcttctctttggctgccaaaagcggctgcgaactgtattcccatcgtttaggttttagatgcgcgcccactagataaaaaagcaaagaatatttctcccatggagaagagcgctccgttggagtcaagctcgtcgtcaatagtggacttttgattgagcgatgctggtacagctgaatactttaacgtgacgacctgctgacttctctctgctgcttaaacctgcatgggcaaaaccaaaaaacgacacccatccgtaagaccgtacaagtatatcagtcccacggtcccactccaataagagaggaaatgtagggtaaattactgtgtactgtaatctctttaggttagcacttcattctgtagtagaatcaacagcaaacgctgcccaatgtccatcacagaaaaaaagaatccagaaagatcgagtagagaatccactactactatacagtccaaaatttgaagccatccaaagagggtccatcagcattcggcagtggagagggtttttctttttttccctttaggtttgattaagaaacaagatcagtacaaattccccaatcaaggggacctctgcttgtctttgcatgcatcggtgcatgagtaaaagagcgagatggaaacgaaaaaggaagcagggtatcttgtattcttgcaagcttgtcccctttgactcggggatctcctccctgcgcactctggcaggatccaaggcaaacgacgctgtgcgcctgtgcggcgtgtgtgcactcgattgcttgtacacacctatgaacagttcacgtacacgctgttagctaacgtggatgagtgatggagcgaaatgaatttgtcaaggccttttacgtgctggtggatccccaaactgagtaagggcctttgaattaaaggatttatgtagaaattttataggattcaaattctataggaaattttcctatttgatcctttgattcaaatgattgaagcttttcaaatcctatgaaattcctatggaatggcacattgcatgtggtttttggaggaaatatagcaagagcttcaacctcttggaaaatttcctttgagtctatctctctcatccgattcctgcgtttttctcgtgctctaatcaaacgaccattcatatgtttttcctatgttttgcaatcctctgttttacacttcaattcctatcagaatcctgtgtttttcttattcctctattttttcaaccctgcgattcaaaggggccctaaagggtatttcgattcaaagtaccctgccaaaacgttgcaagagttgaaacatggcaagttttaagattaccaatatttggtacattggtcatatttgattggaaaaagtacgaattacaccccctcacccccaccctctgaattatcgcggtccaccgaattacccccctaaactcgaaaaccagacatcgtttaccctgaacttttactaccagacaaattacccctctcgacccaatccaaagcggttttgttctacgtagcgtatacgtggcagtccagtcagcattttatttataaaaaaaaatggaactcatctgtcatactcctatctcactcttcctctctctcacttttcctctgtctcttctctctcactctctcactcttcctctctctttctcgccggtcggcggtaggcaggggacgcagagcgacagcggcggtgacagctggggacgaggaggcggcggcggctgcggccatgacgagcagccgcccctcggcgcagggacggatggagatgggtgtgggcggtagcgcgagacgcggcggcggcggcagccacgacgagcaactgcccccctcagcgtggagacggacggaggcaacggcaacggggcacgcggaagcggtggctcggtaggg

SEQ ID NO: 26644 - DNA, 11823 bp, Oryza sativa
accaaccggcgagaaagagagaggaagagtgagagagaagagagagaggaaaagtgagagagaggaagagtgagagaggagtatgacaggtgggtcccatatttttttataaataaaatgctgactggactaccacgcgtacgccacgtaggacaaaaccactctggattgggtcgagggggtaatttgtccggtattgaaagtttagggtgaatgatgtttggttttcaggtttaggggagtaattcggtcgaccgcgatagttcgggggtaattcatactttttcctatttgatttgatatattagaaaccaaatttttggtagaatcaaagtttatcttctaaccaaaatcatcatatgcaatattcaaactaccaaaatattgataatgagtatttttaacatcagtctaaaacggtctaagttatgaacttggttatgtttctcgtggtgaaacctgttcatctaaattcagattataaacttgacatgagtattcgtcgatagcgagatattacatgttctttcagttattgtggtttaggactcctaatgtgtttctttgatggcacaccacatacccctccttgatatgccaaaacttgcagtggtactactactgctcaataactgcccactccgtatcggcctattggtgagctgatgttccttctcctgtgtcaccaaccaaacacggaaaatccatgcgtacacatgatcctcgtttgttgtcccgaggcattggctatgcttgcggaggcacatgttattgggatccataaaaaccaaatgtgaagtgtatttgtctcaaaatgtgaaaatataggagcattttcatagtctactggagtactatgaaatatgtttgattatactataaaaatacattttgacatattttatgtaatatgaagatactccatatgtagaaaaataatttgattacgatgaagattaagtgatggcacacaactaagaaaaccattaacacatgattaattgaattactataaagcaactcctatataagtttcacacgaaatatactaattagtagtttgaaaagcatgctaacgaagacagaaaaaaatcttcatcttaatcaagttagaagagggcctaagtgatcaaagcttttttcccctttctgcaccctattctagtattagtaggagtgtttcataaagaatttaatttgacatttattttgggagggggcctggtaaatcaagacatccatccatagttattaggaccggaccagaccagcggttcgaccggaaaaaaccggaaccagagcccccaccggtccggtccccttaacaaatcaggcatgcagtcagaccagatgaaaccggttaatccgggcgttttttttataaaccggagatggggattcgacctctggtcgtgggtttgagagcaccgtgcgctagccaagccaccgttgtacagcttgtgccattagtaagggtgtgtttagttccacactaaaattgaaagtttgactaaaattagaagtttgaagaaaaaaagttggatgtttgaagaaaaaaggctagaaatttatatgtgtaggaaagttttgatgtgatgaaaaagttgggaactaaacccggcctaaaacatagtactttctatattaccaatcaaaccacggttcgaccgggcaaaccagtgatccgaccactaaggccccctttgattcaaaggaaattcataggaattttagaggattttatttctataggaatttttcctacaaagtcttttgaataaaagaaatgaaccttatggaatcctatgaaattcctatggaatgcctcttctcatacaagtttttgaggaattttaataagaggtagaaccttatggaagaaatcctttgagtcgttatatctcctcaaattcctgtgtttttcctgtggtctaatcaaacggtcattcctatattttttctgtgttttgcaatcttctattttacacttttatttatgtcagaatcatatatttttcctattcctgcattttttcattcctgtgattcaaagggaccctaaaccaattaaccaagagctttaccggttcatttaccggtccggtcttttaacaactactactagtacgtacgtatccatccctcgatcaaatccagtgatgcaccgaacccgcgacaagaattcactcaccagtcaccacatctcatttcctcgtgctgcttccacccctccctcgtcgccttgccagttgccagtttgccacccttccactcgttcgcgctctctctctctctctctacaacatctctagtctccgctgtctcgcacagacttctttctctctactcttctactagtacactacgcaacaaagccaaacgctgaagcgcacacgcgcggacgggaggcgcggcgctcctctccccttctctcctccacgcacccccggcttccgcgctgccattactgcccctccacctacctctctgcgcgcctgatggccggcgaccgccgcggcggcggcggcgtcgtctcggccgacggggagcgacggcgggggatccggcgcctgctgctgccccgcggcgaggggtcgtcgtcgtcctcgccgccgcagccgccgccgctgcaggcggaggaggggaggcggaaggggttcgcgtcggcggcgctgcgcgggctgggttgcacgtcggccgcggcctcgcaggcgtacgcgcccggggccggggcggccgcgtcgtcggccgtgcggtcgtcggcggactggcacgggcggaggcggaggagggggaaggagaagaggaaggagaggggaggaggaggagggggcggtggaggcggccacctcgtgggtggagggatcggcgccgacgtgtggtgcgcgcctgggataccgttcgccgcggaggcgtcgtccgtggactgcgtggtggcgcggcaccagatggtggggagaggccgtggcggcgacgcggagaggccgcacagagaggttcgtcgcttgcgtgcgtggatggatggatgccgttgatccttcgcttctacttgttgatttcgcctcatgttcggatctgttcgtgctcttggaaccgattggttttgcttgttctttgctttccggtgggtggtcgatcgattcggagttttcgtctctcatttacttgtgtttctttgtgccttttcttccactcctttttgtctgttggcgaaaaaagatttaaattcaacattcaatactctgttctttttttccgttcttctgttgctgttttcctcccacaatcaattctggcggctttaaaaaaaccgtagcatttgccactgttctaccacttgtatagtcctgagttcctgacgaaccaattaaagccagtctttaatgtcgtgtttggtcagtctaattaagttcttgttatctaaacatgtgacatgtatctcttctgggcgtactgaattcccctgtaccgatgcgcgctgtgcgcgagcggaatctttgccatgtttctctgaaattctctctccctcctcaccaagttgatgatgatctcacccgctacgctttttttttttttttgcctttgcgcagagaccgtgcctgtccaggagggtgaccgtgcaggagcagatatcgtcgtcgttcatggactcgccgccgccgccgcacctcgacgtcgcgcccttcttcggcgccgacctcctcccctccggccgcctccgccggatgcgcgggtaccgccactcccccgtcggcctcgaggaagaggtaaaaaacgtcacaggctcacggtagtagcagcagtactagtactggcacagtagcgcacactgcaacaaacgttcgttcgtttcctcgttgcccccacactgcattttgcttgcttgcacacttgtcctgagccaccgcattgcatgcatcggtagatacatttttccaacgtactcctaagtcggagatggacacggcccgcaacaagtgcgcatgctgacagcggttggtggtgcgacacgctgcctgcctgcataagattcccgtgcgtagggtagtttagcgcgtgatctgacatgcgtattaagcagctgtaacgcgtgatatagattaatagtagtagtattagaagtggagtagattgattgtctggtggtgcgcgagtgaacctggggggtggccggctggccgggtgggcgttggaagtggttgacttgcatctttcgtgcgctaaacgtgacgtgagatcgtggccttcttggaggttaactaatcggcagccttacacaggcgcgcacaataattgtataagcggttgcagttgcaagccatggcacctgcattatgcgcgctggttagcgtagtggccgtacactcgtttaggattaatgcggctgagaagggagggaacgagacagtgggatgtggccacagctttggaaagagacctctcaaccatggtcatacacttccatgaatgcttctcgttgtgtgtatacaccgtgccaactacaagtataaatgctggatactcttgctgagctgatcagaaatgttgccggtaatggtcaattgttgtctcaacggtgctagtatttcaggatgcgggcaaggagtgctggagcacacctgggaatgccaagcaatagtatggtttattctatctactgtcatgctgttctgtggtggatcgtacggttggtaggaatgggcatgctggtatggtgcgtgaatgattggttgcctccgatggcagatcgagagtcctagcagttcaccatttatgattagtgctcggctgtgctgcttgactgaactattcttttggtgcttaagggggaccaacgctccttatcatgttcctgttgcttcagtcataatcagatctagagttgtagtcattccttctggtccttctggatttcatgtgggcatgtgattggtgatgactccttaataatagctcaacatcaagatccacaaggattgtcggtcccgcactgccattgcctatcaagatatatatttgaggggatttgctttaatgtgctttggtgcctagttcagggaagtccatttccttacctataaacattttttctatctagttttacttctgtgctatacctctgttttctgacttaggttttccactgtcataagaattcatatttgattttggtgcacattccaaacagtcgtaaagaaagctactatatatttatctggtgcttcaatctaacctttctatgtaatcgtaaagaatataagagatacgtcagtgcagctgtagaagcatatttagctgcacactttgtactctacttggaagaataaccagcccgatggtcagtgattgagggttaacttgtgctaagcggtgcagttgttaatctgtgatcttcctggcagacatatacataattatgcatgttgctagctcaataagcagccttatcaaaggtagcgagttcaaatacttaatgaaactgtttttgatatggcagatcatgatgtttcagacaagagttctgttgggaggaatgagcatgtatgatcggtaccaggattggcgccttgatgttgataacatgacatacgaggtttgtctctttgccttgtagcatcacttttcaccaccaccaccaccatcatcatcaattgcttcgttttacaggagttgcttgagcttggagataaaataggttatgtcaacactggattgcgtgaggatgagatagttcgcaaccttaggaaggtcaaacacccagcctttgactcctcgttccggtattcaacagaaatggaaaagaaatgcagtatttgtcaagtatgccacaacctcttctcttgagttatcttcttcccttcagtcattatacagggtatccagtgtctggcatgtgaacaaacttcattctcatgtcaatgtgttgcaggaagagtttgaagccaatgaagagatggggaggctggattgcggccacagctaccatgtttactgcattaagcaatggctttctcagaagaacgtttgcccagtttgcaagactgccgttaccaagacttgaagtccggactccgggcaacgacgattgtatacctgggtcaaactttcaaaacatgtttgtttgtgctctgtacagtcaattacatatgttattgtataaacacatcatccattcttttgcatttgcagatagaaatgccatattgaggcatcctttatcaaatatatgttactcttatctcaggtgtcaatattggcacagtccgggacggcagctagtgtcttgtgcaacctcattcgatccttcacgtgttagttgctttagcttgaaacaatcagatgagcacgtctgaatattaccactctgcgagtttcttttaacaaaatcgtgttttcagttacgtttccaatgaagctgattcggcaagtagtcaatactgtattagcagctatctagccaagatactagctgctgcggtgctgccattacaaatacttgtatcttcctggcaaaaagaccttttcttatttatctgacattactagtgaatagtgatatgtgtttctggcatttctgcaggcgatgatcagtgccaccgtgcccgtgtaagcctcttgtctctttttgtgaaggaataaaacatttacatatataggttataaatcaactgttgtggtaataaactacaagcttggaccttggatatagaaaagggagcgaaacgaataacacacttttgtacctcaccattccattaccattttgatgatttcagttccaatataggatgaaattgtgcactcgtgcaatagcgtgttggagctctaacatctaacatttacgccaataacaaaacttaggaagacacttcatcatgctgggagaggaactctattatacaagggtacacttcgtggacagcctacatgataaaacataccacagtaaacaaacagctttatatcctttaagtactcattaatgtaaacatacctttcgccctccaaccaagtcataatgcgcataatgagggccttcgggctttccaaaaaccttatatgtcaccaaatgctgaggaattaacttcaccgtttctgcaaatacaagaaaatgttgttgtgatatgtatttatgaagaaactaaaaaatacataatcaaacaatgaagccaaagagagatcatagtatatgcattatctaatagcatggcctactttagctagggatattacccaggccagtataagccgtgtttagtttcccccctaattccaactttccatccccttctattccctccaaacttttcctcacccaataactttccacctttttttccaacttcccaacttttttaaaccttccacctttttccagaacttaaccccccccatgtattagaccttaagaatgccagtaagccagtccatatataggtatatttgggggttaaagttttttggggtccaagagtcagctgcattaagtagttccctataatgactttcacttggctaacttcagatgataacctgaataggtattcattttataaaattccaaaaaagtcctcatcgcgaaataacagtgcaaatatggagcttattaccataccataaacagcttccggggggcaaatcagatcctatctccagcaagggcaagtattggcactttgattttgtgcagatgctgcttgaagaaaaaggtaccagccctgttgcgcagcccaccatcacggaatgcagttgtcagctgtagtaaaacctttgctggcaccgtgcctgaacaataatgcatcaagtcatcacaagaacttcaagggcttccttattgaaattcatgtatcataaagatggcaggcagataaaaatgaaccagtgcaatcaatactcctacagatggtaacagaaacttcatggtggaacagtgccatatgagcatatcatgcaataacattcaggctatgtatatctatcatatgcttacagtataaggtaaagattaacctggctaggctatatttgtaaaatgtgcaacttcttaggaatagaagtgttcgcttgaccatatcatcatactacacttggatggcaagttcctccgtgaacaatatcaggttgttgtacctttttatgaaacaacttacagatatgacaaagcttaaatatgaaacttacagaagttattcaagacaagcttcgaaagcagatcaggatccatcatgtcctttgatgaaatttgagagcgcagcaatgacagaatatagggtgcacgagacgatatagggtaagtggtagacagtaatgttcctacagggatagcaggaacacgtaacatctcagctgggtctgcctaataaaattgaagattaggttcctgtatatgtatattagtacagtaaattaaattgcacgatggtcaacttacaagaggcaatagcaacttgagtgatgagttagatgttgtgtagtcaactgatgaggccaaagtaacaattgctaccagctctggctcagcaccttcacatccttttgaggcagaaacacagaacaagaatcatgtattgataacagaatgtaaatttctgattcatagcataagaaatatttaagactatcctaaaaaatgtggaatatcaacattgttaaataaatatgttgttttcttgctatctgagacagatcaaaagaagatttccagttatacataccacactttgaaaccattgcatataataatattccccccattgaatgaccaatggcaagcagtttgccatcctttgttgggctttgctgtttaatataattcatctgcatgataaaaagagaaaagattaacactttttaccagggttcccaggtatcaatcgagtgatctttatagatggaaggctaagttaacaaaccgcggcaggtacatcctcctccaaataatggtcaaagtcccaatcatagctaataatgagctccaattgtttctgtagatcttctattgttgcagacaggcgttcttgccaaccaaatagccgaggtgatatattctgttgaccttccccaagaatattcacaagacgtagacttaaatggcttatttgatctgatattgctgatgtttgtggcaattccagtaagcccaaaattttttctgagacttcctcaagactactagttaatgaggcatcaggaacaagttctgacacttgattaaaaaagccatcagcgatacttctcagtcgactatcttttacataacctgagaatgtatcacccaatcgtgccaaagtatttgataactttgtcaccagctgtggttcttctaatgcattactctctattacatccttatcttctactactggaacttcaaatttatcttctactactggaacttcgaaattttgagctagacaagtggaatcatccttggcaggtccagcgccatttaatttctgtgtagtaatctcatccaatgcagaacttcgagacatgtcagatgtggtgtcagctacagctagttcagatccacgcatgctcaggcctgcaccacgcacttcgacaatccatgtatcaaacccttgcatggacatatgacgtgcaaatgaagcctgacaaaattattatagtcaaaatcaagggaaaatataaacagaattctataaccatgaccggcaataacaagttcgttatacaatttttgcttatgagtaaacaatatagaatatcaaacagacagtgaccaaggcatgagtaaacaaacttctaaaacgaaatacatttacatttttttagaaaaaaataaacagaggtatctttaaaataagagtaagcaaaatgccccaaaacatgtgtttttttaaacttaccgctataaaagcacaactactacatcttttatctgaagcctgaagtagggcgcaccagcataacttttactggaagatgtgtacaattttaccaatgtatctatgcaattttttttcttgcacaaactcgtgttctgaattgtgtgatatgtccgcgagattcttactcaagaaattctgcccagctgtattgtagctttaatgctatcttttatgcaccaaaaccccagtttctgttctcatgaaatttcatagctgtcaaaaatggagtatttttttccaccaaattacataagagatgcacttaaactttttaaattttcgttattccctagttctgctgatctgctttgtgccatgcttgaatcagcatttggagccttattgcatcctaaacattgcaaagtaaggaagcattgtcacactagttggtccagaaagttctgtttactgcagcgatttgttttccaacttatttttgttcagtgtatttacagcatggagtaaattctctgttgttccaaaacatagttacttctccacattaagtgtacagaactataaaattgtaacaacaatgatcagctctttccgaattttaatccctaattcccaagataattgctaatttatactcagattaaatcattcatcctatctggaactaagcggtaagcgatttgtagcgattaactaaacctcatattttttttgtcaaaaaagaatagaaaagtactcattgccgatcgattatgcacacaactccacaagttaggatcatatagatatactaaccccaggagacaggtcaaatccaatcgcattggtggccactcccgagagcagcatcagcgggtgattcctcttgggcgcctgcacaaaccaagctagaaccaaatcaacaaccataaccactaaccagccgccaccctctccgctgggaggggaataagcacgcgcacctcaggcggcgggcggtaccgccagagcgcgagccgccactctgtgccgggcacgggcacgtagtgcagctcatccgccgtgcagatcgcgggcttcgccccctgctcgcacgcggcggccgcggaggcgagggcgcgggatggcgacggcgaggatggttggggcggcggcgggggaggcggcgaggcgcggtaggaggcgaaggcccggacgcgcggcggcggcgggggagccggagggggaggggcggacggggaggaggcgcgcgcggtggcggcgggggaggagaggtgcgcgaaggcggcgccggcgaggaggacgcggaggttggccgcgtggaggagcggcatggcggttggagttggagtccctcgcgctctggccgcctctgctgcgttctccggctttggttgcgccgcttcaacatcgaaggccggtggtgacactgaccgatgggccagtctatgtggagaaaattgacatttaaccatgttcgggatggggtttcgctggaatgctagtcccgaatatggttttgttataatgtcattgtcaaatgaagccaacttgctagaatgccatttcaaccattttaactgatttccaaatgttttttatcgtgctctgacatatttgcccctagtcattttgttgactttgcaggggaaaggagaaaagggatcgatccccatccggtcgccggcggtggagtgtagcagcggcagcgacgacggggcgtagctacgagtcggtggccgccagctcctcatcctcgtcaccaccaccacgccaacatccgtcggctcgccgtggacgcgacggagagggcgaggagggaggggcggagctcgccgtgggcgcgacttaggcgatgggcgtggtggagtggtggggagctatgggagggaggcataggggatgccggcgaggcactcaaggaggaggtcgtcgaggaggatggagatgggggtcggcgatgaggtgccggcgc

SEQ ID NO: 26645 - DNA, 17894 bp, Oryza sativa
  unsure (1)..(17894): unsure at all n locations
ccgtccccgtccccgtccccatccgcaacgccgccttctcatccccagttgcgtcgctaccgtccccatccacaccgccgcgttccccgtccccgggcgcgccgccgccgtccccgtccctggccgcgccaccaccatccccgtttctggctgcgtcgccgagccgaacggagaggaggaagacagagaggagagatgagataggatcaaggatattttggtcatctcagcaataaaaaacattaaactgagaagaaatggatggaatagcattgcaacatgttgccccctgtttgagggtagcattccagcgaaaccctgttttgacaatagctaaatgtcaattttctcgtctatgtggcagtcgccatctaacgggaaaggaatttcgtgacacgttcaccgccttaacaagcaacacgtatgaagtagctgtacagatcgggccggaaatctgtgttcgcgaggagcatctttgtgtgaacagtttgtgtgaggtcattaaaacgggaaggaatgcggaaataagccaacaaaatttgcctaatttgcagctgtcgtcgacctgtcgtgctgcacgcatggtccggaaagaagcacgcccgggctagcgctagagtccttactaaattttgcagttctagaagcttcctctcttaaaaactctatcagaatttacagaagtgctatatgacgggatcccgtcccaaccatgatggatgggataagttagcaaccaaccaatccatcgattctatcttcttctaccttatctattctaccatattaccacatctctctcaaagcatgactgctgcacgagctcggtgcggcacaccccggggtgtggatggcggaggacacggtcgcaagcgacgagctccggcgtggccgccggcgacgagctcccaacgtggcatggctgtggacggcggaggatgcaacctccgacaacgagctccggcgcatggctatggacggcggaagatgcagcctccagtgacgagcttcggtgtggccgccggcgacgagctccgacgtggtgcagcgcgtggacagcggaggacgtggccaccggcgacgagcccggcgtggcgcgtggcggcagaggatgctaccgccagcaacaagcctggtgtggggcgtggtagcgaaggacgcggctaccggcgacgagctccgacgtggggcgtggatgacgaaggacacggctgccggcgacgacctctgacataaggcgtcgacgacagaggacgcggccgccggcgacaacctccgacatggggcgtggagggtggggctgccggcaacgacgcctcggtgctcagctcctgatacctagtaggaattacctgatatctggtaggtatcatctgatacctcgcaagtatcactcgatacgtgggagaaatcgtctgatacctgataggtatcacatgatacctcacgagtatcacccaatacatggtagaaatcgtctgatatctgataggtatcacatgatatatcacgagtatcatccgatacgtggtagaaatcatttgatactttatatgtatcacttgataccggttaagtttcaagacacgatacatgtatagcagcccgttcgaaaacgggattccgttgtatagcagccctccagaatttaacaaatacatcaaaacaaagtaaataaaaccaacactatcgaaattcgataatgccaaaatgtgaaaaaaaaatagattaccaaaatatggtatggttgatttgggtaacaaggtcaacaaagcccccttaaagctgatgaacacgagtttaattttaactctgctagggcaataaccaacaactgatccaagccatccatcctatccaacagaccacacaaaactcgtcacttgttgacgtccagccatccatttaggaacgtgcaggttacattatgtagtgaacggatggccagcttaatatgtacttacatctagcccaagtatacagtatcagtgccattaatcccgcgaaactgatgatcaaaacattcttgtgctgcgccgccggaaatcagaacaagaaaaacggtcgcagcgtcgcgagcggtcatgacaatctacgcagctcgatcagttggtgttctttttgccgcctcttttattcttgatcagcttcaggaggttgggcatcaccttcctcttcctcttgatggtgaacgacggcgagcgcgggttccatgcgcccgcggacaccgacgaccgccggggcttggacctcctcgacgtcgccgacaccctgctcgaccgccgccgcgggtacgcgcactgcaggccgtccctctccgccgccgcgttcaggtcgtacagctcctgctccagctccttctgctccgccgccgtcttctccgcctccgccgccacctgcgccgccctggcctccatctccctcacctcccgctccgccgcctcggcgcgcgccgcggcctccttctcgctggccttcagcgcctgcacccacgcctgcgccgcggccaccttcttgtcggtcaccacccggaccagcgccgcgcgcccggtcaggtactcgtactcgaaccgggagatggtcatcgtcccctgccgccgtgccgccgacgacgccctggcctgcatcgtgctctccacggtgtccctgagcttcctcatcgcctcggcctccaacgctttcgccgcatccagctccttcaccgactgcttgatccgtccctcggtcgtggcgatctccttctcgatgttctcggcctccgcgatcacgcaccgtttctccagcttggtgaggtcctcctccatcctcgccgcctccgtctcggctttcagttgcttcatcgccgccgccaagttggacacgatcgccttcgacctctcgtcggccgccgtgacggcctccaaccgcgccttcgccttgaggagcttggtgttcagctgttgcacctgcgcgtccgctttcttttccttcgccttgagcaggcggatctcctcggcgacgcgcatgatctcggtgcgcgtgcagtccatggacgtcatgaactggaagctcccggccttgatcgtctccagctccttcttcgccgcgtccagctcggcctccgcggtcttcagcagcgccttgtcctgcgcctcctccttcttcctcctcgctgcgtcctccgccgcctcgtcgctcttggcgtggctcttctccatggcgcgcaccagctccatctcggcctgaagcacctccacgtcggagttcgtcacggcgagcttcgcctccatctccctcgcgcggctcgcctccttctgcagcgccctgaccctggccctcgcggcctcgatgtccgcggcgaaccgctcggcctcggcgccgcgctgggcctcgatctcgcggcgctcccgctcggcctcgatgcgcgccagctccaccagcacgtgctcctcgttcgcctcgtccacccgccgcttcatctcgtcgatggcgcggaggctggactggatcgtgcacgccgacgccacgatgtcgcgctcggccttcgccttggcctccgccgcggaccgcacctcgagccgcagccggagcagctccttcttggcttggtccagctcctgcaccacctccgcgtaccgcgcgtcgcgctccgcgcccggtgcgtcggtgcccttcctcctcgtcctcgctgcccacattgcttggagctccgacctctgggacgtggctttggccgttgtctgctcgatttggcgctcaagctccttcgccatggctcgcgctctcgacagctcggactcggcgccggctctctctttatccacgtacgccttgcgttcattcagcttgtccagaccggattgtgctagctgcttcatttcagaagacagattctgcacatatatataccgaaatggatataaagatacagatacagtgcgtttttacagaaatcgtataaaaatacaatgaaattgagaactgttgaacttgaggtttgttcacaagaatcagaaaagcgtgtgaattcagacactacctcttgggctggaacagttcctctgttcttgtctgccttcctcccgttgatgctttcgccaaagatgctcatcgcagctcgaaatgacccacttcgtcccaagttctcatccatggtgatggcggcctccattttatcgcaccaaagaaaaggtgaattgcaccaaggctgaatctttcgaacgaaaaattcttggaagtacttatttgtttggagaacagttaagacaagggagagcttgtgtgttggtaaatgaggacaagtgtagcagctcgcgggtctatcctgcttgcatgactagaggagctcactaccacacaagtacacaacatgtcgatcccgttatattatccaccttgttcttgtctgaacttcgcagttgttggttttcactagccaataattttttgttattattttgaaactgactagccaataacttacaacgctcaatttacgccaaataaaagcatctcttagagttggaggtcagctaaatagtttcagctcatccaaaataggaatggagctggataaaacgctctcacaaaataaactagagagatagaaataggtttagagcatctttcccatccttaaggaagtaccatgaggtacgaggtaacatgaggtaccaatctaatctaaccgttgatttaacaggggtataattgggctaacaaaaattaggtctctcttccattcttccatgtcgtcgtcgcccatcgagggccgtcccgcatcgaggccggcgccgtcgtcgcccatcgagctcgtcgccgcccttgccgtcgggcatcgaccgccgccgtcatcgcccatcgagctcgccgccgccgccgtcgttgcccatcgagctcgccgccgccgtcgtcgcccatcgagctcgctgccgccgtcgggcatcgaccgccgccggcgcatcgagcccaccgtcgggcatcgacccccgccatcgcgcatcgaccgctgccgtcgggcatcgacctccaccgccgcgcatcgacctccgccgtcgcgcattgatcgccgccgccacgcatcgacctccgccgtcgcgaatcgagcccgccgccgccgtcgcgcatccagcgccgccgtcacgcatcgaaccctccgccgtcgtcgcccatcgaggttgccgtcgccgtcacgcgtcacgcatccagccgctgtcgtcgtgcatccagccgtcgccgccaccgccgctgctgccggcgtcggccatcgagcccgccgctgccgccaccgtcgcgcctctcgccgattgccgtcgcaccgagccgccgcgcctctcgccgcaatctcgctgctctccccgatttttcctctcgtgaaacaggaaaggatagaaatacccttccaccaatggtaccacttcaatgaggaggtgcagtaccatgaggtacggatgatttctaaccgttgaatgatgctagatcaacggtcaggatttggtattgcacaacctcaacagtaaaaaaccctcataggtttaggctccttcataactctcctttaaatctaactcctgattttaggaattagagttttaccaaacgaaccttgacgtggattgttgaatactattagagtacaagtttagaagtactgagaagaatagagaagaaaaggagtacgacaaacggtatctttcagatattttccggccactgccttgcgagtggtttgtatttcgtttcgtcgatgaggatgctgtagtttgaagttcacgcatgtgtcttttgcagagatagattagagcaaaaattggatcacgtgcgtcagtacatgagattcatcgatcaaaactgtgaactcggagtgaccattgaatcatcggttcattgcacattcacacaggggcttcgttaaaatatcgtcgtatcatgtaacatttcttctacttttgcgtattggagttaaatcttaaaatcatgatcttaggctatgcacgatcacctaatttctcttatacagaatttgatggtgtactgaccggatgaagaagccatatggttgccttagatgcgtcggtgtagtagttgtgaggcgacggtgatgaagatcaccatgcagtgacggcgatgggaattcgcccttcactccccttcaacacgccttaaaatcggtagtttgagggtttggagaattggcttagcgtacatgagtcgtcgctcgtgcacggggttaaggttccctttttatgcgtattgaggggatcaggggtgattccttctcgaggaaaatgacgcttccgatcataaagctaaagagagaaacgtgtgagagaatgcgtgagactcgttcctcaatgttagggatcgcgtgggctttggtgggctaagcccaacgctctcctttctggctcggtggccagacatcaaccaacattgcgtactcgttttgcacatgtactatcttggtgttatgcatctatttatatatgccctctgcgttccagacttccgggcgtccccaacctgcaatggaataagttcactttgagtccctcaaatactgctccaatctgattcatacccctcaaccacaataccatatatcttgattcttgacccttaaactatattggaaccagtgttttcgctgacgtggctcgttgacttggtcaacccctacgataatgtggcagcccagtcacaaattagaagtgggcccatatgtaagtgactagagagagaaaaaactatgacccatttgtcatactcgttgacactgtaccccttatatctcccttccctctcctgctctccctgatcgacaatgccgattggcgaacgagggagcggtggcatgggcctggggtggcaggtggcggcgatagccaccagcaagtgccggagaggcggagagggggctagggaactggcgtgccgccagcactaggggttgggggttggggcattgccgtggcagcggaggaggtgcactgaggagaggaggggtgggtaaggagcagatgaaagcggagtaatggtcgcggcgaaggaggagctcgagctccatgacgtagtagagagagaatgttagtgggcccacatttatgtttttttaatttttatatgccacataagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcgatggcaggacgtggtggaggaggagagctgcggctgctggggacgtggtcgagcccgtgggtgatccgggtgagagtggcgctggggatgaaggggctgagctacgagtacaccgaggaggacctctccagcaagagcgaccacctgctcaggtccaacccggtgcacgagaaggtccccgtcctcatccacggcggccggccggtgtgcgagtcgctcgtcgtcctggagtacatcgacgagacctggggagccaccgggacgccgcagctcctccctgccgatccctacgaccgcgccaccgcgcgtttctggaccaactacgtcaacgacacggtataatgactggacatcagaacggcagataggaattctgtttgattggttgatttcctttgcaattttttctgcagtttttcccgtcgtggaaagtgctgttcaggtcgacggcggcggagcagagagctgaggcgttcaagaacgtcgtccctcgcgtggaggcgctggagcgagcgttcggggagtgctccaaggggaaggccttcttcggcggggacgacgcggggctcgtcgacgtcgcgctcgggagccatctggtgtggatcaaggtggtggacgaggtggccggcgccaacctgctcgacgaggccaagttcccgggcttggcggcgtgggcggagcggttcttggccgtcgacgctgtcaggcaggtgatgcccgacgccggcgatgttctgaagcagtacaaggggttcctggccaaatggactgcaggcgctggttcgagctgaacctgaacacaacggcgttgcctgctttcgtcttcgtggattttctaggtgtagaaaatactttctgcttcggggatctgtactttgaggagtacgttgacacgcgtgatgaataacagttttcttttttgtttcataaaaggagggaaatgttgacacgctgttcagtgaactactttagtgtttctagacgaaccacttagttgatttgctaagcacacttttaaacggcaaatatcgttcttccttgtcacgaaattcgtatcgttccattaagttgcattcttttggaaaactatatttcatccttaaggtacatcccctcgctttgcatgtcacccaaaaaatcatctaaagtcttaaaaaaagaattggtatgacagattgatctatcatgtcaaaaattttaaaacttttttgatgacacgtacaaaacgagcgtatgtcttctgttaagagataaaaatccacttcctgttccttttaagcgtccgaagacatttttggaggatgacaaaatggttctccatgtttgaaatcgtggactggaagtagttacagacaccaatatacgatatatactgtattatcttactccctccgttctattttgagcgcaaccataaatttctgcgtccaagggcctgctcggctgccctttttgaagccacacgacagcgagctgcagctgcaagcagcacagctgcagccgcacaacacaaggtttgcagccgcagcgctgccgcagataggacgccctaactttgatcatctgtcttatttaaataaattttatgagataataaaatataaatagtattttactcgtgacttatgtttttaaatttttttaaaaaaatttaaataagacgaatggtgaaagttgaacgcgaaaaactatggttgcaattaaaatgggacggagtaagtacgtagctactactgctacaacagtaaaaataaacttcaactaatcacctcgtcaagctcaatcattcatccactagtcaaggccataccaactccatcatctgctgtcacgtttggtcgacgcatgtacaacatcgcaatcaacactgacggaatcaagtggcctgtggccccttctccaagccagcaacggcacggagcaatctcctatcgccgcgcactcgccggccgattccaactttgcttacacagcttaactaaaatcagtcaaacactcaaacctcacactaatcacctgatagatgaacttaacaaattcgccatgtccttataaagacatacagttatacccatcttgtacacaaaccgtaaaaccgatccagacaacaacagcatcatactcacacagttcgcggcagcaatggcgggaagaggaggaggaggaggaggaggcgagctgcagctgctgggcacatggtacagcccgtacgctatgcgcgcgaaaatcgcgctggggctcaagggcctgagctacgagtacatcgagcaggacctcttcggcaagagcgagctcctgctcaagagcaacccggtgcacaagaaggtccccgtcctcatccatgccggccggccggtgtgcgagtcgcgcgtggttctcgagtacgtcgacgaggcctggcccggggccgcgccgccgctcctcccggccgacccccacgaccgcgccaccgctcgcttctgggcgacctacttcgacagcacggtaatcgatggcatcttcctgaagaaatcaaccttagatagatagcaacgttcatgtcggtgattgagaaatcaatattagagagatcgacatttttgttttgatactgtattaagttcttcccgccgtggagggcgctgatgagggcgacgacggcggagcagagagcggaggccttcatgaacgccgtacctcaggtggaggtgctggagcgagcgttcgtggagtgctccaaggggaaggcgttcttcggcggcgacgccgtcgggctcgtcgacgtcgtggtcggcggcttcgtggtgtggttcaaggtggtggacgaggtggccggctccagcctcctcgacgaggccaagttcccgggcctggcggcgtgggcggagcggttcttggcggtggacgccgtccgggaggcgatgcccgacgccgggaagctcctggagcactacaagggatttctggctaaattggcttcgccagctggttctacctaatggcaatctatctgccttgctcgcctgctttgacgatgaagaagttgtttggtactgtgtcatgtgaaaatattttgttagtctctgttgagcggtgttcagaatgcaaatgtgtacatcttgaataaaaggagagcaaaatagtgaggcgacttttagtgtgtacaagtataattttgctcaatcagcagtgtgatcacaagggtacagatatgagggggcatagatgaggtgcacgattttttttttaaaaaaaagacgaatcgactcgagtcgattgcttcaagttttttttttcgcaaattgctcttcatcaatcacaaattatttatcaacatcgcaaatcacagaaagtgaatcacaaatttttggcacaaatgcattactactcaaatcagaatccatctaatatccaagtattacctatccatttcagcatcaaaggagaaaacaacatcaacaagggagatcggaaaaaccaacaaatcattaccgaatccataaaaaatcaacttgccaagggtatgggggagggagccaccgattctgctagtggtcacctccgtagtcgtggtcccatccgtgccgccactcgctataggtgaagtctgcccgctcgctcactgacatcgagtgacccacttgcgcgtggatctagccatccccaagttctcggtgatcgaatctagcgccgagctcacaggaaccagcaacccatggtgataaggaggccaagggagcgagggaggcgtggggacatcaaggaggccacaattgctcgacagggagatggaagtgcggcacagctaggctaggggaaagggagggggctgctcctgagctcgcggcagttaagagagagaatgaggcggagggggagattccgaggcataaaaactagtgccaggcttggttcgttggttcaactccctcgaatgtgttagtttttcttttaaggaaaaggcaatgatatcacacgtataaatgtcttcttttaaaaaatggcatttacaagtgttgttggtgcaggtttttaattttagacccatataagggatcaataggacgtgaaaaaccccatatgtgctgattttagatgaaccgatggcacatatgaggatatcatattaggatttttaagtagtggatcaatttagttactatgcatttggttcaaaggttgggatgggtcagattgggttgaacctattttttagactgtttaggttagggacatgtgggatgggatgatccctaacagagaatattcccctaaggttgatctggtacctaaaaactaatggatcaatcccacccattttttctctctcacagacatgtggatcgttccttaaaaagtaggataatctcatccctcatgccaaacgaatagatgagaccgtcagaacaaggatgagtctaacctattccatcttatctccaaaccaacacatgctagaatacaacgttcggagtagaaaactaaaaattaattgggccagttgggccattggccattcctatctagacgtggccatttctcaacatgatttgttacggactataccttgatgtatgactaccttcacaaggatttaaatcatggttctcacaaatattacgtaaaatagatgtgagtagctctggtttctaattttaggccaatcgaattttgttggccatcggaccatggatcttcgtaatggacctcctttctcgttagcgaagccattttgcttctctatcaattatcaaagtgttaacacggtaacacctcgctcaagttgctagttgctgatcgctatcagcttttctctgaagctagtgcaagtgtgcaaccctacttttgttgcagctggaaaagaaaagataggacccctgaactaaccaccctgtgacacactgacactgccttaaagcaaagcgccgggggccggccaagtggagcgcctagtagcgtggcagccagtcgtcacgcggtcctgcaaatagtaaccgcacttgtgccgttctgaaaggtgactgcgttttgaccggatatctataaccgatcgatccactgcaggcaggaaaataccaaactccaaattgttcggcataaacaagccaaacctaattaaacaagtgacatacacatacccatggtcgtattaataaaccagattcttcaaaatgagactactttgagaaaagatatccaggtctattctcacttaagtgaggctttcggttgctcaattaaaaagagaccgatatcccattctatctctgaccagtgttgttaagatcagtttaaaaaagtttttaaagaaaaaaaaaacttgcgtggaggcgtttgtcgttcaaacgtggaggagtattggcaaccgaggcgagaagcactccctcctctcgtctccacctcccacgcctcgtcccaactcacaacccaatcgaatctccccacgacgaaggcagagggaagggagcgcgaggtggtagtagactggcagagagggcagggcaaaggcatggacgcagccggctcgccgcggaggaagaagaaggcggcggcggcgaagaagcggcgggggggaggggacgagcgggagcgcgggcgcgggcgcgggcgcgacctgtctccggcggcgccacccgtgggcgccggtggagggaaggacgcggcgctcgcggagtgcgcggcggcgtgctgcgtgctgtgcgcgtgcctgcccctggcggcgctctgctgcgtggcgcgcgcgcccgtccgcgtcgcgcggcggtgctggcggtggcggtggaggaggcggaggccgcagcggcgcctcgcgcccggggggtcgtcgtcgttctccgacgccgagctcggtgacttccggcccggacggcccaggcgcgcaatggcggaccaggagttccggccacgggggacgtctccaactccaagcggcagccgccgatccccgtcgccggcgccaccgcatccgcagcagcagcaaccaccccctcatgatcggagaagatagtgcaagttagttagcatttttatttctcccatcatttcgcaccaattttgctgcaactatcaccagatcgtccaccaagtggatcgatctttggttagtgcctaagctcatgattaggagaaaaaaaagaagatgattttttgccaaggaagagggccacccccaatgtatcacaccccaatcaaacaaggccaggttgctaatcaatgcacatccgattgtcatcattttcctctggttccagattgttcgatcgttgcacacgcgcgcgcgcgcgcacacaagcggatcgtacgagacgatagcactgcattatcggctgcttcttccatcataactgatccccaatatttcgctggatgtaactgttccgtaagaacagtggatcactggttttctttctctctcttgattacaggctggaaattggaaaacagcgggttaaactgcttaccgttcagagtaatccgttgctagtcaaacatacgtgcactttgggcagttgcgaacatggtgagcttttaattcgtttttaatcaaagaccaatgaataattaaatcatggggagcagacaagccgaacagtgaaatagtttcctaccgccgcccctacctgaatgatcatgagtatcgagggaaaaaaatcagggtgccgaaagatgcgatgccccccttcttcaggaatcaatatcaggaggaatatgtctggcacggttcgagtttgcatgatttgagagttttgaacggttgcaaaggagaatgtcctttgcaaaaaaaatgctcgaacctggaatatgatggcaaccgaaccgatggttggcacagcggtactaaggctttcagcgcaaagtttggattttgattaaaattgaaaatgatatgattgaaaagttatgtgtgcatgacaggttaatgtgatggaaaagaactgaagtttgaagtttggatccaaattttaaatctaaacacagcctaacacatggtgtttgacttgtcgtgagcaaccgggcagccggcgcgacccgaccctgacagacaggtaagcgacgtgagatcaggctcagcagcgaaccagcaccacggatgtgagatcacgtgaggatgatccgaggccgctgcccgcgggcgcgccggccaaaccaccccaaccaggcacaggcagaggatgggcgaagcagcgaacgctgcggaatcacggcagggcggggacgcagtcacgcagccgcacgcggtagctgtcggctcggtgactctacggtgcgcgcgggcggcaacgaggcggccgcgtgccaaccccccacaatgcactcgttgcacctccgcccgtgcgtgcgtgcgagattcttttgttcgttacgggtggacgagggagaccggcggcggaagggcatgccttctccgcgccgttggaaaagcggcacgggcacgggcgatggctcacgtcacgtgcgtcgtgagggatcttttcgttgccgcgagcccgcgaccggcgcaatggagggtcgcgtcgccccgggcatatgcgctggttttgttgcgaacaagcaactactactaccaggtataccactatagttatcaggcttgccgccaccgcccgccgcgaccaagactgccacttccagatgctcggctccatcctataccagattgcagtggaaccagcacaggagaatatggtacgtgggagctatatatacggtggttgtactgtaaaatcttcagcgatatcacgtgtaatcaagaacagaaagacacacgagcggtagggaaggcgatgcccccgaacctgaagaatgcgagcgcgacgtcggaggcggcggcagcggcttcccgtcatcccatggctgagtggctccaccgcttcctccacgggaggcaatgggaagtgggcttcggctcgaatgagaaaaagggaactctccaggagacatctctcattatctacatatcactcaaagtaatggtcatgaaaaaaaaggataggttaatacgtagtaaatcaatcaaaaatatacaaggtaaaatttaacttttatgtattacaatgaaaaaaacaaattttacggtgaatatttgtagtttaattttttttcaacttgtaaaagtaaaattttaacttacatatttgtggaggagtgatatatcatatattaatagatcttctcaaaattttccattccataactatttgagtttacacgcaaacaacgagggaacgtcatttcaagagaaagccatgattatttcgttggtggattgctaacggtgatagcaatagcaaccaggttattttaaagttttgtggcctacagaataagaccaacgacatatttacaaacgaaaaataatacgtgaataaaacttttatatacgtgttcttagtgatctaaaagcaaatgctgaaaaataaactttgataaagaaactttaaaatcaccttcaaattttaaggttgaaaattcaaattttggatgataaggataagtgtaagcgaaaagatgaggcgcttcttctcccttcatctcaaaatataagacgaataaccttttcacaatgtctcataacatatggtatatacacgtataattaactagcacatccctctactgtaaatttgtttttttaatcctttagtacctttgataccattaggtgattttttttttaaatccttcactcttaatatttctaataccattgggtgcttgagccttgaggtgaccaaagcgaagaaatgataataattctcttatggtatttgtgtttagagctttatattttgagattgagaaaatatttggatttgccacaagtttaccgtgcaaataatgtactatcgtactataaatcatgtagagaatcaacgtgacttgcacaaatgcaacttatttcatcatccgttaacaagttcaatgagataaacgtgtccgaatgtaagtggtcaatcttacataatcgacgagataggatagtgtactccgtttcatttcataaatcattttgacttttttctaataaaaatttttaaagtttgattgagtttatagataaagtagcatttccaacacagaacaaacatattaccaatgtatattcattgaatctaatttagtgttctcaatgttactaaatttatctataaatttaataaaacttaaaatgctaaactaaaaaagtcaaaataacttataatattaaagtagtacatgatacgacctacgcgcaaatcgcatgcaaattttgaagtcacggggcaggcctatctgatcacgtgagtgggaagctgtagctgcaaatataacacaataacggcccaaacctcctgtgtggcaaactgtgtcgacccgaaataaatcagaaacaaaacttgacaacgccacagaaggaatacaggagtgatgacactccaaatggtctattgtacatgtggttaaaagaacagaaaaatcatacgcattagattgcactatgacctggacctacaacaataaataggtctgcttcatctttaacccttacagataaaaacatgacttctaaaattgtacaattgatgaagtcagaggaaatatgggacagcagtcctcggtcctcgcatctggttattctcctctgtctctgtgaagaatttgacctctctttcctgatgttttagacaaaggatataaaagatcagaatcagctgcgagccttagagctcatgaaacaaatcagatacttcacagcagtatttgcaaaagaagacatgttaacatattcagatcaactaatgcaagagtcagaccacagataagataacaatttcacactagtagcaagaaatcttccagtacttgtagatgagctaagttcaattggaacttctattccctgaggaatggtttattgaggtggccacagttacacaactagaaacgaatatgctagttgctcttgagtccaacttaagtttcccccaatcagtagtcaaaccaaagtgctgtgtatcgttaattcattgctgagtagattatagatagcatggggtggcatttgttattgttgagcacacaaaagcagttgggtgcctagcgctgtttcatctctgtattgtgtgtgcacaagtgcactagcaaatcctagtactcctatatgaagtttgatgcaattacataatgcttccaccacaggtgcacaacataccattgtctcnnnnnnnnnnnnnnnnnnnnnnnnnnnnnnnnnnnnnnnnnnnnnnnnnnnnnnnnnnnnnnnnnnnnnnnnnnn

SEQ ID NO: 26646 - DNA, 700 bp, Oryza sativa
  unsure (1)..(700): unsure at all n locations
agcaactatcccagattcatggccgtctataatgtcaatgttcaagatatcattgaatattaccttgaccaaggataaggactgaatccttggagataggcacaatgtcctgaaccttttcacttgtaaagattgcttcaatagctgcaagaaaacacaagataaaaaacatgacagaaagagagttacaacataaatgatagatcatggcctgataaaaacaaacaaacaagctcactaccttagtcaatgggaaaaagagggcttcatacattatgctggttttttaaaacaattactttgcaagcctgatgatgttaaacatgcacatctatgctaactggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26647 - DNA, 3370 bp, Oryza sativa
  unsure (1)..(3370): unsure at all n locations
nnnnnnnnnnnnnnnnnnnnnnnnnnnnnnnnnnnnnnnnnnnnnnnnntaaggcatactatttactcccttgtaagctgaaatgtgtacaacaagtattatgcaattagaacagacaattccacaaatatcaacagagttatgtcttgtatggacaagctagagacaggagtcctttaacaaaaaaaaaaaagggaataaaatgaagttaaaataaaatgttcacgcttagaaaaactaaaatctgcgagtgaaggatttgattttcaaaaacatgcgacaagggtatacagcatatgaaatattagtccatgagatatacctggaagggcctaacaacagattgaagtactctgagtgcgttgatagtattccattcaggatgctggcctggacttattatattgctgctgtggatcacttgcttcaactgggggacaagttcaggccacaaattttccttgacaaaatctttttctatgacttggcggaactgtttgatgcaaaccataaggatgtaagataacacccaaaaaaggcttggtagtgaggaatttagttgcagagaaattaagtagaaatgagacatacaacttcaatcaatactcgaagaaggaaaggttccacttgaagcaacgcctgggcgagccgatcacggaactctttataaagctcaggtgatgacaacccccagtcaatatttcggcgtgtgtaattcttcaagtatgttgctgcagcaacttttgttccttggtccccatcagctataagcacaattcaattataagggtcaggtgggctgcctgcctgagcattgattgctcaaaaagaacacatatactttcattcacaactaaatactggtatgacatttccatttttctgtacaatatctcaaaacaaaacaagaacatcaatatattcatctccatggacagagcaccaaccatttcccaaattatgtttctacatgcacataaatagtctccggcacttgctaactgcagtttagcaaaatcatgaattggattctgggtgctgcgtgtggcaatttaaaatagccagacaaacatcaaacatacataagcaatttgtccaaaaagcgttcatatttgcacggagttccactcttaagggacagtgttaggctgttagcacgccacaaattagtaaattactacaatccagactaccactgctcaaattccccagcagaagcaaaaaaatccacaagcttccgcagaaatcgaacaaggtaagcacttggcatggaaactccaccagcacagctacaaagataaaggggcgggtacctgcggcgacggcgaggagggagatggggaagcgggggtcggaggcggcggcgatcctggagagcccttccgtggcggcgtccaccgccgccttgtcggggctcagggtggcggagaggagcgaccggagctcgtcgccggccgccgccgcggcggccgaggtctgggcttcgacctccatggagcgtaaaccctagttcttttttcttttccttttttgaggatattttttgaccagcaagactccagagagaatggggttgagttggagggaatggaaaggaaaggaatttggcgggaaacattggcgccagatcagatgccatggaagaaggatccagccaagagtggtggagcaatcaatccccactatgcactcaattattagtacaatatttacatgctggattacacactaataatcatacaaaactacaattattttcttttcagaattatcactatagctttaactggtatttccccaaagctgcagcattaccaaagattttattaggaaactataattttatcttcctataagttttatgacgtgtatatgatatgtaagtgcaaatttatcattcaagtagagttgtattttttgtttatgaaatcatacgatatttttgtagttctctggaaaatgttgagctaacgttgtaacaaaatgatagtttttttttgacaaaaaatagttgtagctatatgaaatatactataaaaatccagtttaaaatatagaatgtgtttgcagattctgctcgtatataaatcaggcccaaatactaaccgggagcagcccaaatatttaagcccatacctactgtctgaacaatcacaggcccagagtgccacatttttttgggcccatatcatcgcgatttcgccggtttttggtaggaataatttcatctgaggtcccttaacttgtcaacgaatccgattttcatccctcgaatggaaaaccagatacaacgggtcccttaactatcaaaaccggctcagattaggtccctcggcggttttgagggtggttttggctgacgtggcgcctacgtggctaatttgactaggtctttgtctaacgtggcattgacgtggcgcttacgtggcaatttgatccaaaaaataataaaacccgtgggacccacatgtcagtttcatacacaaattaataaaaaaaatggtggggcccacgtgggccccacatgtcattctcaccccttttcttcctcctctctccccatctcccctctctctcccttctcccatccccgaggcagcgggcggtgtccgggtgagggatggcagctcgcggcggccgggagaggagggaggcggcgcacggcggcccggcgaggagggaggcacgctcgccgtcccggcgaggataggcggtgcgcgtcgcccgggcgaggagaggcgccacgcggcggccgggcgaggagggaggcggcgctcatcggccctccgaggagggaggtggcgctcggcggccgggcgaggagaggcggcgcgcggcgtccgggctgagggagacgacgcgcggcggcccagcgaggagggaggaggtgctcggtggcccgacgaggagggaggcggcgcacggcggccgggcgaggagaggcgacgcgcggcggccgggcgaggagggaggcggcgctcggcccggttaggagggaggcggtgctcggcagcccagcgaggagaggtggcgcgcggcggccgggcgaggagaagcggcgctcggcgaccgggcgacgaagggcagctccaacccggatgtgaccattgaggacgtcggcggaggtggccgggcgaggagggaggcggtgcgtgcgactaccgagcgaggaggggtcgtgccgtccggctgggcatcacgggcggagcggccgggcagcctccttgctccgatccggccgccccgctccaccggccgccgccgctccacccgcgtccgccctgctccggtccggccaccccgctccaccgacctctggtcgccgccgccccactccaccggtcagtgaggagaaagaggggagatgggg

SEQ ID NO: 26648 - DNA, 8616 bp, Oryza sativa
ggttttgataggtgaggaacccgttgtgtctagttttccattcgagggacgaaaattggattcgttgactagttaagggacctcagatgaacttattcctttttggtaggatgtgtggccagaaaaaggaataagttcatataaggtcccttaacttgtcaacgaatccgattttcgtccacctaaaaccagatataacgggtcccccaactatcaaaaccggtacacataaggtcctttggcggtttagatggtgtttttggctgacgtggcgcctacgtggcaaatttgactcggtcttcatctgacgtggcattgacgtggtgcttacgtggcaattcgaaaaaaaaaacccttagggcccacatatcagtttcatatacaaattaataaaaatagtgggatccacgtgggccccacgagtcattctcacccctcatcttctttctcctgatctctccccatctctcgtcgtcttcatctctctcccctctcctccctcctctcgctggcagagataagaagcggcgcacgagcgccggccggagggaggaaaggagcgcgcgcatgcgcaggaggcgaccggcgagaaaggaacggcgtcctccgctaggagaaggacgcacacctcaccatcgcggcccccgccaccgtttccaccgtcctccgcgctgctcaccgacctcgacagcgtcctcactatgggcggtggcgggcgagctcccgcttctctccacctgcttccccgccgccgctgtcgaagacgacgacaccgatggcgacgggtttgaggagggcaccgggccaccgatgcggcgattgggcgtcggcggcgcgggagcagtgcggtggcggcgcgcagggccacagggtgcaagcggcggcggcgtcaaggagggcatcggcggcgcgtggggccctagggcgcaagcggtagtgactagtgactggcggcagtggcgcaggagcagggcgtcgggacgcaagcggcgccgtggaggagggcgtcatcggcgtcgagcgccctttatctggtcggccgccagcttccggaagcgaacggtgagcacgtcgccattttctccttctcccctctccacgacttcacagggattggaaactgcttgctgcagttgctgttcgattctatttctacaattctactcacgatacaatccattatttccctcagtaaatcccgttgaaatttgaacaaaattcagtgccaaaatgttcgctcacatcacactgttgcagcatgacaaacaaatgttcgatctacacacttacgaaccaccggatttcggcggcggctactgcggcgtcggagtgcagattcatcaccctgacgaggctgctaccgtcctcgccgtacctgatgaggtggccgtacatccgcagccagtggtcggaggcctcgtcgacggtgcggtaggtccagatgtgtggtctgagccagaggcagtcgacgaggtcaccccacgcgcctcgttttccatgctcagcacacgacaccattgaaggtccgtgacgcgcctgtcgtcggaccggataccggcgacgccaaggccgggcaagtactcgacgaggtcagccgccgaagcaggtagaggggctggagatcatcgaagtggccaccggtgagcggttgtcccgctggcttcgtgcgccgccgctccagccaccgtcgccccactccgcccgccgccctagtccacatcgtaggaaagaagagagagaggatagcaggaagaagggagcagtgaggatgacatgtggggcccacgtgggtcccacttttttttaactgacatgtggggcccactaatttaattatttttctggatcgaattgccatgtaagcgccacaccagccaaaaccgccctctaaaccgccggaggaccttatctgtaccggttttgatagttgagggacccgttatatctggttttagggttcaaggacgaaaatcggattcgttgacaagttaagggacctcggatgaacttattccccagaaaaacaaaactgaacactgcagtagagcagaggaccaacagcaacacaagagaaaagaagtcatcacatctacctgctacctaactggagcacaacaaggctaccagcaagcaggcagattgtgcaactgccatctactcaccgaacaccaaactctccctctcgcttctcttgcaaaacaacctttccagaaccaaaccaaacaaacaaacaccggttcaacagtctaatcactagtcactagtctgtctggtgtgttgttctccttaataacgtaattaatccatccactgtcaaaccaagaaacaccaaaagatggaaaaggaaaccgaaggcagaaaccattaattctcgcacagcacaatgtatctggtccgattggtgtagttagctccagaccagctggtcataaacatggtctcatcctcatacagggtgtgcaaatcacaatatcttcagtagacaattaattcaggaggatgcatatcacaattagcagtagtttagtcaattaattaatgcttcttttctacactgatgctgcaggttgcttacttagtagatccaatctagaacacagcgagtcatcttctttatattcattccattcctcccaaagacgcaacgtgcacacaccaccaccaccttcatctcggtggcttcgttcactccgcctacctacctacctttgcagttggtttgctgaaccctcctcaagaacccacgcgcctctcgcggcagcagctaaccaagccatggcgcgcaagaagatccgggagtacgactccaagcgcctcctcaaggagcacctcaagcgcctcgccggtatcgacctccagatcctctccgcccaggttcgattctttcttcttcttcttcttgatctcaaagttttagcttttgtttccggtgatccctggctggtttggcgttttttcatttttggcctgatttgggcccgcgtgatttggcctggttgcgtgtaaagatctggtttttctttttttttgttcgctattcattactcaatgaggcattggcatctgtgaattcatgacaaaatagttctctgtttagggtaaaatgcgatgctttaagatgatagtatgaaatggggatctggctacaagtcgtatgaagatgcaatttttctgctgttgggcattgtggatgggctcacttacaggattttaattttagaatggaaatgttcttggttctgtatgcgagttatggcttgaactagtacgacttatggttgcttgcagtttggtacttgcagtagtattaggtgatactccatatagtgcaaaagcatcaattcctttgttagatctggagctttgtcttgcagcattgtttttgtttttttctatgtgtaaattgttagttaactctcgttactggtgtccgtatggtggtgaactggttatgatgttgacacttgaatgttgtcctgatgcaaagtgatttcctctgaaataaataacagtacatggactacgtacaagcagatatttccttttgttacattcacacatttggggtcactagggagccttcatacattttaaactgactgattttgaattatacaaactgtactatgtgtgaaattaatcgtaattacggttctcgtttgacatagcatatttttgtttgaagttaaaaatatcggtttggctgattctgggatttgtaaaaaggttacacaatcgacggacttcacagagctggtaaaccagcagccatggctgtcaaccatgaagttggtcgtgaagcccgacatgctgttcgggaagcgtggcaagagcggacttgtggccctcaacctagatattgctcaagtcaaggagtttgtgaaggagaggctgggagttgaggtagttcaattttgctatcgcctttaaaatctgacttattctctgttcgcttgataaattaagttgttctgtcctattgtggctattcaggtcgagatgggtggctgcaaggctccaatcaccaccttcattgtggagccatttgtaccccatgatcaagaatactacctttctattgtctcggagaggctgggcagcaccattagcttctcggaatgtggaggaatagaaattgaggagaactgggacaaggttaagacaatttttcttcccactgagaagccaatgacacctgatgcatgtgctcccttgattgctacccttccattggaggtatttgtactgttaaaattatttgccattgtaccttgttcagttgatttcatttgaggagtacttccatttgtcacatgcttataataattgaactgtacatttcgacatcaggcacgtggaaaaattggtgatttcattaaaggagtctttgctgttttccaaggtattaaagatgcatatagaattcacttttcatttgttgtaatgttttagttgtaaatgtaataaacgtattggtctatcatgtatccataacaatatgctcccattacagacttagatttctcatttctcgagatgaacccatttaccatcgtgaatggagagccgtatcctctggacatgagaggagaattagatgacacagcagctttcaaaaacttcaagaagtaagtcccattgcttctctagcatacatgcctctgtgcgaatattttattaagcatttcttgtcactgttcaggtggggaaatatcgaattcccactaccattcggtagagttctcagttctacagaaggctttatccatgacttggatgagaaggtatccacatctcaaattacacgtttcacatttcaagcctcctccccaatcttatttaagtatgagttgcctgtataatatcatcagtaggtttgcacatgaattcagataggagtgctggcagtctggctcagtactatatgtttttttgaattattttctaaatgtgatatgatgtccttattctttcagacaagtgcatctctgaagttcaccgttttgaacccaaaggggcgcatctggacaatggttgctggaggtggtgccagtgtcatatatgctgatacagtaagctttgagttcctcccttgttttaacttagctgttcagggatttcatgctactgtcatgaaattaacttttttttttcttatttaccaggtcggagatttgggatatgcttcagaattaggaaactatgcagagtatagcggtgctcccaatgaggaggaggttctgcagtatgctagagtagtacttgatgtaagcactcaagatataaccataaccacatttctctccactcccttgttatgtcaatttgttaatgataacattcaatgcagtgtgcgactgctgatcctgatggccgcaagagagctcttctcattggagggggtatagctaacttcaccgacgtcggggccacatttagcggcatcattcgggccttaagagagaaggtagctatgctgacccctaaatctagaattgtggccaatgttctctaaaacttatcaccagttccacatgttcatctgattgattgactgtcaactgaatctgaaacttgctttcaggaatccaagttgaaggctgcaaggatgcacatctatgtccgacgtggtggtccaaattaccaaactgggctggctaaaatgcgcaagcttggcgcagaactcggcgtcccgattgaggtacggatctactgtctcctactgcacctctctctttgctatgcaagacctgttatatctgaagttcataaatgcaaatgggcaaacctatcagtttgttgttggtggttctgaatcactatcctgaccatcccctcacacaacacggatgagctgatttctgtttgaacaacccatcactgcaggtgtatgggccagaagcgacgatgactggaatctgcaagcaagcaattgaatgcgttatggccgcagcataaatgaagatgcaagttctgggatctgcaggcaagatgctgaatgcgtgatgggtgcgacatggatgagagtgtggtgtagttgcagtagttctctgcagatggctgatttgtttcttgatacatgttatacttggacgagatctggataggttattgatgtactgaaactactactgcgatgcaataaaagtgagagtagcgtttcctgatttgttctcttcttgattgtgatattgttgcaatgcaatcgcgctgtatttcatctcacattgagatgtgttcctgattaagtttagcccctggttttggttcaagtttaagccatggtactgcacatgcattttacaggatctgaatcttgtcatcatgctcagcaacaagtagacgatggtcacgacagaagagttcaaacaacagcatttttgtgctgaaaaacttggtagtatctttttgttgtttctggcaataaactattgcaaatggtagattgtttgctaaaataggttttaatttttcgatttcgaagtaaaaaccgctcctcacaagtttaccaaaatccaatcgaaaaccggtaaaaaccggcgactttcagtgaataccatacgaaaattttcacaaccaagatcggttaatatcgaccggttttcacaaaccgagatttcatcggttttgtgaaccgtctaaaatcaagatcatgtttacaaatatagttcaaaaatattattttgtataaaaatatatgtaattaactgtggagtaaactaaatatatataattgttttgcaataatctcttaatcattatcgggaaaacagttatttaactggggagtaaattaacatcatgtccggctaatatcgaccggttttcacaaaccgagattccatcggttttgtgaaccgtctaaaatcaagatcgtgtttacaaatatagttcaagaaatattattttttataaaaatatatgtaattaactgtggagtaaactaaatatatataattgttttgcagtaatctcttaatcattatcggcaaaacagttatttagctggggagtaaattaacatcatgtccttacagtaaacattgtttggcagtgctgtttctaccattctagttttacagtaattataaagtaagaaaatccaatatatccaaccgctatccttttaaacataaaattatcgtatgattacccattaagcgaatatagattattctctaaatcaatcaatcaactatatttatgtctaagaaaatcaaatatatccaaccgctatccttttaaacataaaattatcgtatgattaccaattaagcgaatatagattattctctaaatcaatcaatcaactatatttatgtctaagaaaatcaaccagattatgggcatgtgtgttttagtactgccatataactctccctgcagttttgttccaatagcacatagtcatagtcataggtaacaacttatatctaaaatgggcaataatctttatatttatatatatatatatatatatatatatatatatatatatatatagaggtgtgcaagcaagtacggttcatacatacatataacgattgtcataagaaactttagtcgctcttccagaatccggaaactgaactactataccctactatactcacttccatttccaactttgagcatgcattttccattaccgaccttgagcatgcatgtattcatagctaccaatgtaatccaacagtttcattgtgtatgattttagtttcaataatttaatagcttatatataaaaagtgtaaacatgcatgttactatcgtccaataggcatgaacagcgtaaaaaacaaagcgcagcatcgttcgattctcaatgatgtgaagttattttcttaataaaaaaggcaaaatcctttcatgtcattttcattagatagagaaaaggcttttctttttccaaccgagttatggaaggtaagcaagaggagacatcgagatgtttacaattaaattccggcatgccttgtgtgtttgcgcttgtctgaaataaccgccaaaaatcatgataggcctccacctctggctgccaccgccacgcctccccacagggccgcatctcctcctccggcggccatcgctgcacgccgtcccttctccttgcctgccactgcccttctcccgagcaccactgccggatctcgatcgtcggcgctgctccggggggacctgccgccacccgggtcgatctgttcccaccgccgtcgccgacccccttttattgccccagcttcctcctccagctcgctgctctcgccggtgggcaccagtctcgccgccccctccagctcgctgctctcgccggcgggcgtcctcaccatcggaagaggagaggagaggggagagagatgaagagaggggagatggggagagagagtaaggaggagaggagagtgtgaaggacaggtggggctgggccccacctttcttaattttttttgtgtaactgagatgtgggcccacgggttttatatttttctgagatagaattgtcacgtaagcgccacgtcgatgccacgtgggacgaagatctagtcaaactagccacgtaggagtcacgctagccaaaactgccttctaacccgccgagggacctcttttgcaccg

SEQ ID NO: 26649 - DNA, 7777 bp, Oryza sativa
tagatttttatgtctgttcttatccattcttataccatctctcctataggtacgtccattttgcatgaaaaaaatcattctattcgttcaccaaaacagtagctatatcgatcagcaagcgtcctcttcttctccttcccatctacacctcctcctcatacccttcgccatagccacctcctccctcttctataagaaaatcagccctatgggcacatgtttcagtacggccatataactctacatttagttttgctccaatagctcatagtcagaggtattaactaatatctaaaatgggcaaaaacctttctatatgggtaagctatcaaattatggaatctaataaaatcatacacaatgaagctgttggattatattggtagctataatacatgcatgctcaaggttatggaagtgagtagctagtacagttcccggattccggaagagcgactaaagtttcttatgacaatcgttatatatatatatatatatatatgtatgaacagaactttctgccacaccaatgttatgtatcatataaaaagtataaacatgcatgttactatcatccaataggcatgaacagcataaaaaacaaagcacaacatcgttcgattctcaatgatacgaagttattttcttaataaaaaacgtaaaagcctttcatgtcatttccattagatagagaaaatgtttttctttttccaaccaagttccagaaggtaagcaagagtagacacatagacgtctacaattgaattccggcacgccttgtgcatttgcgcttgtctgaaataactgccaaaaatcattataggaccaaattgcccttaggtaatgtacaagattgggctttacgacatatgaaaggttgggctcctacaatctgatgattagttaagaaaaagtcaattttgtctccctcaacttcaaacactagtttcattcgtaccccctccctttgttgtcgtataaaagcaggtgtagaggctctcttaactgttaaaaccgagtcaatttacctccttcgatggttttatgctttatggcatgttgatatggtctttattttaggtggtactaccgtaagatctatttaggtggtactaccgtaatatatagtaatttattaaagtaatagaaaaagaaacctccacgttcgttctcacggcctagaaattctcatattaatcggagaaaaagaaaaacagagtccatatagaaatacagtttaaaaatatctgaaattaggaattaataaataaggaatattggaagaggagactaaaagttcatatacatgtatacaatttaggattaatggaaattcgtaattaaaagtagatgttatagtccatatctctactattataaaaattgaagatgtttttgccagtgttttggtacgtcatccgtatttgagtcggtttctaatttcgttcattttttgaattacagatccgtgtttgagttggattttaagtttgtttccttttggaagtataaaaggagcgtacaagaaatgttttgaaaaatctctcatgctaacttgagatgaaatatggactactaattgcagcttatgattttctaaaaaaatatccaatcgagttttcactgtgaattttaccctaactaaacggtataacaataataaaattaaaatagcatttacccattgcaacgcacgggcatttttctagtataaatataatttagaaataactaaaattcaaaattaaaaaaggaatattgaaagaagagtatagagtgcatatagaaatataatttataaatatctaaaattcggaattaagaaaataaggaatattagaagaagagcatagagtccatataggactaaaattcgaaattcaataaaatgttgaaagaaaatactagagtccatataggtatacaatttagaagtaactgaaattataaattaaaaaataaataatgttgaaagatgagtttagagtccgcataaaaatacaattagaaataataaaaattcaatttttttttcaaaaaaagaatatggaaagaagagcctagagtctatatagaaatataattcacaagtaacgaaaatctgaaattaaaaaataagaaatattagaagaggagtctagaggccatataggagtataattgagaaataagtcaaataactgaaattctaaatttaaaataagaaatataggaataaaatttataaataatagaaatttagaattaaaaaaaataaaaatattggaagataagtctaaagtccatatagaaatacaatttataaataactaaacttcgatattaaaaataactgataactatacgtatatacaaatacaatatgaatattacacatcagtagtttttgtaaatttagtgtaaattttaaaattatattgttattttaatagtaaataagaaaatatctattatgtaagagaagatgcaatctgtgcggattactatactaattaaaaaaataataaaactagtgagacctccatgtcacagcaaatttctttatcctctaccttttcttttccccttcctctctcttcaaggtgcagcggcgtcgaactcaagatgcaacacgcaaccacctcctttctcaaaaaaaaaaaaccttctccacagtctccaagctatgcggcacgctggcgcgtaggtaggtactacactacacacgactacagtccaatctggcccgagagaagtaaaagcccacagcggcctaaccgatatgttatcctttcacgttacatcgataaacaaccatattttttctgttgtttagattgttgtgtttgtttcacggtatgtttatcctatctaatctattctcataccatctcttctatatatacgtacgtccattttgcatgaaaaaaaaatcattctctcaatccaccgaaacaccacgtacgtagagtagatcagcgagaatggcctcctcttcttctccatcccatctgcacctcctcatactcttcttcttcgccatagccgcctcctctctattgtccaccgcgacctccacgcgcgcctcgccggccgacactgccgtcggcggcatcgccgccaaggtgtacaccaaggtgtgcgacgcgacgaggttcgccggcctgggcctgaacatgacggagttccgctactgcgacgcgtcgctgccgtacgccgaccgtgtccgcgacctcatcggccggatgaccgtggaggagaaggtcggcgccctcggcgactggaccgacggcgctgcccgcatcggcctgccggcgtacaggtggtggtcggaggcgctgcatggcctctccagcaccggccccaccaccaagttcgacgacctcgccacgccgcacctccactccggcgtctccgccgtctacaacgccaccgtcttcgccaacgtcatcaacagcgccgcctccttcaacgagaccctctggaaatccatcggccaggttggttacaatttacaattcatcgatcatctcttcatttcaatctatagatcatacaaatctatatgaattttgttcaaatttgtaggctgtgtcgacggaggcgagggcgatgtacaacatggggaagggagggctgacgtactggagccccaacatcaacgtggtgcgcgacccgaggtgggggagagctctggagacgcccggcgaggacccgtacgtcgtcggccgctacgccgtcaacttcgtccgcggcatgcaggacatccccgggcacgaggcggtcgccgccggcggcgaccctaacacgcggccgctcaagacgtcggcgtgctgcaagcactacgccgcctacgacctcgacgactggcacaaccacacgcggttcgagttcgacgcgcgcgtcgatgagcgcgacatggtggagacgttccagcggccattcgagatgtgcgtccgcgacggcgacgtgagcagcgtcatgtgctcgtacaaccgcgtcaacggcatcccggcgtgcgccgacgcgcgcctcctgtcgcagaccatccgccgcgactggggcctccacggctacatcgtctccgactgcgacgccgtccgcgtcatgaccgacaacgccacctggctcggctacaccggcgccgaggccagcgccgccgcgctcaaggctggcctcgacctcgactgcggcgagagctggaagaacgacaccgacggccacccgctcatggacttcctcaccacctacggcatggaggccgtcaacaagggcaagatgagggagtccgacattgacaacgccctcaccaaccagtacatgacgctcatgaggctcggctacttcgacgacatcgcccagtactcctccctcggcaggcaggacatctgcaccgaccaacacaagaccctcgcccttgacggcgcacgccagggcatcgtcctcctcaagaacgacaacaagctgctgccgctcgacgccaacaaggttggcttcgtcaatgtccgtggccctcatgtccaggcccctgagaagatcatggatggagactacacaggtacgtaggtcgtcaaatgcaaaaattctcacttatgttactgttcatggtccgacaatggcatcatgttactgaacattattgattgatactttttttttcattgttgaaatgcttgacaaaccttgatgttactactgttcatgatccgacaatggctcaatcaattacagaaaaatgttactgaatactactttgaaatgcaggtcctccgtgccgatacgtgacgccgcgccaaggtgtaagcaagtatgtgaggttttcgcatcgcgccaacactaccatctacttcggaggcctaaacctcaacattgagagggagggcaacgacagggaggacattctcctgcccaagaaccagacagaggagatcatccgtgtcgccaaggcgtcgccgaacccgatcatccttgtcatcttgtcaggaggtggcatcgacgtctccttcgcgcagaacaaccccaagatcggcgccatcctctgggctgggtaccctggtggtgaaggaggcaatgccattgcagatgtcatctttggaaaacacaatccaagtaattcagaatgcaaatcacatcattattttattcttttgacacatcaaatctcaaaatcaaatgttctttgattgaacaggtgggaggctgccattgacatggttcaagaacaagtacatctaccagctgcccatgacatccatggatctccggccggtggcgaagcacggctaccctggaaggacatacaagttctacgacggcccggacgtgctctacccgttcggctacggcctcagctacaccaagttcctctacgagatgggcaccaacggcaccgccctcatcgtccccgtcgccggcggccactgcaagaagctcagctacaagtccggcgtgtcaaccgcaccggcatgcccggcgatcaacgtgaacggccacgtgtgcaccgagaccgtcagcttcaacgtgagcgtcaccaacggcggcgacacgggcggcagccacccggtgatcgtgttcagcaagccgccggcggaggtggacgacgcgccgatgaagcaggtggtggcgttcaagagcgtgttcgtcccggcgtggagcacggtaagcgtgagcttcgagctcaacgtgtgcaaggcgttcggcatcgtcgagaagacggcctacaccgtcgtgccgtccggcgtcagcaccatcctcgtcgagaacgtcgactcgtcggtgtctttcccagtcaagatcgacttcgctatttagacaatcttaattaaatatatattcaggtgtctgtttagattcttttaggcaatgaggtatttgtttttaagttcttttttcctctaaactgccatatactgtcatacgtttagaatcgtactccaaaattggagtgttaagtgtcaatatgtttaggcttccatgttacaattggaacatatatggtcatagaagttgaaaagtttagcagtttcatatcttctgttcttgacacgtatgtgatttaccaactataattaagctctcctgcgtatcatgtcaccgtacgtcgtgccgtccggcgtcagcaccgtccgcatcgagaacggcgacccatcggtgtctttccccgtcagcatgctgaatgtaactgtcttttctaggctccaatattattcagtatgctgaatgtacctatcttttctatgactttgatgttaccaatctctcatcttttcgcttatgtttatacttatcagtcaaaatttgaattttcaaccttaaattttaagccgattttaagattgttttatcgaagtttatttttcagcccttcgttttttcatcaaagcagtgccatacctgcttacatctttcttgaaccatgcatgttcagtcgttcagtcccttcgtgaaaatttcctgaaagttatattttctcatgctcagtccctttatgaaaattttctgaaagtatatttttttatgaaagctttgcatggatctttctggaactagttcttcagttctgaaactaaggctgcgttcgttcattcaggtgagattgggtgagaaagcgcatcgttttccgcgcacacgctgcccaaactactaaacggtacattttttgcaaaaaaattttataggaaagttgctttaaaaaatcatattaatctatttttgaaatctaaaatagttaatactcatattaatttcgttttacgtatcttcccaatcttttcaacccccttcttctcgagctcagttttctgctctgaaactaaaacctcgtggagttttttcagtattgtggcacataaatgtaacttgccaactttgaaaagagatttgtttgaattttttttaacttatatcgagctttcacaaatagttgaaacttgaaaaacttgttctttgcaaaattgaatgaaatttgtcaactgtgaaagagtagcaacaaagttattcattgcaagcctgggaagttttgttttgctcggtcgaactaggtgatcagggcatcctccatcatcatactattcatgtacttatattactatattagtactatattggccggagagagtctggtatgtcatataaggcccctctcccactagacgatatagaccagcagaagggagacattatttacctgcattaccgtaccagtcccagcaaccttgcccctctcctgttagccgatatagacaaacattattgagacgttgtcgattctggaaatcagcaatagtaaaaggggatagtgtacgagatctcaaaatggatggatgcggaacataaagatttagacaggttcagtctctctcaatgagagacaatactctactcctgtttggagattgtatccgccgggtgtatattgatctaacgatctgattgtggttatacccttgaagggctccctgcccaccttatataggatggggggggcaaggttacaaagagagaaacttacccaaatacgacatcagttttcttaatctattttacaatattaccgaaccaagactttaggtcgttccataatatataaagaaacgtaatacctaagtcatgatccgttacatattccataaacataatctactccctataatcagtcggatagacctgccattactatgtggttagttgaacaaactaagcatatggttaaggagtaaataaattaaccaaccgagtggctttttagtcaaccaaatgacttaatattaatttatagcatatagggctgcaggaattc

SEQ ID NO: 26650 - DNA, 13649 bp, Oryza sativa
atttttttaaggtattgggttcacacaccgtgcgcatatcgcaaaaatgagtatgcttaagtccctataagacacatagcttcatcacacctgaaaaatatatggcatacgtggtgtaaaatcccaagtactaatgctcaaatgatttaccactgcctataaatgaccaaaaaaatatattataattagcctaaagccataatattggtcttttagaaaaagtaggaagaaagcatgtgcagatgcacgggaaatttatttgttgtttgtaaaaaaatactaaaaaaaggtcatatgtcaccatattttataagaaaatagattgtaattgtaaaagaaagaaatatttatatcatgaatccctgaatagcatgatccgagtgatataccgactgtttttaaatgatataatgcacatagcctaaagccaactacgtctataaaaatcacatagcaaacgactttaataaaaagcctttatttttagataatggaatataacatcctggcctttgctcaaaagagttacagctaattattacaatctagtactctagaaaagagtgtagtccaaataaaatagaacacatcaaccaaaatagataaaaaaacaaaaccaagacaaggagaacacattaattcaagtctatttatgaatctacatcaatagttggcaaaaagttgcataaccgttatctctagcttataacatgcaactttcagaaattctccatcttcatcacacatttgtaattgtaaccaaaaccggagccaatgtgttgctctgaaaattacctgcatatataaaatagatggtaatttatcaaaaaccatatcattcctgctcaaccacagagcccaacatatggcagaggctactacaagaatcagtttactctttttcttgtctaccccaaaagccaaccataaaaaatatgagatatgctagcagaaagaccaaaagtgaactgaattactctccatatgaactttgcataatgacaatccatgaagaggtgttgaatagtctcatttttcatatagaaacaacattttaaattaccattccaattccgtctcgccaaattgtccttggttaacacaacccctttaagcaagtaccacataaagatcttcatcttaagcggcatcttaagcttccaaatactcttatcctctcaatataaccattattaattagagctagatacattaacctaatcgagaacatgacattctgatgataattccatctaaagcaatcagaagaaagattcaactggatatgtacaatagaagcacataattcatgccaataaacacgattctgaccaactaaggcttcctaaaagaaatattaagcggaacaaatcccatgatattagcaatagaagaaattttgattcggacaatagtatataaagatggatatttatctttgaaggccaagtttcctaaccatttatcttcccaaaacctttttgttccccattatgcagttaataaagaaattttctaaggtattgggttcacaccacgcgcatatcgccaagacaaattaaatatgcttaagttcctacaagacacatggcttttccacactcgaaaatatatggcatatgtggtataaaatcgagtaaataatacccataaacagatttaccaactgcctaaagttgaccaaaatcatacaatcagtctaaagctatagtattggtgttcgaataagaatgcacacatatgtggcctaaagcaatgatattatatataatcaattgctttatataaaccaaacagtgccttaacttgtataaaagttaatagaccagctatatatataaagctttactgttttccatcttttaaattgcattgtaccaactcataaaaagttgtgtaacagctgaataaaatgattttcaagatattaagcacttgaacacgcgtacattgccaagaacaaatatgcctaagtccctaaagacacgtgacatgccacacttgagaaatatgggctgcatactcttaaagggcttcggcccaaaaagaaaattcaccgatacccttaaaaaaaatcaccgtgattactgtgcatcatcttctccgccgcttcatttccaaaaatcccccttcgcgctccttttcacaaccaccaccgccggagctaggactagggttccccactcatccaatcaccaaaaagaaaacccaaattagccctcgagcagatctgcacctccgcaccaacaacctcctcaaatttcttccacaagaaactctaatccgaagcttctcatatccacccatggcggaagagcgagaaatctcgttcgaacaatgggcgacgtttgatgtgaaggaatccacattgaaggagacggtgaagaagggcgtgctgccggcaaaaaaatcatcgggtggcaatcggcctacagtgaggaattctcgacaccgaacattggagaaattgtggtatttactaccttcttctatagtggtttcaatctcccaacttccactttcttctgtggtcttttggatttttatggaattaggatttatcacctaaaccctaacaccattctatacgtcaccgtatttgtccacctgtgtgaagcctttttgggcattcggccccattttaatttgttccgctgcatattttacctcaaagcacaccccaccaaagaaaacccctacgtagttggtggctctagctttcagccatgcggaaatatccacaagcactacttcaattttcctttgagaacctccaacaagggctagcatttgaattggttttacatctcgaacccagttccatgcctccctgcttttgtcggcctccctccagtccatggtccccattggaattctcagccggagggaactgatcttgctgaggctaactccttactaaagaaaatagttggaatcaagggagccggcttacgcgggaagtaggtcactctggcacttcatcaaatgccaactagcccccatcaaggagagagatcaaagccatccttccagcacgaaggccaaactggccccaatcgggaagatccagactcgatcgagttccagaccatgtattctcagatgtacaaagtcttctcgactgggattgtcatcgattatgggcacaatcttccagtcatcccatacagcctaatgaatcctacgcctccagtaagtctctataactcttctttcgtctctggcagtgaatgaatcattggatatataattgccttgtcttgacttttataggaaaatgaatctataatctcaaacccccttgctatggctcggcaatctcctcgaaggagcccaagaaataagcaaccaactgggggcccatcaatcaaaacccctcaaaagggtaaaaggtcagtcaaagagcaagcaccagcaagggctgagaagtgaacgaggaaattccatatcgtcgacactgatgaagacgacaacttagctccaggcgccaacccaactcagacgccgggtgctgacactacccaggtgcccaatgtaactcaagcagtgcccaagcctaagagagcggtttccaagtttaggacatcttcaaggtaaacacaactatgctctgccttttaatattccagaacattagaatccttgttgataaatgattgctaagaatctgtttgctcataatgagatcctgttaacgccaaattttggtaagattctttagtgaattcagttaaggaaaaagcacaaccagtcgacggaaacttatccaaaagagacatagtttaagaaggaaccttgaaaactttggcatgacggtttaaattctatctattaattagacaagatttagtaatttccttttatctttaggaaatgtttatttagtgtccgatcatgacttgtatctttccttttatctttaggaaatatgtgtcatgtccgatatggactagtatctacccatggtataaatatgtacaccgatggtctttgtaatctatctcttgatcaatacaactactctcgacgtatcgccaccctcttttccgaggtttttacttatcaaccggcagaacttggcacgtgacgcgtgttgcatcggctttcgatctctggcgagggggtaagtcctacgttccgccggccctggcaattgtatcggctacattggtgttgttcaaggctgtattgtttcgacctcttagattgctctagtttggttgatatatttgcctaccggtttatcatatatcttagttaatctaatttgattattcaatttacttgtatcgatctgatcttttctagggttttactggtatcggctaaattgtttgtcggtctagattagctaaggtatccactaccctgaaaatcagtcaatggcttgattgtttagattttatgattctttttatattttgcgttgcatcagccctagtcatgcttagaatcataaaaactaatatgcatgcctttcattgctaataagagtttcatcgaggttttagccgatgggttatctggacgtttcatcggcttataaggattatatacaagttagttttagctgattgcagtaaatgtttcattgattatctaattgtttgaatttagtgacatcgaaacaccagcccttaattcattaattcatttgtttatattatgcccttaaatatctgtcaccaaaataaaataatccattagtttttgcaaccttaaacggggccttagttgaaccctttttttttcctactcatctaatctaatctaaatctaaatctaaagtattaaaacctacccccggctgctcgctcctcagcgttttgcgctggcgtggacgcgggaaggaggagggatttcgcgagcgctcctgcctccgcgtcgtcgctggccattttgcaaaaaagcccttgatttacttgataatttgttgtaggtccctatcccttagttttaacgttatgcgttcttacttagaggacctctgtaaacaaaaatattctatacgaagaagagaaaaattggaaaatcgtaccgcgctctgaaaagtataagatgaggggtgtttttgtaaaatagaaaaaaaaaccctaacccccttccccaaaccctagccgccaccattcctcttcctcctctcgctccgctctctctcctgcccaagcaatggccgcccccctcattctcttcttcccgcaggtgacggcctcccccgcgcactctctgctgtcatgcccgccaccgcagagaggattttattgccatgtttaggattctattgccttcttagtccaactcggtaattttcattgggaatcatatggctttctacaacttacaccaaggtaattaaactggattgtcattgcacttgtgaagttcgtttcattgctttcttggttttattttctaccatcacattttatacatttacagttaggaaagaagtgatgactatcacttttttgtttgtttctatatttatgcaaccgtggctatcaactaaccaagttgtgatatttgatattacttttagagctgatgacctacaactgataagtacttaaagaattatgaatttatgactcaattatattgatgtccctaacttttttttaatgttcttgaattgcttctctaggaatttcatgaactcagtaactaagagctaattcacagcagttatttaaaggctctcaaattttatcatttggctgtagaatatgaatttgttccacaggaggaaatgcatggtataatctaggatgttctgcactaactaccgtggcagtgtcacgtaattatctgtcgtctattttatattgtgagcagttaaaagaaatgatcaagctagcatttgatatgattttttttcaattcaaaatttcaatacttgagcaatctaacgtgcaaaggcacactcacaaattccaaatatgagaatggaatatctgtggctttcggttcttctattttttaaggttagaatccacatataacgtaccttcaggttcttttatcgtaacaactgtctctcactctgatgctcatgcatgtatgagcatgtgagattatcaagtttttgcttttgtgaggtgtgacagaaacattcaaaggttgtgttcaagagacatatttgctgttgtgttagtttttaattgttatgggcatgcacttgtaaaggaggagagtgcagtcttgaactattgatggtcaacctctttgttttctatatatatgcccattcttgcatagaggttgaccatatatacaagtgcaaagaaaacaaattcagatacattggtacaaaagtgcaaagaaaacaaagaggttgaccatatatagaagaacatggaggaatgtgtgagaaaggtcagctatctaccaattcttgcattgattgctctaatagcaatattatatcaaatgaacaaattgcattggtttccactaaatctagggagaaaacaaattatgaagaggcatgtttattgttgacaacaagggaccaattgaaagggtcaatgcttagaataccaaaatacaagtaaaacttagcatattttgctattacaaactaatatggaatgactaactacgtttttttgtttgttccttaaatgttgcttgtgataggaaaaaagggggattttcatttttgctctgctatattagctcacttttaccagcatgcttgcttcttaaaatttggtgtacatcttcgtttatctaggtatataaatttgatcatttcatgtctacctgtgtttgctcttaagtcatgatgcaccaatagggctcaacaattcatcagtgctaattaccagagaggataatgaaataaaggtgaatgttccatcttctttgatgtttcagtactatgttcccctggatttgctcatgatttcagatttttactattgaaatttggttacgttgatcaatgatcaatataatgtgttgttgatattctgctagaggttcaatttgatttgtttgtgcatcatagatagggcaaggtacctgccaatgatttaatgtacagatttagttggaagctctataatgcatgtcaggtaacattttaaattacagtaggattgatctctgttgatgaatgttctttatttttctgtgacagatccacaatcacttatttggatgcatcacgctagcagcaaaatactatgctcaaatcagtgtcttaattataggctggctgattgggcccaggaacttggactcttcatagagctcattcaattccattacgtacattagccctcatagcatggaaaatagtcattcaatttcacacattgtaccattatacatgacaacagagcacttctttcctccctatactataaacaaaaacaaccagaaaagcaaattcttctagctgtgcattcacttttccatttctgatgccatgggtcttattccatataaagaagcatcagtacagcttgaagaccatctatccattgttgtcgcattgtatcatcaacgctaatatcatcaccgtctctgtcacaccttccaaactatacatacagaacgacagtaatacattcccttccatccaatattgcaggacaattcacctctagtatactaaaattcttaaaccgaatggattcgccgcgacctccgccagccacgtcaacctgacttttgtgaaaaagcccctcgcttttgattagttacgtgccggtccccactacatccatcgtccgatctcgcggtatggtcgatctggccgtccgattctccggacaaaccctagccggccgtcctcgctccccaccacccactcgacgccgccttgcctcaccactgctgccgggggccgcctcgtcctccgcctctccccgccgcctccacctcctccgccgccactgtgtcgtccccgtccccggctgcctccgcctccgccttcccctcgcgcagggtgcagccgtctccgcctcctccaccgccgtcgccgtcaacgtcgctgagcaccgtctccgccgcccgcgttccgccaccgtccctccgtgccgtactaagagtaggtgtatatgcctcttcctccccctcgcgctgccgcctcggcctccccgttgcgccgtcgctgtcgccgagcaggggcttcaaggcggacgcggagaaagcgaggaggtgagtgctcctctcctcttcccttctcggttctcttatgtctgcgaggaacggtgcctcgtcgccgttgtcgccgtcgtcccgctggctggcaccgccctttcccctctccccgtcgagtcatcctctccgacgcggccccttcctcctcttcatcggatggggtgaggagctcggcagcggcaacgagttcgacctcggcagaccgggcaacgacgtatttgctattattgtgcagaagaaaggggaccgatatgtatgcaaatgcagacttgcagagagagaaagagagagagccatggcgcatcgttccccctttcatttcactttacctcttgcatttttgctgcatgtctggccctcaaggcggctgctgctgcttggccggtgcgcctctttaattcgatatatcgatcgtttctttttcaatgatgccttagttttaatattttacattgtgtgtctgttaattcatcggcgatatgatctcatggccggctgcacattggctctgccagaatcgattcattcgagtattgcataagctatatatgctatggcacttcagtaagctttctgctcttgttgattactagcacacatgaaagagtcatgaactagtgttctttacttctgattaaattgatgtgatatttgtgtaggtgatgacaaaagctacaattattcagtgttgtcgttctctcctgcaggtgacgtattatgcaatttactgtttgctgtagttttacagcgccactgctcacactctgcttttgaaagcaatatgtctaatggattacataaggaaaggtctattgcatccgtcagctaacatttcttacggtgttagggcccttttagttcatatataggagtggcaaagaattttataggactcaaattccaacagatttttcttgctatgtttccctttgacttataagactatgttcctatgctttattttcataggaaaaataccaagaggtataacctctttgtaaatctatccgcggtccattcttcatggtgccaatcctcccttctcagagggtaattcttttctgattcatatggtgcgatgacttaccgtggcacgccgtgaaaagctgagattggcagatggctcattgggtgtgatgccggcatgtcggttctcaatattactggagtaagcacatatctttgtcattggccaattcgcattgcttgaactttccttggattaatttggctgttcttctggaacggtttataggtgcaaaggggtgcgagcaaggctacattggacaaggcggtgcaactatgagccgggagaatgaagatgctttcatggatatgctggtcagtcctactttgtcagctcaattaatgtgtcattcttgttcatacttgattaatgaaattgtaatttcacatggaatttcaattacatggaacatcaacctggagtttaacaaggttaggttttaatcacactccattttaatgaggttggctttttgttaggtaattgccttgcctttctacttgtgtgtactaccatcagaacgaacctgttcggcatagtattttttagcaccgcccaaaaaaactttaagattgtttcaataatttatctacataatatcaagataaatgggcatagtttatgaacctttgaattttgctcctgttccatactaagaagcaaagaaaaatgaaatcatcaaattcaatagatacccagtggagtatgggtatctatttctgaggtttaatgtttttgtttttatttttcccctcaccatcaaaccattttcttatgtttgtgtttatatttaaagcttctagatcccattgaaaatcgttataaaaatgaggaggtcagagctcaagccacgagggatctttctaagtgcattgttgaccacaggatggctgccaaatcattacccacgcctgagcaatatgctgtaagttctgtaaccatcacccttcttttttgtgcactctaattaagtacatctatatgtgctccataaatttcagcacacaaataatgcatcataaacatgtctgatattgttgtatgaccttttgcatcataaacatgtttgataggactttttgcatcataaacatgtttgatattgttatatgtggatatggtgagatgtagaactgtggattttagagcagaaacagttcatggttttaaaatgcactttaatagatgcatattcaaagtattaaatgtgtaccaacttttactttttgtatttgtcttgtgtaaagcatcatacattcatattacaacaatgctgtggctgacttgttattctgacaatcggtttctgttcaggttgaaagggagtgcactaaagccgaacaatggctatgggagaggtcacaactccaggagtccctgcccaagaatgttgatcctgccctttggtcccatgaaatcaacaaaaaaaaaacacgagttggacatgtaattagttctttcctccctgggaccatttttcaactgacttgtgcaaaatcagttacagtttacatcccatattatcttagtacatttgcttgattccacttgcaggttttgtagaaacattgcaaggcacaagggttctccagcaagagcggattctagcggggtttcagatcacatgcataaaacagatagaggctagacatttctaggatttcgtaactgaacagcgttgtcaagcctgacattttgtagcaatatacagatgagcgagtttctgctgacagtcttatacgatccgactctgtaccacagtcagcccgccatcgggtgcctgcatcttgataatcccagaggtgcggttttcacttgaaaaccctactactaatcatgattgttgatgcttgtgtattcttttactgtaatcgactcaagggctcaaggctgttgtctgcattttttcttgtgatgaacaaagaatggaagacgccattgataacttccaatggtcacaagagttgaagctttggggtttcattttgcgctgatcccagaaagctgccctggatagtctgtatgatataccggagatttgtatctactatgtgccattgaccatatattgcacgcacgcagcgtagcgcgtgtatctttctagtgtatcttttcttaaggtgccccacttcaccacatgtacgatgacacattcgtttgaagcaactttagacttgtttttttaataaaagagaaacattatactatgttttagaaaaaacgaaacactatactaattttaacaaatggttgtatttggcaccactaattcaatataagtaattaggtaaaacgaaaatgcttacagaaatgaaaataaccgatagtagttgttaatgtaacagtaataatgtagggcctgttcactttgctgtcattttcaaccttactaaattttggtaaagttaccaaaaaagtggctacatttagtttgctaccaaattttggtaactatataagaaatcatgtcaaaattttgacaagtttgccaaaattttgacaactatactaaaatttggcaatgccaaaatttggtaaagttttttttggcatcaaagtgaacaggcccgtagtgtaaccgtgggccaaaatcatgaccctagaaatatggtacttgcagttttcctcccaaaacctaatttaattaaaaccctaaacatagaaattggggaaaagatcaatgatcaaaaattgattccctaagacgcaatttaatcatgtgatcacgtagattgaaagaaatctagaataatcaaagcaaattagaaggaagcactaacttgccggtctcgatgactggagaggcggtcgcgagcgcggcggcagcctcggccatggcgaggcttcctgcagacttcgaggaagtagagccaaggcaggtcggtcagttttgcatcgttattttgttcatgggccacatttgttctgggcctgaccatgttgggccaaagggggtgcacccattgtaaaaacatgatggcttagcattggaattctttaggacccgggtgcctgtccacctccctgggcctactggccttcgccctttatcacgatgcgaacagcctgttgctgaattactttttttagtcttaaatgaaaaagcacaattgcttttgtttttcttttgatcggaaaggctgttgctctagtgttttttttcattttttttggtaaaaaaggttctagcagtctagcgctagccggaaacagcacataggatgggcggtactctattctagcactaggagttaggtccttttttaagctagtttactcaattattgacgtgcattacttgctccatgcttttaaaaatatatatatttttactatattgcttagactacttattctaaactatttttgaagtttatttcttaaaatatgaatttattatgttaataagataatatgtgtcaataattcagagaattatctgtttcagggtcttgaaatttgttctccttaggaagagaaaatttgaaatacacagcagatatgatgggctcagacagatgacaagctaattaatttgaccaatttatatctcggtacctgtaacatcctgaaaattcgaccgacaaaaatctaaactctgaaaatgtgggccttcaaaaactttttaaataaatcgcatcatgccgattttattcgcttatttcattagattttaatttcggtgttcaccggacgcgaataaggaattattatttaggataaatcctaaaattaaatggcaacacagataaattagaatataatttaaaataaagatttgttgataatagaaataaataaaatattatcgcaaccatatttgtatcaattaaatttaaatacgatggaataagaattaaccctaattaaaaattcaaataaattatataaaaataaaaaaaatgggtaatattaattttgagtgaatccattagttggaataacacaaatgttgagtaaaattcatggatgcaaagattaggaattatagaatcaaatttatacgggaaataaactaaaatcggaataaataagaaaatgcactgttcatcatggcgaaggtgttcgatcgcgtccctagccctaacacctcccttgccgcccgcgcgccgctcgcccgccgcgccgccgtcatcatcgtcgccgtcgcgtcgccgtcggcctcgcgccccgtgccgccgcctcgagccccgtgccgccgcctcgcgccccgtgccgccgcctcgagccccgtgccgccgcctcgcgccccgcgccgccgctgccacgctgtcgccgcgccgcgcgcccgcctgccgccgcgctcccgtcccgtcgccgcgccatcgtcctgtcgccatcgccgcctcgcgccccgcgctcgcgcgtcgcgtcgccgcgtcgagccccgcgccacctgtcgcattgccgctccgagccccacgccgccatcgcgtcgccgcccgcgcgt

SEQ ID NO: 26651 - DNA, 18584 bp, Oryza sativa
accccccctctctccattctcccccaccccatctcacccttcctcccctctcccctctccaatgcgccgccgttcccgtgccgccgcgtcgccgttcccgcgccgccgtgccgccgttcccgtgccgccgcttctgtgccgccgtgcgccaccgtcgccaccgccgtcgtcgccgctaccgctgccggtgtgccgccctccttcccccttgcgtccaccgccgacgccgctcgggtaggagggagagccgagagagagagggagaagaaaagagaagaggaagagagagaaagagagaaaagaaagaaaaagagaaagagagaaaagaaagaaaaagaaaagaaaagaaaagagaaaagggagaaaaaggaaaaagaaaaataaatagaaaatttggaagaaattagggaggttaatagtttagaaaatttaaaataattagaatttaattatagattaattatggtcgtagaattgcaaaatttaattattcttggtaatttctaaaagaaatcaattcgcggtagtaatttagatgtaattaacaactagatgaatctttatggactattatagattatttttggataatctctataagtaatcgattgaaggtagaaatttggatttaatcgctaggaattttagacgtatattatatttaatcatttagtcatagactaaattaaatcgtataatattataagataattttaggattccgtccgatatttagctcgcgatagaaatttctaacctattatatggatataatgttcgggtagattaaattaaaaaaaaacttatgataacaaaatatttatactcgcaaaatagtttaggatatttaaaatcgaaattggtttgccctagtttgtgaatagtaaagttaatataaaagaatcaactttcgcattcgacttccatttggatttatttggatttttatttgaattctaactgaattcaaatcgtttcttcgcacgtaattttagagcccgagggagttgcggatccaagcgaggaccaagacccgcaagactttgagcaaggcaagtcatcactattctttgaacatgttgaacccaattgcgaaattgttttgcttacaaataaaattgcatgcaatgatgaacatcctacttgtgattatgtcatgccttgattattgtttacccttattccttcgtaaccatgtttacgtatgagtccctagtcgattataacaattgcttagaaatgctactctagatttatgcatactcatatttatcaaatgctatatacttgggcaattacctttgggaaggtaattgagatgcggcatgtggagacatgagcgccacattgccatgatattggtgacatgatttgtgaaaggagaaataaactaaacaactgttttcgactggggcggacggaggatttggatggtatctggaaaaggctagtaccgtccccggtcaattaaggaccgagccatgaagctaagtatgaaacgacccccgtacaaccgcgcttctcgtatgggtatagacctagcggagtaaatagccgagcggagacagtatccctgcatagatggttcacccctgagtgaggcaggtgcgctacggtgggacattcgttgaggtagggccgagaggtgtgccctacatcggtgtcgccattggtaggactgccatgagtgtgtgtgagagagaacttaacttgaactataatttaatatgtgtgtgagacttctccttcctaggagcgccagaactcctctcactgctagaaacatggacacctagagtgcatgaggatttaagttcatggagcggatactgccaatgcgaggttatcaaaaagctttgccgtgacgcgtctcatgtgttgggacgaggcacatgtgttgggcagttgcggagtgcgggtaaagtgtacatccactgcagtgtgagtaaaccaaatctattcgaatagccgtgctcgcggttattgagcaccgggacatgtattacacttggctagattctagattcttaacttgtgtgggatgggatattgcatgatgatttttatgctgttggagccacttcctgagaggcgggaaggtggatgccctcagaaaaccatgacaactcaatggcgggaagctatccttgggatcacaatggatggtggacagaaccgtcattgtttaatatgaacactggtactaaattttgatcagtctatgctaggtcttaggcttgcgaaaagaattacaaaacttgctttgcgcaaaagaaccatagccattccttgaaatactcctatcatgtgcattgttgctgtggtggcttgctgagtacggttggtactcacccttgcaactataaacttaatcagaggccggggatgaagcttcggaggacccctatgcctactaccaggagggtgatgaagacgacggcgctcaataggtcttagtacggtcgttgcctgtggaaatggcgtgccgctgccttaactccgctgccttaccttcttctgtttttgggatgtattccagaccactcggtccgatgatttaagactatgcctgcgggcttatgatgtaataattcgtactcgtgtatgtgcacttggtacttcagctatggattcgtgtgtaccagactacttgatccagggaaatggtacggtttacacgattgattcctgttataaaaacgggggtccacagtaccagctagctatataaaaagaaaacgataaaatgtagactttggctgattaaaagttgactcatatactccctccattctagaatataaggcataaccactcttaacccaaagatcaagaaatatttattattaccttctcatttgaatcactctaataaatacaatgtatgcatctaacagaattagaaatattgagagttgaggatttaaataataatttagtggaaaggaggtgctagttaattgtttgcttgcatgcatgtcttatattatgaaacatcgaaaaaatagttgtgcattatattttgtaacgatggagtatatagctagtttaataacagagctaactttaaaattacttcctatgttttaaattataagcacttcttgcgtttaaaatttgttcacaagtaaggatctttagagcactatatttcccccaccaaccattatcgcatttaattttcacccaattttacctccatccattcacaaaagcttgacgctttcgcctttgttctacgtacaaatgcatgtgttaaatactgtaggaatggtcactttgccctaattaatctttatttattctagtcccaaccacccatctcggtagtacatggagaatatttttagcttagctcgtggcaaccagctgggtccttaatcgagcagcttttttccggaggacttttaaagtaaattctacttgaagtatattcttgcagtatatgaaagggtagatttggtatttgttaaaaaatcttaaaatggttatttagtcatttttaattgagatttttttccatggagattttttttctatcggtggtatttttccgatctcgtcgttcgttcatgataccaatccagtctactttgtacgcaagtctactttgtacgcagtacgccgggtcaccggcagccgccttcacgttgtctcgcatgtggctcccacaagcgccgcccagccgctgccgtacgcaacgacgctgtcgccgccgccggagctggaagcgacacagcctccgccgggagcgaagccacagtactgccattgtcgtgcgcagcactatcgccgccgtcgggctcggcagcagctgtctgcttccaggaacttgcttccgtcaatctctagcgataactattaatttgtgatttgtgcattacttatagtctatcgccgcagacgggcttccctgccctgctgctgccgcatgccgccctgctgcttccacctgccgtcgcccggctgcccttgccgctgcgagctgccgcaactgcgcgcctatcaaccggatcttactaagtgcaaaatttgaatttacaaaattaccccccacgcaaatacatgaaaaagacaaatatgccctatttaatttatagggcagaataatttagaggaagatcagattaatttgcaccgttagattaaatatactggtagtatatatttacagtaaaaatgtaccgtaaaaattctctttttctatatctctaatgcataacagagctgcgtccgcttgtagcaattaacactttttgtgactaggtgccatgtgagacagcccgctgcttccacgagtagacagcaagttgggatgcgccggaaccaggctcaattcttttgttttttctttgaccgcaaaggcttttgctctagtgctttttgggggccgggttttgaagagaaatagcgttttattgaaagtacaaacactagccgtcatctttcacaagtatgactcagcaggctgtagagaaatccatatcaatgtttctgcttttcaagggccacgtgactcggtggaacatgtatagcatcctaaaacggtttgggtgtcaatctgctgtcaggttcaccaaactgttttgaatggtgttatcgttcttttatgctaaggcagtggctcttcggtggcttggccgatatccactgttggatgtcggagctgcttttcgctctggcgattttcgttgcttcagtgtcgctgcggttgtgaaatcggcgctgctgggtcgcttggacggctagctcggcaacgataacacctcttctgcgatgttgaagctgttgtgtcgcttttgtgtttagcttggcagcgatgtcctgcgtttgggctccgtcgttgttgttagttgtgtagctagctcccttgctttttactgtgtggtgggtttcagccggtttcccgtaattaaccatgcaattgtatggttttcaggtccgattttccttataaactgagctaattctcttcttctaaatataaaagtgaaacaaagttccaccttaggtttttttaaaaaaaacagacctttccaaaattgagaacaactctctttgttgaattggaaaacacctccctcctgtaggtatttccttctcagaagttccacacataaactctcatctgaagatctaatttcatcagccattttgcaagaagggcagaattcagcatccttgtttctgttaaaccaacaccaccaaacactttaggacatggcaaatctggccatttcaccatgtgatactttatttccatcacacggcgtgtttaaaaacgagaggattcgagctacggttgtctagcctaccaaccataatgtcaggtaagaaattcatcacgtatacttttttcctaacagttattactactatgaacttatatgctttagtcttttagggttttaagggttataaataagaaccaagtgttcattagtattaggggttgctttagaagttgtgtaacttaatcaagtggcgggacatcatggggccaaaggccttctcatttcaaggatgtcttaaagtagcactacgaaaaaaaatcgagttatcttaaaaacacaaaaatactgattgaatatcattgttccatgataaagattgttaaaaaatgtcatccttttcttatcacctggttcagcaaatttagtaaaaaagttgcctatattacatgtgagaccctttgtagtttgcagatacttagtttagtgcctaacactgaagacgcgtcaacattaaattgcaaaaaagaactaaacccatgttatatggttccatcactgaaaatggaatacctaagatagcaagggtgcatgtgttaaaaaagagggacaccatactaatccactgcaagaaaaaaaggtttattatattcatagattgaataacaaaaatatcgaacttatatgatatgacgaaacgattaatgaaaacaattacaagacatatataacagaatagcttcacctttttcagccaaacaaggaaaaagggagatcattttagccaatgcctaagcaatgaaaaaaaagaaccacgctaaaccaataagcaaaataaacaaatttccgcttgcatgttgcattgtgttgcaatcaacacttaggcatggacacttgtgttgcacaatatatgctatcattttccatgaactatggtcattagcacttgggcatgtttggaggacgaggcagcatctgagcctgtggcgtcttgccatccttcacgatgaacacagtattcattccccacaccatgtgtcgatcaaaatggcaatgcatgaaccacacacctgaacaatcaaaataaacatgaaaaaaaattttaatttaaaaaaagaaaactggacatgaactctttgatacaagcataataatagcataattcacagaaaccaaaagaggaatcatcagaaaaaaagttacctggattgtctgcgcggaagcggattgcggcccagccggccttgggcacggagactgtgctctggtacggcgggtcgagcaggttgtaggtggccgggtccctgcggtcgtcgaacttaccggaccctagtcccacgacgtagaaggcgaagccgtggaggtgcattgggtggctctcgaaggacgtgtcctggaacaccacctccaccacggtgccgtactccagcaccttcaccttggcgccgtgcttcgtcaccccgggcctgtcgttgtcgccggtgaggttgacgaagacgggcgccgggttgttagggaagtcgtcctcgtacacgccgcggccgctgccgtagtagtacgcgtgaaggacgtcgatggccgggctgacgaagctgacgttgttgaggctcgccgcgaaacgcgtagtgttgcccttgggtcccttgcacgccgtgtcggttgcgttggtggcgttgcaggggagaaagttgatggcgaggtcgatgagcatgtgctcgtcgacgtgcgtcggtacgtggaccgggtggtccttgctgccaagggacctgagctgcctgaggaatgccatcgccgcgtccacgtcgtcgagagacggcaggacggcggggaagtccggtggcccggcaccgctgtcgccggtgtagtactccacgacggccgtggcggtgctgttgttgaaggggatggggacgggtaacgtgataaacgtcctcgcggccatgtagtacctgctgttggacttggaccccaagctgcggttggcctccaggagaaggtccatggtctggcccggcgcgatcatgatgtattcgacggtgagcggcttggtgtagcgggcgtcgatgccgacaacggtgaggcggtgcccggagacggcgaagaacatgtcgttggtgagccccgcgttgatgacctggagcaggtacgtgttgccgtgctccacggcaaccttgaaggtgtcgtccctggagcaggggaacatgtccccgggctggccgttgattgtgttcgcgtcagacggcttgacgtcttccccaatgcgcttcatctcctcgagcaggtggttcacatcgtttttccaccactcacctgcaaaacccatagaaataattagttcagatcaaacggttatacgatcgatatatacatgcatcaaacaagctaattaagattccgttaattaatggtcgtcgcgaatgcgtacgtaccgaggatgatgggtatctctttgtctggcctcttgaaggggaaggtgtcgccgtgcttggggtggacgacgatggcgccgaggacggtggcgcggtcgaagtcgctgtgcgcgtgccaccacagcgtgccctcctcctcggacatgatcacctggtaggtgaacttgccgtccggccggatcgggcattgcgtgatgaactccggcccgtccgaccatgggttccgcggctggtccacgccgtgcctgcgctacgtacggttaattgttagtcatcgatcgcgaacattgcattgtaagtttcgacatatggatcgatcatggcgtttcgctgtagcaactggcaagtggcaacaacgaagaacatgatttaccagtggatggtgatgtttttgttgccgtggttgtagacgttgacgatgacgagatcgcccttgcgcgcgtagatggtcggcccggggaactgcccgttcacggtgaggacgctcttctcgtggcagagcctcctgtagttggtctccgtaatctgcagagcatcatacatggttaaaggtcatttcgtgcattattcatgccctatccgatccatcagaccatcacactactgtcactgtggatcagtgaagtagtacatcacttacaaagaaatcgtagtggcggcgagtcctgccgccgtgagccgggctaattgcaactgcaaatgttaacaccgcacatgctaataaccagagcactgcaggtattttggcaatacccatcgccggacgcacgatattcgaaccaattttagtgtaagaaaacagggctaactgagaaaattgtacgtgagtatgtatggttttctgtgtaagcacatcgtctgtaattactcaacagtggctagctaagcagctgctttgcctgagaggatgagatggccatctgatcaaacagaatgaatgtatttataggaaatggcagcgcgtgcctgtaatcaacgtcagactatttcattcaaatgattagccagcttggaaaataaaaaaattcttccacgtttcacgcatgtattcttctacagcagtggcacgactactaacgaaaagttttttctcaaactggcgttagttggttgtctgcgcgctcgtgtcgtatatatgcatgcgtatatgctactgtcacgccgcggccactgacgacatcttcagaagtttcctgccactagtgcttttacggtacccactactgttagtggtagcagtgtagtacaactttaatccaaccgttgaatctattaacttaactagcatggtggtccatacaaattacgcgactagcattattatattttctctcatataatagcatatatgttttcttaatgtattattcaaatatattaaaatgacaacataattttaaatttcatactaattttacgaaactactaatgtgtaatatttatattgtattttatatacgtgttagttattaattatttttaatatcaaatttaagttatttgtaaattatattcttatatggactatagactcgtctttgaatatttctttttttaatttcgtattttcgttatctgggtatttctatataaactctaggctcttcttccaatattatttatttttaattctgaatttttattatttctattttctatgtggactctaacactagtacataaagtataaagtgttatataaagtgttataggtgccggttcggaaagcctaataggtgccggtttcggtgctggcaccaattagtcggcactaatgattttacattggtgctggttcccaaaccggcacctgtttggcacctatgtgttttataggtgccggtttcgatgaaaaaccgatacctataatggtccaagggctgcgctcgcacgcctataggtgacgattctatgtttatagccggcacctattataccacataggtgcctgttaatggcaataaccggcacccataatcatgtaacccaaaaaaaaatatagccggttctcagtatgtccattcacatcaatccaccgtacacacaaaaacccacttcaattcacagaatatatgtaatccatctccaaacatcaattcacagattcacatcaccccaaatccaaaaatttccaaacatacacacataaatgcaatccatctccacacattcaagttatcatacatcaattccatctccaaatgtttacatcaattccatactttcaaacaaaggcaatacaaagttaacttgagagaaattaagttgaaataataaagcaaggcatcaccttgttaatcttgtttccatgtccaacactgggtgcacaagttttctcccttccagaatcatgattcttggaatttatatgactgaatgagagagagagagtgagagaaatataaatttgctaaaaacagaattgatgataagtcatgctaaaataactgacataaattgcatctggtattgaagggaaacttcaaatggtataaatttgctgatgaaccttaccatttaaaaatgttccttttgttatctaattggaataatgacccctataaggttttaagggtgattttcagtttaaagcagttttgagcaaaggttcagcacttgagtttgacaagtacaaaatgagtttgacaagtatattgtgcatagggcctatgggcataacgaaatttcagatttcagattgcatcaacagataaaaatcagattgcatcaaaacttataggcctcatttctgcatgtaaatttctgcacaatgaactcacagcactagcggaggcaaactagcggaggcagtgaagtgttcttgttttacccagttcataatagctctagtttcaggttgtctgtagttaattccatcattgatggggaaaaactgccagcattaacaatttaattgaatggctcaagtaggtaaagaacaaaaggaaatattccataagaagaaaataatgcatcactgacttggtcaggaaaatctccgttgaggtcaacattgtttgcattaccacgtcttctaagagcaaatccatcagggttcatcgttggaagtatatgaagatgcatgttttccataataagagttgcctacagatattagttgaactggtaagtttttgagcttatcatatatttctatcgatttcagtaaaaccaatggaaatatatatcataaaaccatagttgagccagacaaacataaaatttaagagcagataacaatggcctaataatttttatacacaaaagcctaataattgtgttgtataacaccgagtggttgtacggtatatacacatcacatattcacacaaaattgagcttaagttcatagcttcatagaattgataacacaaaaaagccttcaaatcaatggcatcccccttttcttcttcattttcagaactgaaaatttaatagccgactgtactactattttcagaaatcaagtcattgcactggtgcacaagctcctaaaatcctggtacatacacactaagcgtctaaaccattgcacaagcactgaagcacaacttcctactttcctaaatggttaaatcctaagtgtgaaactatgaataactcaataatgctagaataaaaaatttaagtaaaattcacttacttttgcttgagatgtttgagaagccagagcaggcaaccagcagcaacggagctcgctcaatcccagtcatcctcgctggccgtccccctaccctgtcgccgccaactaaactgtatactagataaatcagtgagtttcagttcccaaatcccaatcagtgaattttagtactcaaatcttcaatactcaaactcaatactcaggctactcacctgtgtggctgtgacgatgtgttcaggggcgatgtgcggctccggccgtgccgctgtggccctggtcggcggctcggcgctcgctaccctgcgcccctgcccgcgccggtgcgccctcgcccctgggccctagcggctggcgccaagccgtggcacgccacccgccacccgctgcctgcccacctcgctggcgccaagccgtggcacaccgggcggccggatctggcagaggggaggtcgcggccgccgccgcctccgcctccgccgtggccaaccccgtggccgccgctgcgaggcctccgccggccagccatgggagcccgtggtcggcggctgccgccgtggtcgctgctgccgcctccgccgcgggatcccgccgcctcccctcccgccggatctggcggaggggagggcgcggtcgccgctgccgcctccgccgcgggagcccaccgcctcccctcccgccggatctggcggaggggagggcgcggccgctgctgccgcctccgctggccagccgccgaccgcgagacggcgggagaggggagggagagagaggacagcgagagagagagagagagcagagttagagagacgcgagagatcgagaaggggagggatagataaggacgcgatgggtgccgtgcgtgggctcggctcgaatcggctcggccaaacgctataggtgccggtttttaaaaacaaccggcccctataaaaattattaggtgccggttcttttaaaaaaccagcatctatattataggtgccggttcaaatgttcttaaaggtgccggttctacattttttcaccgcaaggaggtaggaaaagctctataggtgccggttttaaatgaaccggcacctatgaaccggtctctatgagagttttttagtagtgtaaactcatctttcaatattttttaatttttaattttgaatttcagttacttctaaattgtattcctatattgactttagactcttcttcccatttttttaattttgaattttagttatttgtaaattgtatttttatacgaactctgaactctagttttaattttattatgtttatttcgaattttacttagttttaaattcctatatggactctatactctacttctaacattccttatttttaattctgaatttctactatttcttaattgtatttctatatggactctatactctacttctaatattccttatttttaatttcgaatttctattatttcttaattgtatttctatttggactctagtctcctctttcaatatttcttatttttaattccgaatttcagctatttttaaattgaatttctatatggatctgtttttctttttcttcaattaatatgagaatttctagtaacataatataaatccttctttgattcaaatatttatgccttatagacaatcctccgaagaaacagtaccaaaagtgatggaagtagataagagtacacaaggaacaagggaggaacaaagaaatgcggcatcgtaacccaggaagtcaggtaatggcaacatcaaactttcctacaactttcctacgtaaattttatcttaatatactctgctattggcaattatatatatatccttaaaaaattttcataaattgcaggaatttgtgtttacatcaatagttacgattgatcgagtacaagaaaatattcaatggtggtacatgtcgtgcaatctttgtaataaaatagttattcagaaaaacgacaaataccattgcaggaactgcaataaatatccagaaaatacaacgcctaggtaagaatacttcatcttttgtaaataacaatacttatgtaataattttttttgcattaaccataatttcatattaggtaccgactacgactccaaataagtgatcatacgacatctacaagctgcactatatttgatgatgtggcacaaagcatgctagagacacctgtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaagacatttgtgcctgattatatgcttgagaagcaatacctcattaataaggctgaagaggtaaagcaggctactactgattttttacaacacaaaatcttgaaaattttatttctgaaatgtttccgcattatgattttacaggagttaatggacgacgatgtggataacatactaaaacaagatagagagacaaatcaacaggtatttgaacatataatacaaattttcatttatttataatatatagcacatatgacaaatacttcattgcctttgcaggaacaaaccagcagcggccctcttattaaaaacagatccatctcactgctacccgtgaagcaagagctagaggatagtgaccaggaaatcacgagtgaagatgaactcacttcgtctgacaaacctcccagttgcaaacaaataagacggaggtcatacataatagaagacgattcagaagaggagagcaatgaaacaagtatgataaaatgcgtagatgcaaaagttcgaggcaaaaatgcaaaaggcgctcatgcaaaatccacaaaggcggaaatcagaaatgacacctacagccatgaaataaacaaatcagttgttgaagaatccatcaaggcaggaaaaagataggctaaaaccatcaatggcataggcaaggaaagctctgttgaaaaacgtcagaaaacatgtgttcaatcagacaataaagcatgcaacacaaggcctcagagaacaaggaaaatgaattctaagtatacaaatagtgcttagagctcatgataatagttcataattagcagtagctcgatagaatatcctacagttaatgatactagctagaaagaatagttcatagtcaatacagatcattacatgtactgtattataatagtcgaatgttgtatatgcataaactgagatatattactatgcaatctgttattttatttatgattttttatcacatctctgtatatacagacctaattttgcaaccgattgcacatgaagcatccaaacatataattcatgcaaaggaattgaaaagaaaaacagcgtcaaccaacctttgcctgcccgccgattcccccaggctcgccaccctggccgatccgtgacccaaccactgcaccgcctccaccttacattttgctggatgccgaaatgagacccaaaatagcagattttgttatgaccaaaatttttggtgaaaaccagcaaaaggcgaatactaaaaaatccgaggacatgcagtacaagagaagaataatcttaaactttccaacgctgcggttaacagattcacagaagaaagcatatgccttgatcgaaatagagaaactaatgagacaagcaggaaaatcgctaagggactacccagacatagagctaccaaatgctgccgagatagaggaacttggtaacagacttataaacgaagagcttaactatgacaaagaccaactgaaggatgagcacctcgccatattaaacagccttaacacagatcagaaaaaagccttcgatgcgataatggaatctatcaacggagggcaaggaaagcaaatatttgtggaaggctatggcgggacagggaaaacatacctatggaaagcactcacgacaaaactaagatccgaggggaagatagtccttgcagttgcttcatgtggtattgcagcacttctactccaaggtgggagaacggcacactcaagatttcgcattccaataaagatcacggaagagtcaacatgcgaaataaagcaaggaacccatttggccgaactactaaaaaggacatcactgatactatgggatgaggctccgatggcaaacaagcattgctttgaagcattggacaaaagcctaagagatataatgaggttcactaatgaaaacagcagtgaaaggccatttggcggcatgacagttgtattgggcggggactttagacagatccttccggtgattccaaagggaaggagagagaatatagtgaatgcatcaatcaaacgctcatacctctggaatcactttgaaattatcaaactaacagaaaacatgcgactaagctgcatgtccaatgaaccgctagagaagcaaaaggtcgctgaattcgctaagtggattctacatatcggtgacggagcatcagcatcagatgaaggagaggaatgggtaaaaatcccaagtgatatcctactacaaaaaggacaagacccaaaagaaacaatcgtcaaaagcatttatccaaacttgctggacaactaccgtgaaagagaatttctagaggaaagagctatcctatgcccaagaaacgaaacagtccaggaaattaatgagtacataatgaaccaaatacaacgagaagaaatgacatacctaagctgtgacaccgtttgcaaagcgatgacaaacaacagtagcatggagcacatgtatcctaccgagttcctcaacacgttgaaattccctggaataccaaaccacgaacttaagcttaaagtaggcctgcctgtcatgctacttcgtaacatcaaccaaactgcaggcctatgcaacggcacgagaatgacaatcacacagttaggtaagaaatacatcgaagcacagatcataacaggtacacatgtggacgacaaggtatacatacaatcatcatgtcaccgagcgacaccaactggccatttgtcctgaaaagaagacaacatcctctattagtttgcttcgcaatgaccataaataaaagccaaggccagtccctgaacaaggttggtttatatctacctaaacaagtcttctgccatgggggcctgtttggggagctttagattccgagaagcagctgtttggtagccagcttttgagaatctggaaaagctctgaaacccagcttctggcttcttagttcatttttcagaatctataactgcagattctcagaagctgtggactgtttgaggcagcttctagcagaagcagcttttgggaaaagctgcagctgggagaagctcccccaaacagggcggtagcattctctagagtcacaaaccgaaatggcctgaaggttctgattgatgattcagattgtcccgaagaaaatgtcgctagaaacattgtatacaaggagattttctaattgacttaatatttttaaggtttactgcaagcagaaacggtgagctcgaaagacagtctatgtaaaaagtcctctgacatatacccacagtatttaaaatcctctaattgtaccagtgttattcaagtttatagatgcacaaatgttattcaataagacccatttgataagaaagtcctctcaaacgtatatcgagcttaagatagggtgctggtaggttcacattatctaatatcaatttatttaaggaaatgttctatttgtcttgatactgttctgaaatagtatatttttaatatccatatatatctactaatctaataaaaattcatctcagtcaaccaataaaaatatttgaagcataaaaaatcaattagcaaaaatctcaaatagccatatatcttcaaatgtttcccccagcaaagattgagaagataaacttcttgatgtaaaatatttttgatggagtgcgtcaaagagcagtacacttttccttcaataaaagagacaaatgaatcaatcctaatgatatccccaacggaagactgccagcttcacactgctaatcaaatcaaacagccaacaagcaagaagagaactttatattttgcataagagacaaaaacgaatgatatgcatgaatattcctatttacctgaaaccatgagccactgctccaatcatggacagcaaacgagatgcttcgtcaaaggacccttgctgtgccgaaggtcctccgataccgacgacggttcgtcgcacatcaatatccccagtgccgcacacctccgatccatgagcaaacggatctgaccccagggagcccttcaaggtttccccacaataagctggaagggaagtacaccgaggcgactcaggtgaccggcggcgacgcaggaaggagagagggaaaaggaaaatttcaggaagcaagcaagtggggaaaagatgagataagagagtgaggggaaaaattcaggaagaaggaagtggggaaaagaagatgggagctgctttaaaccattcaattctgcgatgctctactaataataaatacgaatataacaaaaaaatctcaaattagaaaaagcacaccacttcggacaccacacaacacaagtgcacacatgtcagggtactgacatgtgaaattagttgagattaataatttaattctatacagcatttatatatagatggagttaagatatctgtaacactgtttttaacgacattgccttatctcacacgtggataattgataatataaaaaaaatacatgtacaaatatattttttaaaaaaactacatgtgcaattggtttttttaatccacatttaatgctgcatgcatgttgacggagcgtggggctcctcaccgggagaccgcgctggcccccctttgccggttcggccggggaccctgggtgaaactctaagctcccaatctgtatgtggaaggttcgcgagacaggaagcacagaagacaccggcgatgtatacaggttcgggccgctgagaagcgtaataccctactcctgtgttttgggagatctgtgtatgaaagagctacaaagtatgagccagcctctcctttgttctcggttcctaatctggaaaggtccagtctaagaaaaagctccccaaaatctatctccctcctcagtgggcaaggtcctccttttatatcttaaggggataccgcatgcaccattctccccctctccctggggacttactctaccttttcataaatggacggagatttgcatggttgccgtccgagtcaccttctgatgggacggcccacaac

SEQ ID NO: 26652 - DNA, 11790 bp, Oryza sativa
gggggggactaagaggagggcgaacacatcaccctcgggcccgacgtcccccgaaggtgccaggccacgtggacgattgtgtctgcctcaaacctctagtcatgatactcccgatcccatgtcaccgacagtagcccccggcgttatgccagggcgattgccctccttaagggaagcggtcgggcgtgacgccactcctaaggcctggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaatgtcgcttcggttggcgagcgtaattaacgcgcgcacgatatgatctacctcgactgccacaaccgcatatccacctcatgcgccgcaagcgggtgaatgggattagtgcaagcgtgggcgcgagaaacgagggggcgaaatagtgggcgcgagaagcgaggagccgggcacagcgttggcaagggtataaaggcactgaggaagggatttgtttccttcccttcgccattattccccttgtcttcgccgcttgtgccctaactccttctttcctgcgccctaccttcgccactcgcgctcgctcttaatcttctcttccttccggcgccatggcacggggctccgctctgctcgatggtagcgtgctgccgccctcccgcatcgtgagcgagaggcaggctgggctgccgcgccgcttcatgccggaatctgccaccggccgggagatagttacgctgggcgagggacgcccggcgccagactacccggggcggtccgtcttctttctcccctttgcaatggcagggctggttctgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggcggctgctacttccagccacgggggccggcgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacagggaccatggtgtatggcgactacctccgccgtcggattgcgccgctccagcggcgcgctcggggcgcctgggagtacaccgggtccgaagacttcatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgatggcggtcggggcctcagaggagcgagctccaaagggccacgacggcgcaggcgggagccgccggggggaacaatctaccccgagagggggtcgtgcttctgggtcccgtggcaggggcccggggagcagccgccctaccgacgcccgggggaagaggaagcagggaggaacacctcccccatctcctccccgagggggcggggcggcgcgtgccagcagcaagcgcccagagggggccgcgccagcatcgcagcccgagggggagcgcaagaagaagcggccccgcaagatggaggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgtcgcgtccctcccgccattccaagtccggccagtctgaggccgaggatccggcggccgcagaggcccgtaggcgggaagctgaccggcgcgaggccgcggatcgcctacgggaagccgaggaggccgcccaagaggccgcccgggctcgccaggccaaggaaatcgctcgggagggagccgcccgggcccgccaggccgaggaaactgctcgggaggaggccgcccgagcccaccaggccgaggaagctgctcgggaggaagccggatttcgccaggacgagacgatggcgacttccgaggcagcccgcgacgaggccgcgggcgcgtcgctcgggcccactccctcgggcgacgctcaggcgacaactcccggggcagctggcgacgaggctgcgggcgcgtcgcttgggcccactccctcgggcgacgctcaggaccaaacgggtccgggagacatccccgagtccggcacttccatcggcgggccgagccgcgtggcatcttctccgaggcggcttttccccacgccttctgctgccctactgagcgcagagccccttctgcaagccttggccgccgcaaacaccacggtgttggacgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcatgtctcggagcttgaaacccgcaagaaggtgctggcggagatcgccaaggaagtggaggaggagcggggggctgccctcatcgccaccaccgtgatgaatgaggcgcaggacaccctccgccttcaatacgggagctgggaggcggagctaaggaagaagctcgacgccgcccagggggtgcttgacgctgccgctgcccgagaacagcgggcggcggagaccgaagcgacgtcccggcggcgcgaagaggcccttgaggggcgtgccatggcgctggaagagcgcgcctgcgtcgtggagagggatctggcggaccgcgaggccgccgttaccatccgggaagcaacgctggcggcgcacgaggctgcctgcgccgaagaagagctcgcgctccgcctccgcgaggacgcgctcaccgagcgggagcgagctctcgagggagccgaggccgcggcgcaacagctggcggacagcctgtccctccgcgaggcagcgcaggaggagcaggcgcgccgcaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagatgccgaacacaccatcgccgttctgcagggcgcgctggactcgtccgccggggaggtcgaagccctccgcttggcaggcgaggtcgggcccggcatgctttgggacgccgtctcccgcctagatcgcgccggtcggcaagtgggcctctggagagggcggaccgtaaagtacgccgacaaccagggaggcctcgcccagcacctctcgaagatggccggggctctccaacggctccccgaggagctcgagaagacaattaagtcatcctcgagggacctcgcccaaggagcggtggagctcgtcctggcgagttaccaggctagggaccccaacttctctccatggatggcgctggatgagttccctcctgggactgaggaccgcgtgcgcgcgcaagtccgggacgccgccgactatatcgtcgacagcttcgagggctcggcccctcggcttgcgtttgcccccaactccgacgatgagggcaatgccggtggtgtagacgacagtgacgtcgaggccggcgatccgggcgcatcgggatgagcccccagacccccgccattcttcagttttttcttcttttctttctaaggcctttgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggctcgtgcccaggttctggtcctcgaaaggcgcaggtcggggctagtgcctggggagatccacatgtcgagactggccaggccgggaacgtggtgaccgagggttaggggtgacccgattgtgggtttttgccgattcccccccggagttcaccacgccccggggcacggctcggttctgggcctcgtttggcgattttagccgacccgagcccccgagggcaggattgagcgcgagtgacctatttcaagtcaagattcttcaaaaggaaaaaacagcacagatacaacctttaggaaattgaaattgcttttattgaaattctgaaataagagaaataagaaagtgcatgtgtggcagcccccggccaaccctgcacgcccgagggggtgcggggttgacccgagcccgaaacctgacacccgacccccccctcaggggtagaagcgacgaaggtgttcgatgttccacgggttaggcagctcagtgccgtcgcccgtggccagctgtatggagcccggccgggggacgccgaccactcgatacggaccctcccacattggtgagagcttgctcaatccagctcgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcagatgggagaaccgcttccgcgccgtagacgaggaagaaaggtgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgctttcggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttaacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggcggaccaggtcgaccgcatcattgagagctgtcggccaatagaaaccttggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgacggacgcgttcactcccttcgcggtactcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgggtcagagcaccggtactccttgcagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccaatgggcggtgtgaggcagctgcgagggacccgagccggcttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatcctcttcgctaggggccgcatccctggggcgctcttcacccgagcggcctcgcggggcgcactcgtctcctgtgccgacgacctcggggtcggaggacgacaggggtggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcaaccttcccgcagtggcctcggggccttcctgggggtcgggggctcctagcaccgtttgacaagcgggcagagggccaactccggtcgtcgggggccttgggccgccgttcggctcgggggcctctcctccctgctctctcccgggccaagtctgcacaaggtgggggtgcgcggaatgaggattgtcctcatcgcgctccacgaccaacgccgcactaaccacttgcggggtcgccgctaagtagagtagcaagggttcatttggctccggggcgaccagaactgggggagagctaagatacgccttcaactgagtgagggcacgttcagcttcctccgtccaagtaaacggcccggagcgtttgaggagcttaaataggggtagcgccttctcccccagcctcgatatgaaccgacttagggcggccatgcaaccggtgacgcattgcacatccctaagcttgctgggggggcgcatccgctctatagctcgtatcttctcggggttggcctcaatgcctcgggcagagaccaagaacccgagaagcttgcccgcaggtacaccaaacacacacttatcggggttcagttttatgcgggcggagcggaggctctcaaaagtttccgctagatctgaaagtaacgtttcctggttgcgcgtctttacaactaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgatggtaaccagagtatgcatctagaaaacacaaaaggtcggaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcaagacggtgctcaatcacctccctggggaccccgggcatatccgccggtctccatgcgaagacgtcagcgtttgcccgcaggaaagagacgagcgcgtcttcctatttgccatccaggagaccaccgatccgtgtggtcttggacgggccgtcgcccagggcaacctccttgaccgggacctcatcgcacgtgactatccgctgcctcggggtggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccggaaggtcgatatgacctagcggccaagtgtgccccggcgtcacaccgatgatcggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccggcgcgtcgcctcatgagtaggggccgcggccagaagctctcgcttcatagccttgaggctccggcgagaaacgtgagcacacgctcctccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctggacgctccctgctgggagcgccggcctttttctttttgtcgctcgcaggcctccccttttgggtggcccgcgaagcgccctcgacggcgaggacatgaccctcgtcgtcggaatggaccgacctcttcttcctcctcctgtcacgccgccctgtctgagcggcggatccgggggcggctgaagctgccactccggaaccggaggggttccaggtccatgcctcctccttacgagccactcggtccgcgagctaaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgatcgaagtgactcatcgtcccttcgctgtactgcgtgtaagtccgcttcctcaccggggcgcggatatgtgccttggaagttcatggtgaactgttggcacaaatcctcccaagagtggacagatgcgggtggcaagttcattagccagccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaagctctacagccgacaccaccaactaggggcacggagggctggtccccacgtccgtgtcgaggtgacactctggacgaggaagcgccctccgttgcgtgggcagcacgtcggtcattacgccggtgctcgatgctggcgcgggcgtccggccccccatgcagatcttcccgggtcgaaggagtcgacgaaggagtggcggccgaatggcgaacggcagctgccgctcgccgcgcccttcgtcttgacgacgcggagccggtggtagcagcaccagaggccttggtggcggaggaccgcccaccagcatctaggcgctgccgtgcagtcatgatcaatttggccacatcgtccagccaacgttttgctggagactccgggtcatgggcgacgggcggatgacgtaggagcgcgcccgaagcttggagcgcgccctggggcgtgctgccgtcgccgtagatgaggaggcgacgctccccatctcgccgcccttttccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggccgtgcgcctttgctggctcagccatgaggctgaacaggaaaagcttggtgcacacgaaagagtgcaagagctcagaagatcactcgcagagtcccctacctggcgcgccagatgacggagcgtggggcatctcaccgggagaccgcgctggcccccctttgccggttcggccggggaccctgggtgaaactctaagctcccaatctgtatgtggaaggttcgcgagacaggaagcacagaagacaccggcgatgtatacaggttcgggccgctgagaagcgtaataccctactcctgtgttttgggagatctgtgtatgaaagagctacaaagtatgagccagcctctcccttgttctcggttcctaatctggaaaggtccagtctaagaaaaagctccccaaaatctatctccctcctcagtgggcaaggtcctccttttatatcttaaggggataccgcatgcaccattctccccctctccctggggacttactctaccttttcataaatggatggagatttgcatggttgccgtccgagtcaccttctgatgggacggcccacaaccacctccacttccgcctggagcagacgcgtcgtggaattgtggccgcctgctgacgacatgaccggagtcagaccagtcacgtcggtcattcttgtccaccacgtgtcagcttagcaatctatatgttcgcccttcttcagacaacattttgcttgtaatggttaggatgaagcctggcatatatctggtcaagactaacgtgccatctctgggaggtaacacgctagctccagctagggtcgagtgcctagaagccctcgtccttacgggatggggcgaggtgtgcgtcagaccgcctgccatcacctaacccgcgatctgaccggtctgtgactggtcacagaccggataaaagagtgcactacactgcgttgcatgcgtcgtgacacgctcagccaaaccacaataaatgtggttaggtgagggcgggcgggctgacgcaccccatgcac

SEQ ID NO: 26653 - DNA, 12390 bp, Oryza sativa
ttcctgcagccccactgtgctcacctaacccatacacgcggagcgaaaacccacgaggggtcggggcgccctggccctcggggccgaggggggtgcagcccgaccccctcggggggactaagaggagggcgaacacatcaccctcgggcccgacgtcccccgaaggtgccaggccacgtggacgattgtgtctgcctcaaacctctagtcatgatactcccgatcccatgtcaccgacacatgtgtccaaacatttgatgtgacggaatttttgaaagtttgaagagaactaaacactgtctgaaatagaagtcattaaatgtaaagaaaaccgtgatacatcgaataatcaaataaaggggtggctaaggaataagaggtagcgactgaaatcgcttttaaaatctataaaattgttcgatcttttgaagtcctaaaataatgagacagctatttaacaaaatataaaaaaactcatatgtaaaagaagataattttatatggacggtagccgcgcaattgcgcgggccaccctgctagttaacttaatgagtaatagaaaaataaccttcacgttcgctctcacaacataaaaattaccacgttaatccgagaaaaatcagaaaaatagaaaaaagtcaaaaggaaaaggattgttaaaacgcgtgataaacttactcatgcatgggcataagtcataacatggaaacggacaagagtcctttttgaaaaatgtggtgtccgtatagatatatagatgtggtgtccatatagaacacctgtgcatggaaggaatctttagggaaaaaaataagcaccgttgctatattcatatacaacacaaattactagcgatttagtacctatatatatgtgttggctcattgcctttttgaacagtatattacatctcataagtaggtaggcgcaagcaaatcgtaaatacaaagcacttcaaaggagaaattctcttaataatcggacaaaaagaaaaaattgagtctatttagaatataaatagctgaaattcaaaattaaaaataaggatatttgaaagaagactatagtctatacagatatacaatttaaaactaattaaaattcggaattaataaataaaaaaattaaaactagaggttagagttcatatagcactagaatttagaaattaaaaaattcaaattaaaaatataagtaatattggaagaagagtctagggtccgtatagaatataatttagaaataactaaaatatagaattaaaaataagaaatattgaaagaagggtttagaattcaatagaaatacaatttataaataatggaagtacaaaataataaaaaaagaaatattggaagaaaagtctggagtccatatagaatataatttagaaatcactaaaatatataaaaaagtaaggaatattgaaagaagagtttatagttcaatagaaatataatttatatataatggatatccaaaattgtcggagacactccggacccatcattatatatgcaagatgaagtgaatcacttcaagtcatctaacacacataatgaaacatccgacgtctcgagagaaggatattggcgacatgggtggtcctttagcctgctagtcaacttcagcctgagatgtacccgtcaaaccacacgaaagcggcgaccagatatgttacacattccgacttgacaaaaatggctaaagatatatcacatctcaaatattcttaactcatactcatgtgaatctagttcccaagatgtgcactagattcacacttttatctcaagcatagatatacatagcaaatacatgtaagatgaaagagatcagtttatagttcaatagaaatataatttatatataatggatatccaaaattgtcggagacactccggacccatcattatatatgcaagatgaagtgaatcacttcaagtcatctaacacacataatgaaacatccgacgtctagagagaaggatattggcgacatgggtggtcctttagcctgctagtcaacttcagcctgagatgtacccgtcaaaccacacgaaagcggcgaccagatatgttacacattccgacttgacaaaaatggctaaagatatatcacatctcaaatattcttaactcatactcatgtgaatctagttcccaggatgtgcactagattcacacttttatctcaagcatagatatacatagcaaatacatgtaagatgaaagagatcgaattacaaataataattagatacacggccgaccggccaaataaaaatattgaacagcgaaagcttgactacccaatcctttcgcttgactacccaatccacaggcacaccatttaggggtttaccccattaagttcacgtcctaaaagaagcagtcgatacccgcatcactcaaaattagactaagtctataacctgcaagcaaatgattatttcagtagcaagagtcagtacattatttctaataatgtactggcaagcacaagacaagcctaacaaactacatgcaaggcatataatcaaggaagaccatatgtagttaaattttagcataaagcaagttttagttacataaaacatttccaaacagatttgcttttgaataaaattcagcaagcaagtacttagcatatgggcatcaaagtaggcattaatcaagtataaatatgcacctcagtgccatccatggcagcaaggaactaattctcaaatctctacataatttgaaggtaatttcagcatttagaagaataaatgcaagtctatactcaatagatatttacatgccgctcatgaccgtgagtagaccgtgagtatggctaatcgattagtttttataactctgcaaagtttggacagctttacccacaagatgtgaatcgctctagtttgtctggtacccgtcggtaccaccacactctacacattgagtgcgatctaactctacacattgagtgcgatctagaggtcacaacgaggcttttacattaagtattgtctaaccttgcatgagcacgataagtgtgaatccatcctaggcttaagtcctagaacctttaggtggcgggcacacgccttaaatctaacgctgtggcggcgaacacatccgttcccccacgaggcacgttatcgttgtattggacagacttagacgcccatgctgtgaggtgaaacagtacactcgtcccttcacagaaatacacacagctaataatattggctagctctaaaattcaacacacacatgggtagttcctataggtagcccacggtacactcgtggcccctacctatactacaacggcctcctgaatacaaggttagacaagtgcttaacttaataggccaaggtctccccataaaaacatatatggatgtacggtaaacataatgaactgacatcgagtgaaatccttagatcggtttgggcacactctccccctatcggtacacaactaatcaccatatgtgtaccacttgaggcccaaaccttaaatccatgttttccataattttatttgttaaaaacatcaatgatcaagttctgttcagattatcataaaaccatttttcatgtttgtaatgagctcataatgacaagtatttccaatctaagcatggtaagcaatatagtgtcatggtgacatcaaaactcatatttaaagtggtatggatataatattcctatggttaggagagagggatatggctatatgtggagttatggtgataatgcaagtaataggtgtttgtctaacaagttttacaaattttaatggattagtgtacaatcgacatgcaagatttgcaaacattttcaataacctccaaaatataagttcaacttgttcaaagagagagggaggtgggacttgccttgttaccgggaaatatcagcacctaattcacttcttcaccgtttatgcaatcatctatataaagtacacgttatgcaattaaacaccaaaatatgtgaaaaatccaaaatgctctaaaatgcatggtttgtgcacagtgagtaggtgctggtctaaggtgaatttaggtgaatttcactttatctcactccatttgagagttatgaattttagaagtttgcttcgatatagtgtagtatttacttaggtactgctatgaaatgcttttgtaaggtgatttttttattaagtttgagtttgctgaggtgacgatatgtgtcttctaagattaacacaattggtttcacaatttttagagttaatatgaatttctaatgtattttggaagttataacgtgttgtatgtttatagtccctatatatgcttgatctatatgtttcatatccagaacatgttaatttatgatttggctaagtaaagtgaatgattttattatttaacctacctttaattcacaagatttagggcttacattatatttgtttcatatatgctaactagatgtgacttatgttagtaacttgatatatatatatatatatcaactatggattaactatatgagttaagtgtgttaagttttgatgaaaggaagtggaactttatcttttctggtccatttagctttatttgttttatttgaagtttgtatgcattatacatatagatttgacttaatcattagtatgtgattactatctactttactaattcaaggtttagagaagttttaagtacagagggtgccacattttattttatattagggaagggcacatttgatggttctatagaagtttggttcactccatttggactaaagatgaaatttctacaaattttacaatttgaactgtacactaggttcatatttccttatataaatatttaggggctattcatgtactgtaagtgtgtatttttattttataactttaaagtgcattatttggtgattctacagaacttgagtttactaaaaaatgagttaaaataaatgttatatgaatttccaaagttcagcttgtctaaaactagttatttagtagataatacttttagaggcttttaatgcaaagtaagtatgtctttttattttacttttgcatagagaatatgttggtgattctgtagaatttgattttaccgcaaaatgagttaaattggattttatatgcattttataatttcttacttgttttatgtttcctttttcttagataatatttagtggtagatcttgtactataagtgccactttttatgttataacatgaaagttcatcattttgtgaatccatagaaattgattttaaggagttaagatgaatttgttatgcatttttgaagtttatagtagttttcaacaattcagcacatgtttaattcagttttcgttaagagtacttcatattcttatataattacgagtaggtcctgctacagtgttgtgtgtattgtatctttgcattacagaccctataatttgttcaattttcaaagtgaagtcctgattccttctctatcgatccagcagtagagccgccatgagcggcacctctgctcgccggcgccggcgacaaacggtgacttggttgggggtgcgaccaaaagacaaaatgaagagaatgttactgcgattccattcctctacttttctcggtcgttggtgaccggagttgcgctagcggcgagtccgagcggaaggtatctttgggtgacggtgcatgtgtgtctacggccatgtactcgctaaatgcgtgcatgcatgtgagtgctagaggttcaagggttctcaccgaggggcctgacaatgctagcaaagcttggacggcagcagcagctcgcgggacggcttggaggcgatggagagcttggcgtcacggcgatggctcgatccacagcatgcatgccaaaatcatttcatgcaacatgtgaaacaccatcccaggttgctactactgcaagcaatcgaccaatggctcaccggtaaaggcggagtcggccatggcaacggcggtgggcgccgaggaagaaggggtttgatctccctctccggtgcaccattatccggggttcttgagggtaaatggagaggaggtcgtggtgatgaagatggcgcggtggctcggcttggcttggtccagagtggttggaacgacggcgatgtcgtgcggcggcgctccgtgcgtgctccagagcttccaggggcgacgccgcgtttccgctgatacaagggatgaaacaagatggaatcaaaagagggaatgttcggcatgggaagtagattagggaacgaaaaaggaattgagacgaccgtggcttgttgacgaacgcgtccatcatcttattcgcggctggtaagggagatgagggagaaagggaaggtggagctcgctccctctcggtgttcacggcattggagtgaagaggaaagctgggcgatgctgctgaggaaggtgtaggtgaggatcggcgttgtcacacaagggagcacgcgtcgagcatgcaggcgcagctctctttctctctctcgttctctctcggctgctgagcggtggaaagggagcgacagaggtgaaactggctccagaggctgccaagtgggccctggttgatggaaccaagacaagggagagagagatgggtatgaaactaagtggagatgagttttggacgaatttcagaatttttctctcctccccaatttgtttattcatagtttaatgtgtggagtagataaattagagtggatttttctggaggtagatgtatgtacctagtttctattttctttggttgcacacaaaaattatgtgtagtttgctcacagaaaaatagagaaaagaggctatgtagaaactagtttgaatttttaggaggtctaaacagaggataaaaattctggaaaaaaatatatttattcattttaaataatctagcattttaataacttattttacctatatacttctatgcagtttggtgcatattttgatgggttaggattttagctgattaaggtttataattagcctattagttgactgcattgactgatttatttgaggtatcaaatttagttattaagttgtaccaaaattatagtgagttggatatattgattagcacttgcaagaatttttccatgattttatcttgcatgatctattcttgataatttgcaaagcttatcttcataggtatgtttacactttataaatgcatctaaattattataaggattaattatgtttggtcttctcctaacctgaggtgatgttatttgtcttcattttcatgcccctataattattacacatgaatgtctttaggtttgcttagttaagttatcttgtattcatgttcatgaacctaacatgaaatgaaaaccaaaatccaaattacataaaaaaaactcaagtcaaactaacgcacttatgtatatgcatgcacacatttatgtttgcactcttgtcttaggttataattgaaaaggttttaatttgttctcaatttttattcatgcaagagttcgatcaacttcatctaggtttaaaataaaaatttttggttcacaaaattaaagaactttcctttcaactagttttgaaaaaaattgcttagccctagaattcgggtatgttacaaaaataaaaaacgaacattagaataagaatgtagagtaaaaacagtaatttagaactaaatgaaattcggaataaaaattaaaatttaaaagtatagaaatataatttaaaataactaaaattaaaaattaaatataaggaattggaagagaggcggtccatgtaaaaatacaatttagaaatgactaaaactaagaattaaaaaaaatattgaacggtcaaacatgcgctaaaaagtcaacggtgtcaaataaaacgacacggagggagtacaatttagtaataactaaaattcaaaattaaaaacaactaataactatcacgtgtatacaatactatattacacattagtttgtttggtcatattagtacaaaatttaaaattatatatttatattttaacaataatatatatatatatatatatatatatatatatatatatacaccagctctagcctagggcagtgactaggggtctagtcaccagatatgaggataggtatgcagtatctatatgcaatcttggatgtgagattagtatgtgacaattggatggcaatccaggttgttaatttttttttatattattatgcaaacataaatgcagtacaggaaataaagacaagctgtaaatacgaattatatacaagatatagaattagatattcagaacatagtaggtttatatagaacggttcaggtgttcattcatataccttgataggttgaaggtagatccttctgaagattacaccaaggacttggtacaacacgttcgtaattatacaggtacaggactctcacaaggactcttacatagactctcacacttagactctcatgagtcttttatttaggttatactatagtactaacacttagatggagtggagtggagtgtgatggctggtggagaggtgagaggaatggttgagtgagatgtgttgtgtgtgaaatgcgatgcctgtggaatgtgatgatgagccccttatatagcgctcggtagagaatctttatgatatctcttcttgacctcaaagagtttatgatacccctttagactttatggagagaatctttggtgatgacgctttagacctttaataaagatgtcataatatcgccttttgactatggactcatcttatctggaatagtgtagattccttatcttgaatagtgatctttgtcggggatgacaagatctttattcattatcttcgttgattattatgggtgctgattgcaccgtgtcgatctctgacggctctgttttctgaaaccactgagccaggcttctgtagtaacttttcttggagcattcattttcaaaatctggtttaattatgcgccctgctcccttgaagtattcataactttggttgtaatatttgctaataaaaatccttgtgatcttgttttggaaaaccggctgatattcataatctgtggtgatagcttcttcaatttctgcagcttcagaaaataatctccaattttcatgattagcaattgttgtatatatttcttcctcttcatccgatagtttgctagtaccgtcttcttgaaaattaaattgtccattcatgatatatatataatgaattgctggacgaacaggtggtgtgaattttggtggtatggaggagaagataatcctgtatcttccatgtccaagtctcctgtagacatctttcacagcgcttcctaaatcagattgaaggatctgatcgagggttgcatagatggaattcacaagaccatgatctataatggtttggagagatatttcttcatggttgtatgtgggtagattccagaatctttggagatttatctcagctttgagaaccaggaatctataggatgggtcagagattgcctggtcatctagccttaagagagggagcatatatatgattactcttatggctgggtttctttctcttccttctaagagatcaaagaaataatcttggagtccaaggaatattttcatttgtctctccttaaacttttgccaaacaagattgaagatgtcttgcccaaagcaggataaagtttgctccgtcttgaagcttaatctaggttggagattttcgtatgtagaactcatgggattttggcttttaagtttcttttggcaagaatctttgtaggcacaagatctacatggtgcttttggctgggtccggagtatatattgtggaaggaatgaattgggatgattatgcagtatgtatagtgtttggggaatggtatcatgtctttttgtggatgatgatggtttattatgtggaaaagattgcaataggttattgatatttatgtggaaaacaaccatgctcgaataccttggtattcttatctgttgccatagattgttcaacttccatgggaagtttatcttggccatcacgggatttctcctcgcgataatctagtaacctctcctcatgatgagggatatcttgtagtttagcccttttttctgttatcttttgatctgaggtcacaaagtttttgaaataatatgctaggccatttaaggcatgagctttttcttttttgttttttgtctgccacaagaggtttaataacccttgttgtagctctgttactctgaaattgtgattaaatcgttcttcatggcctctgggcagttggggcagtctccatgaactcatattcgtgaaccattcagacttctgtgaagccatttccttgcatatatattcaaaatttttagtagcttttaataaatatctatcttcccatgatgtcttacctgtcaagtccatagattttggaagatatgatgggaaagaattgtcatgtaaatatattgtattcacaatttgttctcttttggtctgaacaagctggtcaagaatctcatctatgttagacgaaaatcttaggctcacctgcttgcccattatctcaaattgaatatcttcgtttgtgacaaggaagggacgaatgagtgataaaaacggtgttcctaaaataacatcttgcttaagatttttaacgattagaaaagatgttttaatgcaaacttcagatatgcaaatataggtatcagggatttgatattctactgttaaaagtcctccatctgccccacgaattctgtgggcggctttacggaaatatttatgagggataataccttctcgaatgcaattgacatcagcaccagaatcaattaaagtgatatgctgaaagtaggatccgtctataaaacgatacataacttctgtgtaccatttttgcttcatttatttttgaatggttccaacaacctgatcatcttcttgaattggttcgtccttttcttccatatggaatccctcttttaattctaacatgtatagacgctttcttatttcttctaaatcttgtttcataattttttgttcttcgaataggctgatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttagaacgagtatattttcatcagactcttcttctgaattatctggctcataacaagagcaaccactgtcttggcagcaattaatctctgcatttttttcttcatctgaacttgagtcattgtctatattatttagtattgcttcaagtttttctttaacatcttctgattctgaatctaacaaggcttggatctcttttttaactttagatttgaaacatctgttagctatgtgtcctttcaagccacatttgtaacaaatggtttctttgctttcagtgtcttttgttcttatattcttattgtaaattctttttggttttcttttggtagcttgaaagctcatcttgcttttatcatttgattttgtcattggtttggaatgggtttttctttttctatggacataaggatcttgaaaaccaaactgatagcaaaaatctcccatttctcttttaccaagaatcctttgttttttgagttgatctttgatttttaggtcattgcaaagctcagcccccaccaattgtatcttttgtgtgatttttccaatatctagatagtgataatttatactccctcccccttcttttcttagggaatttctaaccttttcagcaaataaaggaggtaaaccagaaatatatttttctttatttccattagctatgcagtcattagcatacataatcatttgatgacataaagtaaagatttgatattcagtaaagccatctaagttccattctacaatttctttgccattgtagtaagtcatattttgaatctgaggcatttcctcaaactgtaggtctgcataagttggtcgagggtaataattcctagttgtggaagtaagagtagaaggtttaaaaatcttattgaccatatcatatttttcattatcagaaatctcattgatatttttatttacttttaaattatttagttttaaggctagctcactgactagttcttcagaaattgcggatccaaaagccttttgttttccaagtttgatgttaggatcaattgttgggacaaacataggactaacagactgagaactagaagactgagaattagagggaatatttatctttacctcaggtcttcctgttttgtagccttc

SEQ ID NO: 26654 - DNA, 18730 bp, Oryza sativa
  unsure (1)..(18730): unsure at all n locations
ttcggattttggctcttttttcatcatgtttttttctttgaagaattcttcgaagtgtctgacttggctactttcattccaatcaaagaaaaagatgttcttcctttgttctctcatttctttgtgccaaagttctcttatctttagtctaaatggttcatcgaccctttcaaagtatcttttcatcttgggtcggttcttttgaagcctgagttcttttttaagcaaatctttatcaatttcaaactcatcctcttctatggcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctggtgtttcaatcaaggattcgacttccgattgatccatagacttaggttcaacagcttgagataaaacccatttctctggcagggtgatctcatcccattttagggttttgggggtagtacatctattattaggattggtttgaaggagagtggttaggccttttggtgtataatgtttggcacaaggtgctaaagttgtcatggctttgtagtaaactctgtaggtaacggagatgttttcactccctggttctagttcataaccagatgtttgtaagttgagagtgagaactttatggatatttgtgtctgagagggatacagaaaaatcaggaaaggtgttaaaataaacaggaccattactgaggctggcttccaccatgccaagtaaggaatctttgaaccttttatttctgcaatctcttagacaagccagaacagagacgttcaaaccctttctagtcaaggatctgatagcaacttgtataagaccaaagtgaaggtagtgatattgatgtttagctcttatagaattgatttctctttctgaaagaagatgtagggtttcgtgcaaagaactaattggaatagttttttcaattgttttaatatagtagtcactaagtaatgaaaaagtacctacatgatatatttccttaatattaaccttaggaatcttccagttggaaatacttttctcaatatcctcaaaagatatagatgaagcattctttaccgacatagtgccagcagacttctcgctactgcacaaggctacagatcgatcagtggctcttcgtgatctaaccaaccaagacatcttatacgaaagataggaagataggtaggtagttaccagacaacggcggggaaatctcccacaattatgatcaacctatttggatatgatgtgttccagtcaacggcagggaatatttcccacaattaagttcaacctttgcctttgataagtgcccagtcaacgaattacgccgacaaacgccttctgcggctcaacaaggcaacgcgacttcaggcaaccgatcaaaggttcgggaactccgcgacttcagaacaccacaacaccgttcgggatcaccgcgacttcagcacgctacccgacccctctcccccccctttcggagaagatggctggggaggttatatatatatatatgtgtgtgtgtgtgtgtgtgtgtgtgagaaaaaaatataacaatgctagccgcgcaatctgcgcgggccaccatgctagtttgtgtaaagtgatatatctatatgaggggcagatatagcatgtaagcatgattagattaactaaatatattaaaacatcaatatcaggtaagatcggctgaaacctcgattctacccttattggcaatcaaaaggcaggctagagctagagattcaaatcacaacttggtagatcaaacttaactcatgcagcactaagtatgaaaacaagcaatatatctagacaatcaagcccctgactgattttcatggtggtagatatcttagctaatctaatcaacagaatgatttagccgatactggcataaccctagaaaagatctggtcgatatagataaattgaaccattgatatagattaactaagatatatgataaacaatgattatattaacaagattaacatatctaaaacgatataataacctcaataatgcaaaccactgtgacaagcattacctcttgtgaggagatcgaaaccaatgctctaacttgaagaaagaactcgtcgaaaataactaaataaaaaggtggcgatgcgccgagagtgtattgaacggttgttgttttcttatatggttcttgggatatatttatacccatagtacaaacttgtccatgatggacatgactcaaactttcctaagtcacagaaacacacaaacaagtccttacggcggactcttgcaaaatctctaagaaaccgacattaatattcctaattattagatacaattgcctataatggactgtatccttgcacggcaatgctttgcaatccaatccgggcccattgcgaacccaaacacacctgtatcggctactctatccatatcggcttagttaagtccgactctgttctagccgatgcacaaccgaaatttggaaacaactacttctccctcaaaatccacctcgatctgttcttcgactccgagtatctctccaatttcgctgttaataggttggtaaatcatttatgagtttatttactcagattttacaccacatatgatatatatttccaggtgtggtgaaaccatctgtcttttagggacttaagcatatttgttaaagcagtgcgcgcatggtgtgtgctcgatactttggaaatttctttattcacaacatacaagcttctttatagatgttttgttatttgaattttcaaagatgtagtcaactttaggttgctcgcgtcatattttataaagaagtcggttttatcacttgagtcttgtttactcgggggtttataatgcatatgctattattatgctacttaggtggcttaaaaccactcagttggttgatttattcattatctgactatatatttagtttgttcaactaaccacataggcggaggctacacctattaggtgcatctagtcgatgcacctgggtatatatttaattgttttttattcttttcagcctttcacaaccttctgaatagataaaagcactcgggagactatgtcaaagatgatagaaacactcggctttggagtaatctagctcgggagaaaattattttttcgactgtgaaagtctcacgggctaatatggagattatgggtaccatatacctacatggctggcttatccgactggatatagggaatatgttatatctatgaaatatgtaacggaccatgatttgggtattacgttttcttgtgtcttaaggaatggcctaaagttttgattcggtaatattataaagtagattaagtaaactgatgccgtatccggctaggttcctctcttggtaacactgcccctcaacctatataaggtgggcagggagccctccaagggcttagccacaattagatcgtcagatcaatatacacccggtggattcaaatctccaaacaggaatagggtattacctctcattgagagggtctgaacctgtctaaattcttgtcttcgcatccatccacttttaggtctcgtacgctacccccttttattattgtcaatttccagtttcgacaacttttcaaccatgttttctattttatcttagtttcgtccatctttgtcggtttgcgctgtaaaccgtctatcctcgccacgagagtgcgattatccttttgtaggtttgtcccgtaaacctttcgtttgcccacgaaacgagtagttttacttatatcgatctaaatcagcctagaggcttattttgatctctagatctgctttgctagccggtttagctttttttacaaaacctatcttgatttagcttttgcgaggttgagatggttggcgactccatatcaccgcaagtcgtttaagtgtgtcgatcggattttgcgactttgccaaaagggttgccaacaggattattactaagggctatcaagagggcaactaggagaaataaccttcaggaggctacttgtattggtttctcttcatctagctgtgaacattcaaacaagttccagcttaaaaaagtcattcacatagaagggaagataccgtgctgtattgtttgaggatgggaacagtgtggccgtgcgggagaacgactctgagtatctgactgccatttctattgctgaaaattttaatgaatcaggggtacaatggtaacctcaaaattcctaaatcattttttccttttcttttctatttgtttaacttggtattgtgggatccactaaccatctaaaaaaattcccattatcttaaaaaaaaaactgtcatccataagagggacaaacgatggtttcatttgaaaatatcatgggtaaatccttaaacctaaaaaataagagcaaaatcaaaaacaaaattaaaaataaaaattggggtacgaacacaattcgttccacatgacaccaaagatcagactgcacatatattgcttaaccaatcaaacgaatgcaattgtttaatattgtttgttgctgtgctttttaatttattcgagcaagtccttcatttgttcaatctgtttagactctgctgaaaattgtcggcatgcgcatttatcactcaaggtataaaggaagacgtgcggtagagaggcacgcgttttcttttaacacatggagatgtaaattctctggggaggcttacggatcgggcgcccgatctgggagccaaaaaaatcgggcgcccgtccgagccgtccgatccagcgcccctaatctcgtccgtccgcgcgcattaaacaggagcacgacacattagcatgacgtcagcagcttggatgcatgtaaaactactctaaactattttttctcttaaattatttatccaaatcatgatccgattgcaccattaaatgtgttgcaattaaatctttaaaacaagaccacacatggatatattctgatgaaaaaaaaaacttattattgagttatttttaaatgttgcacgctatttcacaaagtatatcggaattgtttcactgagtagatcgaaaatgttcaaaccaccacgtcgacagcagctagataggctactccaaatattatactggtgcgattatgatgaataagagtaacgaccggctttggctaacaggatccgaacctgtataaaaatcctcgtccccatctcttttacctcagtctcgcatatatcctagtaccaacgatccccatactatgcaaataccggaatcgcgacatcaaacgtcgacagtggcgcgctaggtagggggttttggtgctttaggattccgacgagatgtgttcaaaagatggattcttcaacaagaagctactcgttgacttcggaccagaaagatccaacccagccagaatacgtctcccgatgagattggaatcatcttcatcagctatttgattcggcgagatcaatcaagcttaagatgtcgctgccgcggaggacatgcgtctgttcggtatttccgaccatttgacgatcgcgaggatgttgccgaaataatacaacacgccgacacctcgagggaccgaaaccgactactatgctgatcgactttacgcgtggcctggtcggactcggggtgacaggccggatacaccgttgtccaagatcgccacgtattgctgctcccgacatgtgcacatgcatatgcagactcaactaggttgtatccccgcggcactgttataagtataatgagaaataaacacgtaaataaaagaaaaaggtatgttgacaaaagaagaaccgtatggagacaacctaaacattaccatgcaagagtaacaaagttatatgtgcctaaatattagtgttagcatattagcccaattaactgtatagcacacgccaaaaatatttgtagttgacagaaattgcgaaagctggacgctatacagcatcaacccatcataggcataagaacattgacatcaggccaagtgggcgcgtgatgttggagcgtatacaacataatcatatattatgcatagtgcattgcatagaaaagtttgcgtaatagcaaacatataaaaagctatagcaaatgatagtaaatggcaacagttaaagcacaaacctcggtgaagctcagaaataacccaagcaaaggaggcacattcagctgtgtcgaccttggtgtagattctgatctctatgttaatgttggcactgctgatagcagcattcgtaaatcacagtaatcagcaaattcagggagagtaagcaacttgggaaaacacgcaaggaggatccttgtactgattgggagatttgggcgcggacctttctgcggccagggaagatcgtcgaggggaatagataagtacagaaacatcatgccaagtcagtcttagatctgaaacttccactcaagaatttttatctttccctcatttaaaccaaatcttgattcctgaagaaacaaacaaacaaagaatgtcattccatccacagagaaatcaaaagacaaaaatatttctaatcacaccaggtcgccaactgacaaagcgaagcatgataaataccaaatacagtgtagaacgggaatcaacaatgacaaataatttcatataagctactaatgtattgataggaattcaataaataatatggctgattctaaagattagctttccgtttgcaatgtagaccactgactttcttatatgtagacctaacaaatacataagtacatgatttctccgtgcaaacagtataaatttaagaagagattatgtacagtatgctgagctgtattacatcttgcaattatcacataattagttcaagatatcattcgtctcagcacacaaattgcgataatattggactgcactcgggcacgatgttcagactatgcactcacccaaaaccaactggttcttgttactattctcagccattgatgtatggtctgacctatagatggatgtgggaaagcatgaccaattcatcagacagcaaggaaggaatgaagggaagacatggagagcaggagcatacatagcctaagtcatagaagctaaaaagcatgacaacaattgtaagaacctatcggcatgaccgctaaactaaattaagacacattacaatattagcatatgcaatcagcacattgcaatgatcctcgtgagacagcactggatgatttgtattttaaacctttattgatagtctagtttaaatggctcaacaaaggtcattccaattagctagtttgttccatgcattactcagcgtaaaaaggataattatattttgttagtgctttcctttttgttgtcagttctttatgtcagctctaccaatgatagtaacagtaaccgtgcatcacacaaatcagcaatggtagtgaaatgagtaaatagtccggcagagcatagccacacgcaaggcggatcgaggggcattaccttgtagtgactgggcgcttcggtcggagcatgaggttgcaggggctgagcggcttgtcacataatcgtcgagcgagcttcagggggtgacggcggcggcgacagcggcggtgggaggcaatggtagaacttcaggggcacagggaaggattttcgataggctttgatgagcaggggaacagtttggtgaggtggtggggaatagacctcaaatcggcggcggcggcggcggcggtggcgagccaagatttacatcggcggcgacggcggcggtggcagcgacatggatctcctaccgtcctccagcagccagatgatagcacgggcgttaccggcggcgtggttctaaagggacgggaaagaacgatggagcagacaaaagacctaaggctcgtcgtgcatcggacggccagaaacatgcatgggctgatccaatggccagcaagcacatgaacagggcaacagtagcgtggttgcgtggcaacagaagcaacacagcagccgtacctcaccaaaaacgcccaagcatgcactggtttgccgtcttatacatgcacagaagacaattcaacggttaccaaggataattatgataattagtggattaattaatttaattaatctaccaattccgtagatacatccagcatgtatctacaaaggtacgcaataatttatatacaatttaccgtacttatttttcagatcatacgatattatcatatatatgatttattatgtttacctagagcatgttttttatacaatatctattatgtgagcactccctatattaggcctacaacggtttaatactgggggctcgctttattttcttcagtataaatcatgcttatttacggtttacataatgcctgatatttcatctgctcgttatatcctgataatactagaagatccatgcagttttttgagtacatgttcgatattctctgctatatgtcttgccttctagaaaatatttttcaggaacaactgagcactcgagtaggttgtggtcgagcactgttgatgaaaaaaatcgaacacaccagcctgggagatctgcttagctttagtgcaggtccaaaggttgatgggatacgggcgtaccagtcagtttgatcctgcaactgacaagatatgcaaataatagatcaaaacagcagatcggcttacaagccgatgaagtagttccagccgatagctgataatagccgatgccgataccagccgatagcgatagggtttaagcaatcggctatatgtccaatgtagataatgatataaaggtgatcggctgatgatgataaataacaataatatatcaacataatccagtagaaaccaatcggctaacaatatgatgtaatagaacaaatactgatccgaagggtaaataatacatcggctggaggtccgatgtcataaaaaccacaggattagataaatcaatgaaacctttgttgtcattggctaaatccaacttatatatacaatccttataagccgatgcaacgtccagataattcatcggctaaaacctcgatgaaacccttattggcagtcaacaagcaagctagagattatggttctaagcacgacttagtagatcaaacctaactgatgcagcactaagtatgaaaagaaacataatatctagacaatcaagccgttgactgagttttcagggtggtagatgtctaagctaatctaatctagcaacatgatttagccgataccggcagaaaccctaaaacgagaagcagccgatagagctaaattgatatgctaagactagattaacagagacatatgataaataggtaggcaaatatatcatccaaaccagagcaatccaagaggtcgaatgtactgattcagccttgaacgacgccgacgtaaacgatacaattgtctgggccagtggaacattggacttaccccttagccggagatcgaacaccgatgcagccccgcgtcaggtgccaagtcccgccggacgataaaataaagtagaaaaggtaaaaggtggcgatgcgccgaattgtattgatcgtgaagatagattacatagacctcgggtatacatatttatacccatgggttgatacaagtccttgtcggacaagaaagaaaccttcctaaagataaaaggaaaagataaagtccttataggacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcagatcttcgaagccgatgctgactctaagccgatgactactccgggcttaccaaatttcactgttaacaagcacactccattatcgagaacatactagacaaatgcagagttgtcgcgcccaacctaccaacgaagaccgacgacctatctcatagcactggccatggctggactactcgagaaaaggttgttaacggataattgctcgcgaacgatgtcggcttgatcacccaacattattgcggacaggacatccagatatgctacgggttgggtatgtgagtcatgctggccacatgagatgcacatgtaataaaccaactctagcacctccattggtgttcgagagataattctactcgctggttcttgaaccagtacatggaagtaatctctcacaccgcaacttccattggtgttcgagagataattctactcgctcgctggttctcgaaccagtacatcgtagtaatctctcacaccgcaacttccattggtgttcgagagataattctactcgctcgctggttcttaaaccagtataccgtagtaatctctcacaccacaacttccattggtgttcgagagataattctactcgctcgctggttctcgaaccagtacatcgtagtaatctctcacaccgcaactttcattggtgttcgagagataattctactcgctggttctcgaaccggtaaattgtagcaatctctcgcgccttaacttcagtcggtcgaggtacgattatggcgatagcgtagcggtcctcgcaccacgacttctgatggtcgagatatgactacggcaatagcgtagcggtcctcgcaccccgacttcagacgacttcagatggttgaggaatagctacgactgaacttcgaccggcagcgtagcggttctcgtaccacaactccaaatggtcgagagacacctactcgctggttctcaaccagtcaatcgtagcaatctctcgtacatttacttctagtggtcgagttacgattaccacctggttctcgaccagcggtgtagccattctcccactatttctacttcaagtggttgagttacgactactacctggtcctcaaccagaggtgtagcgattctcccactacctctacttcaacaaagttgatatcaggtacacaatatcgccaagtgttttacctagagatcccttaccacgacgacacctagagttgaaacctatccttatatccctttacgccgtcctgacaaggcctctgaggaacctaagggaacttcggctgaggacgcccagagcggataaggccttgttggatcatgtagagacaaacgaccatgtaagacctggtcatgtaagagttctcgccgtgcgtattaaccaagccgtgtgatcggaaattgagttttccaacttcacggctgggggctaggatcagtgctttttcaactaaggcaggtcatgggtccaagagccttatcctccgagaacgattctccgacgacaaggctagggtttagggagagtgtatgagtcaacaaactgactgatcgaagtcggtaagagagaagacgctcatgtacaaaacattggtctgtacatttaatttactttcagttttccatacatattataacatgtcaccctttgagcgttcgctcaggggctatttctatataatattcttttatgagtattgatttcaggaaaattctattcgacattgtggaagactccatgtctctatggttctacaccaagatcgactaaggcgagcacgacaaatgttgacaaggctccgtcgcaggctctgcgccttctcgatcactcgagaacggttggtggatctcgacaaggaatacggaatgaagaaatggtgtacctgccgagataaaatttcttgacttcaatccaaattctcgattacagcaagacgggagacttagtcgtatgctctgtactttcttagttgacgtcggagattgactcagacaaaccctataggtgcccgcacgaggctgatatgggaagtctaacgttatctctgaactcaccgagaacggtcatgtgagcacgataacagttactccaaggtctgcggttgagaatatgaatttgttcatttgcattgaagtcgggggctactatcggggttatggataccacatacctactagtagttgactaaatctcgacaggatccaccacataccatgtcttatacagaaactgacttcggatatggagggagttctggataaggaaagacaaccagagttctacatggaaacgacaaagactactcggattgtatccatattggtttccctggttctactcggacaaggggacatctatggttataaatacaaggccccccaggaggagaggggggacaataagagctacaacatacaagccaatatacgccaagacaagacgtcggatatcgacttcagggaaaagcacggctagtcccctacggtgtctccggatactgtcaggagagacgaaagcgctatttctgatctcgccgggcacggattcgaggaggaagaccaccctgttctcgactacgtgacgatacttcaaaccaccacgtcgacagcagctagataggctactccaaatattgtactggtgtgattatgatgaataagagcaacgaccgacttcgcctaacaggatgtagggctattacctgactgttcaggggcccgaacctgtataaaaatcctcgtccccatctcttttacctcagtctcgtatatatcctagtaccaacgatccccatactatgcaaataccggaatcgcaacatcaaacgtcgacagaaacatttttttagtggaacaaaaaaatgaaatggattcccttaatagagggtttccatatatttgttgcaacgacgcattccataatatcaaaattcactgcaacatttgatccgtacatagtgaaacattacgagtatactagctgaaacatcgtaaaactactagttgaaacatcaaaaagaccatatgcaatattcaaaaaatatcaataaaaagagctaaaatatttttcgtcgaaatataatcatgtgtggtcttgttgtaaagatttaattgcaacgaatagaaatgtatgatcggatcgtagattggataattaatttagaagaaaaaacattttgaaatttttttaaaaccacaccttcctgccgagcaggggagggagctccggatttttctccctctcccgggcgaccaagcaggagggttttcgaaattctcttgtcacgaactttgtcgcaaactgagctttacacagttcattagtggactctgtctaccggtttcgagtcttcaactcagcatggtgtttatatttataactatttattctttacgcggtaggataatgaggcatctttggtttgttcaatgagtttttttaaagtaaattctattatggtgccgtcatttcgtgatagagaatatcagaataactttactgagtgctgcagtaggggaaaaaaaggcgaattaacacgtgcatacccctttttcagaagagagaacaaagcgcacaagaatcttaataattacacacataacttgtcaggatgtatggttcttgcaacgatggtgaagtattctcatagattggccagtgtaagaatccatcatgggtgataaatgctaccagaaaatcgtctcatcaggggtaccggtaaccaaaatattcgaatttgtttggatttagcgaaaactagcaaagttttgtttaaatttcatgattggcctagaaatttcgttcgaaatttaattccgtccgctcaaaaattatttgcaaaacaaaatagcaaaccttgtttgtgggcgtgaaagttttgtgcatcttaggccccgttccatactccaactccaaacttcagtttcctcgttttctgttagcatgtttttcaaactaataaacggtgtatttttttaaaaaaaatatttctatatagaaattatttaaaaaacaaataaatttatttttcaagtttataataattaatatttaattaatcaggtgctaatgagcttttctcgtttcacgtgcacggaaaatatctctccagttggagagatcgaacggggccttagtccaaccgttggagagttatttgaaggaaaaccatttgagttattagtggtcaacatgaaataataatatatagtgaacgctgacagttgtttaaaaacggagaatgtaggccctttctgttagacgagaagaggcgatcattatcctcacataaaaaactagagagaaaagagagaaagaaaaagatatgccactatcactcgccacgggcacgcttattataaatagccccccttccaggctttgctgcaagcaaccaaaacgtatagaaagcaaggatgtcgtcgtacttccagaccactcaaccgtttagtaggacttacaagatcggtaaacccaagggcggcggggacgggcagggagctggtaataattactttattcactatcaacactaatatatataattgatagtttcattctgcgatatttgtgcgtttgtgaatcgctagagggaaaacaaggatccgacggtgcaggccggccgcgcgtgcggataatcacacacaacaacgaccacgaaccacgagtcgtgcagcacgaacaagctccagcttcatctccggctccggcccccgtctcctactgaatcaactagcaatcaaccaacgcatccatcgtatagatccgtccatcccgtcatgcacgcgtaagtggcactaaatagtactcctactccgtaaatatttcctcattccctaaatatgtttgacatcgttgacttttttaaacatgtttgttcgttttattcaaaaacttttgtgatatgtgtaaaactatatgtatacataaaagtatatttaacaataaatcaaatgatagaaaaaaaaattaacaattacttaaattttttaaataagacgaacgatcaaacatttttaaaaaaagtcaacggcgtcaaacattttagaatgaaggtagtcctaaaatcaccgcaatggtacgcacagtaagatgagcagataattgggacatacgtacgttcgtacacctgctagttgcgctgctcccccgtagtttcgaccggcttcccgtgagatcgaatagcatgcggcccagcatgcatatgtgtaatatgtctttgtaaatgtaaactataataaagactactttatagccaatgtaatagccaattcatataatagttgtttactatactattaatatctggtcccacctatcatacacatattacgtcttagagtccatcctgcagctagctacagatctatagcccgctgttcttctttttcttcctttacctctttaaaatatgtttacagctagcttaaagcctgctattgtacctgctcttactattcgtgtgtatggcaaatcacggcggcctaggagatctgcttcactccagtgtatgtctaaatcttgcttcgggttcagggcgtgtgttggtatttcttaacgacattactataaatataattcccagcatgacgtagaaatattcatggtatatttatggtcacagaaatgatccacaagcgcacggacataccattgtagcgtttcacccggagtattccaagctatcgtatttatttaatcccaagggaagatatgacaagagagtactatgctaatagtttatatattacttgtatacatcaagttttgtgtaggggttaagtgattcaaagggtaggtgacatacagaagaaagaactaagattccctcactaaacaaatactaagctaagtggagaaagaataagaaaagaattcattcctatacttctaatatacatacatctttagtctacacttgctagtatacagtcatgcaaccaatacccttaacagtgccctcctggtgtttcgagagaccacccttggttgtcgagtttcttatgacaacctgtcatgaccatccaacctccaaccggagctaaataaggaggagtaacctccccaggaaagtgtacttaggattatatactaacgtgtaggaatacccgtactgagctgtcaccatcagcggcccacctctactgtcccgcagcatataaccctaattaatggtatccaataatctaagcaccgtgcttatattactaaatactactctgcatccttgcagctgacatagagcaaccgaatactcgaacattaaacccacatcaatgtacctctctggtaagctagttacacagctatatcgatgcaagtataaagtaaagtcgatactcaaataatatgaatggaataaaataccgaagatgtataaagaagaatattctattaattcgataagtcatacaaaagaagagaggaaagctactagaaccatacccgaattctcctgaagacccgaggactaagaatactattttaattcctactccactagcactaggatactactaaacttgagagagggagagagctcttcttcttgagtgtgtgtagaatggaatgagaggagtggtatttataggccattaggtgccttgggagtgtggtgatgctcaagatatccaataagcatattccctcttgcttcacctccttgtgccaagtgtcatgacggttgcttcgggtagaaacggtcacaactgccatgggatgtcgataactaccagcctgtggattttctaggccatctgggctgttttgggtttggccaaacccaaggttcggccgaaccctggactggcccaattggcccactttttggcaggtgtatctctcggtggatcctcagcccagtggtgtgaattttgggcttgtttgctcgtgttaattctgtgttatgagcccatctatctacaagtctgcttctcgacagcgtttgattgatcgttcgtctattttctgttgattctcctccatttatatgtgcttctcctgcatacatgttagtagcatagtatatagtgggagtagatattttatttggaaattttgcattgcaagcatatctagtcttcattaattgggtagtattgacggtcaaaattggtcgataatgaccgtcaacaaaccccccaagcttaaacctttgctcgtcccgagtaaaggacaaaagaaaacaaagacttggttgttgattaggagttgctactatactgtatatctcaaatgtacaagtgtaagttatgggtactctctctcaaattaaataagttggcacggtgacttacccttacacctaattcccgcaagacactgcctttccttgtcttgagcggttgagagacagaacaacaattagagcactagtcacccactctttattcaacttttattccgggagtttccaaatgattttgcaaaaaaatccaagttcctcatatgattctcttgatcactcaaagtgtatgaatatggattcctcaccaaatttgcctttatgattcctactctaaggtttgatatgtggagcttggtaggtatcaaatgtggcatacttacattcacatttattactaagtcaaaaattggactaaagcaaatgactagacatactcaagatcaagatcatgcaagtgtgtgagtaatatggtggaaatggaatgtggataacaataaagaaaatgcttctcctttatgcatactttcttctccaaaatcctccattcataaatatggagagggcatggctatatttttctatatgttttttttatcatgctcaacatctttgaaagagcagaaatttattcttttcatagccatgcctttccctcctcttttttttcgcaaaggatttttttctaggagaagaaagcataaattggaacggagattatttttggatgatgatgaaatggatatagtggataaaatggatgctagcttccagtgtagaaatttagcatatgtgtgcatatgtgggtgtatgatcttgatcatatggtatgaaaagtatctacacaagtcacaaaatttgacaaagttcaacggaattacaagcaaccaaaatgtatatagtttatcaatacgaatatttttgactctggtaggaattcatatcaaatgaggaactttcaagtttatcatttttgaaaaataaaacatctggaattcaagtcaaacttagaacaggattatagcaactcttatttactatctcatatctcgcaacaacctagacttagattagcaagtgcagctcacttccctcaggttcccagataatgtttggcttttcttactcaacttttgagagagtacttaaccatgaacccatatatgagagatataaaacagagcaactattcatcatttcaacatgaagaactaagcatgtcttacctagcatattaaatctaacctatctttttggtattgcaagtttttgtgttgttttaagttttataaatgcaatgcaaaaattaaacatgcaacttgaaagggaaacatgtaatgtgatacaagttaaatatgtaatgtgatacaagttacctcagtgggggagagacgtctccccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26655 - DNA, 490 bp, Oryza sativa
ttggttttacatctcgaacccagttccatgcctccctgcttttgtcggcctccctccagtccatggtccccattggaattctcagccggagggaactgatcttgctgaggctaactccttactaaagaaaatagttggaatcaagggagccggcttacgcgggaagtaggtcactctggcacttcatcaaatgccaactagcccccatcaaggagagagatcaaagccatccttccagcacgaaggccaaactggccccaatcgggaagatccagactcgatcgagttccagaccatgtattctcagatgtacaaagtcttctcgactgggattgtcatcgattatgggcacaatcttccagtcatcccatacagcctaatgaatcctacgcctccagtaagtctctataactcttctttcgtctctggcagtgaatgaatcattggatatataattgccttgtcttgacttttataggaaaatgaatct

SEQ ID NO: 26656 - DNA, 580 bp, Oryza sativa
agtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatccggattcttaggcccgtttagtaggactccaagc

SEQ ID NO: 26657 - DNA, 179 bp, Oryza sativa
ataccacctcaggatttaagcgagaaatatctcaacctaaatagggagttattagaggctccctgttgaccagttgaggtgggggtcagaatgccacacgcgcgcgggccgggccgggccggggcgtgggcgtgggcgtgggcgagggcgagggcgagggcggcgtgcgtgcgtcacgt

SEQ ID NO: 26658 - DNA, 720 bp, Oryza sativa
ttttttttctttcgaaaatggaaatgcgttaagttggcgttcatgccatttccggcccactcggcccgttacaatttggaaaaggaaaaagtacaccgaaggtccctcagcttgtcatcgagttacaaaatcgtctccgaaccgtaaaaccggatataatacctcctctaacttataaaaccagtgaaaactagatccctcgacggttttgactccggttttaactgacgtagcagctgactcagcatgggacccacatgggtcccacgtgtcagcctctacttcccctcccatctccacctctcttcctctctctcctcccacgaaagcagctggccagctgggtacggttcggctggcgcggcggatggctggtgcgtaaaaactgggcggcgccagcgggggaggagctgggcggcgccggcgataggtgacgcggggacgcgggagaaggggcgacacggcggcgcggcgacacgggagaaggggccacgcggcggcgatggactcggcgggtgccccgaccgcggagctgttcgccgcatgcgcaggagaaccgcggagcaggcgagcgaggcgggctgcgacctcgctttcgttcgcgtgcggcgtcggcgtcgtcttcatcctccgaagcgagctcccggcgagttggtgaaaactgcaaaaccgggcaggggctagcaggcagtctcgaccgcgtgtgcgtctggcggcgtc

SEQ ID NO: 26659 - DNA, 2413 bp, Oryza sativa
ggaggctgaggtggccacgctgacatgtggggctcacgtgggtcccacgctaagtcagctatcatgtcggttaaaaccggagtcaaaaccaccgagggatctagtttgcactggttttgtaagttaggggatgcgttgtatccggttttgtgattaggggacgattttgtaactcgatgacaagttgagggaccttcggtgtactttttcctttggaaaaaggatttctttggtttattgcccgtacaggtctatacagattttgacgaattttggtaaaatactatattcaacgaaattggtacaatatgttgttcccaaaaattttggtaaaatactatattcaacgaaatagctgattggaagtagtttcctttcctgtttctttgtttttgcaccacaaaaatgtaatagagtagcgcatgctttagcagctttgggttgtaaatgtcctcggaataccgttgaaccatgggacagtatgcctccgggcatggaggacttggtggccagcgattttgctgagtccttaagttaagaaaggttcttttcctctccaaaaaaattgagacgtgcggagttcaaaagaaatagaaatgtttgcgttttaattagtggggtttgtattgacgggttatactcgcctactgtatttatagtatggctgtcgttgtaaccaaggtatatgcgagattacggtaaaaagagataggagacagaattttatataggttcgggccccttaactgacaggtaatagcctcggtatcacatgagtacagtatttaggatgacctaatctagtctaccttcagtatcacatgagtataatatttgggatcacctaatctagttttttttgtcggtttgacatcatgtagctctcacacgtagtcgacagctagtgtagtattcgtctttgaatatgaactcatcgagattgcaggtagctctaatccctcatgtcagccttcatagctcttatctgtattggcttgtattttgttggtatgttccctctccttctagggtcttgtattatatcgaacatcatcttcctctccaagaagaattcggagagatagaatatgatacggactaaggaggcattatcttcccgactataactctaacgcctcctattttaggaagataatttccttctctattcatcgtattttcttaataaaaggatacattcacgtatactattggctatatggtatttccatataccgaaaggcacaaactcatgtataggaggtatgcttagactcaaattgacagtttgttagccaattttttggcaataaattcttttgagtaaattttatagattcacatgtatgtattatattattatggcttgagttgtaaaagaaccttgttagtttggacatgtcacatatataactgcagttattatggtcttaaggtttcaaaaaaccgcaccattaactagttttactcgatattgtagcataagaaaaaatattttacttacatggctatactccaatattttggcgatggattgaacgaactcaaattttgaatataagtatagaattcaaatgtacaataggttaagaaaatgtttgacaaactatataaccataatactaatatatgtggttatacactgctacagaaatgtttttttggacgagaccctctttagatggcagacggaccataactagtcgcatctacaaaaatcgtcctctattttggtatacggcttcttaagaggaccttgcggaaaaatcaattttcgcaagcgggtctcttaagggtccgcacgcaaaaataagcttatttttgcaggcggacctcttaatgggccacacacgaaaatatattttcgcagacggacctcttaagtaatcacctaaagtccgagttacctcctcatttccctcttaacatttcaaaatttttcattcttatccattcatctctcttacctcctttccactaaactctctcgcctctttttcttctctccactcctctgtcgcgagcggcgctcctctctcactcttctctcacggccggcggtgggcggcgcggccgacgatggatggcggcaggcggtgggcgcggccggcggtgacgggcggatccgcctccaccgggcccatgacgaccagatccgcgggcggcggcgggaggatctgacggtggagctagtttttttattattatttggatttttatttttgcgtgcggacgacataaagcacccacatgaaaaaagagcgatttttgcatatcctttcggatagacaggctagagttccacatgcaaaaaccatttttggtacgtctggaaaaaaatgttttttattaatgatacgcaatattccaaacatttagttttgtactacttgaaacaaatatactaggtttt

SEQ ID NO: 26660 - DNA, 690 bp, Oryza sativa
tcaggtaataaccctacatcctgttggccggagccggagttgctttttattcaccataatcacaccagtacaatatgtggggtagtctatctaattgttgtcgacatggcggtctgaaggtctgactcgtagtcgacaacagggtagccttcctcctcaaatccgtgtccggcgagatcagagatagcgctttcgtatctcctgacggtatccggagacaccgtaggggaatagccatgcctatccctgaagtcgatatccggcagcgtgtcttggcgtatgtaggcttgtgtgttgtggcttctggtggacgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttgga

SEQ ID NO: 26661 - DNA, 2157 bp, Oryza sativa
  unsure (1)..(2157): unsure at all n locations
cggcccgccctagtgcccttgccgtgcctgccgctggccaccggtatcgcctactcctaccatgcccaacgttggccaacagttcaccgttcgccaccaacttcaccaccgtaggccgcagcatcaaaatccaattgataagtcaagtcccgttggtcccctctttcaattttgctagaccatccataacccatgattattgattaagttagtgtttgttgcttgcattgaacggaggggagtaggatgacagcaagtggctagttataagatggtttcttcattatggtacgcatatttttaatttttctatgtattttcttgttatatattgccatcaattagagatatgatgcttatatgtattgggtacacaactatttagtacaatatcactttagaattatacataccggtattacacagagaaagtcaggaaccccctcatcttttctctagctccgtccctgtgtaaaagtattgttcatgtgttaatgtaatgtgctgtagcgatcgatcccgtgcgctcgctgtaaatcgggcggctgagattaccctaaagtcaccgcactgtgcttctctgacttcactgtgtaaagtaagatgatctcaatctctttacagaacatttggcagagtaagacttcgatctgatctggcaacaaatgaaggttcttgttgtgatgagcgaaatcctagcatcataaggcgtccgtctgccagtccatgcgacggcgatctgaccaatggacaggtttgacacaaagattctcttggtctcgatcgtgcagcttgtacgagtaattctgggtctctacttcaattcatgatgtttgttcttcattcagaactcattttgagtaattcttgtgccaactgaaaatcaatcaataatgccgattggatgttccatttcattcgagagtgatctcttatgaccacttgggctctgtctgttcccgttaggcaggagaggtgagaatgtaattaggttccttttcttcattnntgcatatcttattatgctattccgtttttttaacataggggtatgaaaaaaaaagggagaattgtgaagatggtccctaaaattttgctcctgggtcattttagtccttaatctttcatattgtccaaacaagtcctttaaatttgtcacatgggctgatatagtccttggtcccaccaaaatcgccacatggacataccatatcaccctcctatgcaaaatctatatgatttgtccaatttacccttatatatatcataggaaaataaaaaacaaaagaaaaagttaaaaaatatggtatatataagagcaaaaatatacgtcaaaaaggtgaaaaaaggaaaagtattttttttccctatggttatgtctaattcacccttacatttctttttctatgatatacgtaagggtaaattggacaattcatcatagattttgcatgaatgatgacatggcatatccatacgacgatttggtggacccattctaggccttatgacaaagtttaaggacttctttgaactatttaaaaggttaaggactaagctgattctacatagaaactttagggactacagtagctattctcccgaaaaaaaaagtaggtactactttcatcgtaaaacagttgtcattctggagtgtttaagtatatattaaggtttaaaaaagactacaatgtccctaattaaatggggatagttggggacaaaagggaaaaatttaaatggaaagtgtttgatgggatatttagtacaaactattttatgataaattttaaatcttagaaaaaacaattgttttaggacggatagagcaaatgacaaaatatatcctacaagtgggtatccacaattgaattagtataaaattgtcaagattgaatacataattattatatatcgagcttaattaagacactacgtatacatataagtgagcgttcgtgaactaatattatccgttgtttttaatatggtggcatctaaacgttcggccgccaataagatcaacaaattaatgcagtcaaaatattttaggtaaccattggtgaaacattaagttatttggttgggaaacaaaaattttaaatcattgaaataattgaaagatatgcgaagcccaataaaatgtgtgatacattt

SEQ ID NO: 26662 - DNA, 837 bp, Oryza sativa
acgcaggaataggaactggcttgaagttctcgatgcgccatatttccaagcctctgtagtgtattaaggataatcgtggctttgtacattgattggactaggaccaataaaatagtgaactgaacagattgtcaattgtaaatactcaaaaaagatcaagagtttaatgaatatttaaagaaaaaaaggcttctgctaaatcactacagaccctgtgatcattgttatctcattaacttctactctgctaatgctaatgtctagcatattgtcaagaagcttgcacctgtcaggatacttcatatgtgtgcacagtagcattgcaaattcatgatcatctagcaaacaaatgcattttacttgttttagcagaagtgtacaattaaattatcttcttaggaccaattaattcaacatggtagatagtgttcactcaacttatggacaaaaaacaactaaaccacaaattcagagtttcaacatgcacaaagaagttttcctggttgacttaagtaatgttatcttgcaaattaagtgacttcaatcaaggtgaagataatgaaagcaatagaggaaagtacactaaggtgaaattaaaaaaaaggatactccttttgcccagcaccacgaaaagctggatccaaatccttcatagaaaccgacatccttgatgttaaagaaacctctcaattcttctctttcacaggagagctaatagtatgctgtaaacaggggtagaaaaggtgggcagtaattaattagcaaacgaaaatgcacttggttttccttttttacgaaaattaaactagatagttcagttgttaagaaacacgaccg

SEQ ID NO: 26663 - DNA, 722 bp, Oryza sativa
ttttttatgtttatcgaatttgtagtgttgtacctcatattctagctaagtctatagtttatgaagttgatgctatatggactgtaaataatatttagtagggcctctattatatcccctaagatagaaaggcatcaaaatcacccttgactacagcccctattcttgaggctctatgccacagtccctatacactattcattagcgcagaaagacatttttcctcacctatttgttccctctcctccctaccatgcaccgtacctccgccatgctgccgccccaccgtccaacatcctcactattgccccttcacccctctttcgtcgatgcatgctagaagaatagatcgatggttcattgtcatccccaatcttcgttgtccttatcttcaagctccctagatgttgtgttgcaaccaggttccacattagccttcgagctcctccgtcctagtccgccgcaactcttttatttgtcccctatgacatcctctaccgacgccatgttgttgcttggatagacttcaaataactatgaactatgtggtgtcttaaacatttgctactcgtattttgtcattccatatttaaaagttttaaatttaaatttgagttgtggtctttgaaattgtgaatttgtatatgatcagattatatgcattagaaatatttatgttcaattattctatgttaactaataatagtaacataaagtgtatg

SEQ ID NO: 26664 - DNA, 2430 bp, Oryza sativa
ctgggctggttgtcaacagtagcatattggagaggggatgattgagctgggatgggttggaacatgatatatgaaatcaaacggcttatcaatctttcttgatactgttatggaattttattcaaaatctaggtggaattgtagaggaagattgaattgttagttgaaattttttgttgtgagacttgatctggatgtctttgttgtctctttgtctcctatggtggtgtttgcttttgaacttgtttactccctcgatccatcctaaaatataaggcataaccacccataacacaaagaccaagaaaacatttaatcactttcttagttggatcaccttgatgaatgcaagcaatgtgattgggagtgattgggaggtttgatgatagtataagatttaaaacaaataaattttataggaccaagagatactagttaatgtatgcatgcatgcacgccttacattatgagacatgagagaaaagtggttgtgccttatattttgggatggagagtataagcctaagtgtttggtgatgtaataccatatttgtgtacatccttctatagatgtagaggccgggttttatttaatctattattaaaaaaattaatctttcttggttacatgcatggcttgacttgggagctacttcataggaataattgcagtctgtggttggtaatatatatatacaaatgttacagagattaccaaagctgctaaaatatgttatatatccatgtaactttttagccaatataataattcactaacccgcacacgttgcttttaattgagttttacatatatcctaaaaaattacaaccaacaatataacctatacatcaactgatgcatggctcattatgcaatttttaaacgtatggacatcggaaatttattttgacgaaattatagtcgtggccttgcatgcatgattagctgatccttgtcttcatttcaagtgtttgtgaaaccaatcgaccattaaatcaagagcttgctcggcttttttgacctcgaatgggttgctggcgttatatctgcaagcaaatccatggttcactccttggaagaccttggcaaagtaatcaatcttcaataattaatgaacaaaaggttatttctaacgttcattttttgctaatgaataatatatttctttgcaaagatttgttattgaaatatttgatgaatgttttaaagaaaaatatgttcttcttgcaaaaaaggagagaaaggaataggtataggattaaagccacatgcagtgccccaaatgatggcctagcttttgtggattagattttgggtgagttattttcctcgtttcgcttatgcaactcacttgtttactgtgactattttttaaaccacgaaacagtgaacggtgtcttttttagaaaattttatatatatatatatatatgtgtatacgtttctttaaaaattaaataaatatattttaattttgtaatagttaatatttaattaatcatatactattgttatttctcggttcccgtttacaatatgctagtaaatcttttgatttttatgccattgtatcagctctaacttttgccagatgttgaccagcaattagagcccgcgtttccctcaaaaggaaaatatagcccgcatgatcctttatcatatcatcatccccggaaaattcttttgtgtgtctacagtctcatttcctttcagaaaatagacttaattagtttttcagtcaagtgttctcactcttcccgtctattgaatcctgtgcttcatgtatatgtgcaaattaaattatcttatctgaaaaacaaaaaggataacaaattgcaaggcaaatagagctatatatgctgatgcatttgctatatcaactgtaaacgaaattataacaggggaactcacccgatcagttctatgacgcaaggcctgaacatactggtacactaattttggtggtgtcagtgtgtcgttctgagctccaatgatctcaatggggcatttgacctctgcgtgaaatgtcacggcgaactttggaataagaaaacaatggctatatattcctgtgcaaccctatagctagatcagatgatacatgcatatttcagcaacagcaacaaagaaagaatatcaacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgtttgttcaatgtggagaggagatcaggaaggttcagagtgtatccttagaatatgaatctggacagactcatgtcttcgttggactagaaaacatctcatccaatactagattggtttttttttatggagggagtatgttggtattc

SEQ ID NO: 26665 - DNA, 1737 bp, Oryza sativa
ttttatagcaaataagtttacttgggctctttttatttttaagatacaccactgatagatgtagtagtataattataaatgcacaaattaatgtgcttcttctttatgttgattaatatcactcaccaccccaacagtaacctccaactccaaataacagatatccctttctttcttagatcagaaaagattgctttagcatcttcagctgcttttacctgcaggatcaattcatatatactggtcaaaatcaacttattgagttcttgataattagcatctagctagtataggttaagtactttggatatagttttgcttaatttgcggcttaatttgtgcatcctgataggtgcaggagctgagaattttcatctgaacgatcacgattactaggtaattaatgttctatggaatataaaatcaaattgcataagacggtgaaacgaattaccggagaatgtttgctgaaccattccgtaaggttcaggtctaatgtgtaaggatctccgtggaagaaatcaggtacagcgacataatatcctgcttgaccaactttgtcagctattttcctgtaattttcagcatcattatcacacatatgcttttaaggtgtttccggatctactactggatcataattcacgatatattcagtggaattcaatgcaacaaaacagcacaattataccgtcctatgggtattagtcgaacaaaacacatcgctgataagggttttcccaccatataccagcccgcgccctccacacagcaagaagcggcactgataaagatatggcctcaaaacagttcaccaaacccccttataattatggacaagcttgagtagaagtgtagagcatgcagggaaccctgttgctcaacgggttgagattttgcagtttttttttaagaagaaatgggaattttcaaagctcttcttcgctctatatttattttgtatgtctcgcacacaattaattattcacatagagctttattatgtgaaaagtattgcattttttgtcctctctctgcaagatagataaaattacgatgttttgcacataatttctccttcaggaacaagtacttatatctcatgggttgaagaggtatatatctccttgcgacgcatatatattacaaatggattgatcagagctattctctaaaatatcaaacttgagatgacttgcttgaaggaaatgcttatagtgaaatatattagtttgattttttttgacatgctaaatggttcgaacaaaaaaaaattgggcacgcgtaaattaatactaaatcatacaatagtctggaacttcaagacaactttgccggcttcgtcattagggacatttctaaaaagacatgttcattgatcgagggatcgcctcgtactatactctctccttctataaatctgagacatatttcattctttggtttctctaaaaatctaagtcctatttatagtcactatgtgttaaattaaattgttgatcggaaaccaagaaaccattgtagaacttattggttgcatgttcattggttttgtcacatagtgagtgagttaattgcttcttattttttatcaaaagaaatagtctcatattcttggaaggagggagtacaaagtaaacagaaagggctaaacagaagagcaatcatttctacaagacatagagatttgtcaagttgttcaacaaaaaatagctgttggtttcttgtaacgacaaa

SEQ ID NO: 26666 - DNA, 715 bp, Oryza sativa
  unsure (1)..(715): unsure at all n locations
aaactaaaaaaaaaacattagccaaaagaaatctaaagtactagacaacaaaaaatatttctatttaattaagcacctcaatacatagtataaatctaaatattaagaggagatagctgaagctaattagttgtacatgagaaatactctgttcccgattccgagagaaaatttgaattcatttccagaaagtttctgatgatagcaaccttatcatattcgtttccgtttcaaaaaaaaatccgaattcgttcccgtttctgaaagtttcagaaaaaattccgaccggcactttccgtttccgaaaacatgtccagaatccggtaactttccgaaccattttcatccctaatcatcatagggtttgaatagaacaaaattatttgaaatttaaacatttttttgaccgaaattgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26667 - DNA, 608 bp, Oryza sativa
gctcgtgcgtcccacagacttggtggcgctcccgttggatgtggaggcacccatctggtcctccctgcttggggatgacgctcgtgtattggctactatgatgagatcaatggagctaatggagctgcaatgtgtgttggcctagtaggtgcctccctctgtccttgtttcttgttgggtttgttttgagtaatcagagtgcccttctccttccctcaggccatggtggtcgtcaaagcactcctcaagcctgggggaagtgatgcaccaacacaacacgcggagaggcttcgtctagacgagattatagccctaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatc

SEQ ID NO: 26668 - DNA, 7434 bp, Oryza sativa
  unsure (1)..(7434): unsure at all n locations
gggtaggctgggcgattcactattccggtgattattctgttctgccctaggatcaaccgggagtcgggacggttttgggcggggatctggtcacctgggtgcctcgggggcgtggactggtgtttttagcccgcgtgcgggtggtaccagcagatacctgcgtagtcgtgtggcttaggtgatttcatctccgtgttcatctgatgtgaaatcccagggatgtgtttatcacctcttaactttgaatatactaaagtctgtgatcaagtgagttttcccgcgaggaatttgtgttgtagtcttgacttatttgtaagggaataagcctattgttttactgtgatgtgtgatctggtacagtaggttggtgttgcgatagccaaatgatgctaagtagaagaggagtaggcacttcccatttttgtttggtttcacgccgaaccctattaaccgacatacttctcaattcctactctgatggtgtttcttgctacttcacctgtttttgttctactagggttcctggtgcctacttggtctgaatggctgacctgaccgacatgggctgctgtagttgttttggctttttaaggaagcctagggtgtctgtaagtcgacctcgcgacgctgatggcatcctatctgaagacttgttgaaccataaatctgcggaggatcctgatggaagcttctacaccggggatgatcctgatagaagcttctacgacagggatgatctcgatagaagcttctacaatggcgatgaccctgacagaagcttctatgatggagatgatcctgatcatctttatggaagtgatgatgggcagccaaggaagagatctgaagatattatactgtcaagggctcagaatggctttgcatgtagagaaagcctagttaaggagactaaaaaagtatttcgctcagaggtactatcctcttagatttgaattctttaccactgttattctattttcatttccatttttcatgcccatatatagaggtatagtcttatctagtgcagacttcttttacaagctagcccgtgcatgagaaactgtcacacatggaccattgtattaaagacaaggttagctcagcggttagactgcgaaataggtaaatgtcgtagttcagtcttgttcgagtgattgaatctccatcatgcaggaatgcaaattttggcgcctctgctaggttttgaacgtggcatcttctacgacaacatcaatgctaatgccgcacattatgccactttccttttggaacaattaataattaatccatccttgtagaataactgccatttgtcctaattttgtgcgtctgctaggattagaatgtgggacctcctgctaggaaagtgacaacctgaagcccactaaccaatcatggaaagtctagattatttggttgttgctatgtagtatacgattttggaatgattggtaattaatctatccttgtcgttatattatttagtagagtaacattgtttaacttattatagaaaattataactgtgttataaatgatcggttaaaacatcttttgcattatacgtataagatgtaaactttaattgtttaaggcgccatgctcagatgatctactgtttcaatcagtgttgtcgtgacctttgcaaatccataaagctgtatgcgatctattacctttttgcattaaacagtacaataacttttttcctttcggcacatttaggatgaaaatggcagcaagatggtcaaccaatatgtccacctggggaagattggttctggaagctatggcaaagtggtaagatagctcacattatgttatgaagtgacttcccacggtaaatgtctaaatctttttttttttggcttaaaggtcttataccgaagcatgaaagatggaaagctttacgcagtgaaggtagggtttttcgctgtccttatgtgctgatttctttatgttagttactaatttttatttcttgcatctgaactcattaataactagctgctagtctgagtagttggttttactcgttcagcaccattattcttatggttacaaggttaaatttatgttgcgtgcacagtgtctgcatctaactgatggaactgtagcctttgcccttctattgtaggttttgaataaatcttacatgatgaaagtacgtgttgtgcgatcagaaactgccatgacagatgttcttcgggaagtgagtaactttctcagtttacttgtgattgtaatacatgtttttttttcttttttgtcatgacacgacttaagtgctctggaaaagtagtgctgcccattcagcccttgacccagttaggatttgggtcagtgtctgcacattctatttaaatgggtaatatgtaaatgtggtgatataattagcatagctcttgcactcaatatggacttacataagtttctcagtacaataaataacaaaccaacaagcccacttagttcatgcacaatgcattgtgcattatttttggctatttcttaagctgggtttatcgtctggctcatgttgacttgttcactcttaaactagccagttcaaacatggtttctcctgatcgaaatggatgattatagaattgtctaaggaaaaacagtctaccgggaggctcacttcaggtcctttttggtcaaactattgggctgggcttggtatgataaccttggttgtgtgcactttgaggatgcatcgctaccataacactgacactatcgggccaaccacatacatagtaaccaagttgtcatggtccgaaatcatggtgggtaaacaccaccagaggatagctggggcggcgatggttgctgcagatgaggagagaacttagacttagatgatgaacattagggagagactattaacgaatggacatacagcccatccttatttaaataggatggcttgaccttgaaggagtttatctctaagattttataaatagctagcaaatcaatctattctatacacccatgtgaacaataaccatgcgatactggacatgtccatgtgcacctcttcctcctccttggcctagggccttggccctgagcccaatacccaagttgagttgatacaagttgagtgtgctcactgattttgctctgttcaggacatgaacacaataaaataactggaataaactttgcttgcttaaagaatctctatgtactgtttaacgtctcaattatctgacagcatcaccttttgtattggtgacaggtatccatcatgaaaatgttggatcatcctaatatagtaaatctcattgaagtgattgatgacccaaatgcagataaattctacatgggtatgtaatgacattctcattttttttaaaaaaaatagtttccttttgtttaattgtagcatgagatttttcttgctaacttttgagcatctttatttaattctccatattattctacctaacattgtccattggtattgccagttcttgagtatgttgaaggaaaaatggtctgtgacaatggtttaggagaagctacctccagaaattacttgcgcgacataatctctggtgttatgtatcttcattctcatgtaagattcaaatttccttcactaaaagatctgttaaattgtggtgaacgccatgccatatatcagaatctacagcctataaacaccaattgtatatggatcaaactattcatggtaccatgaatagtttgatccactagcagtcatatcaactggtcatatcaaaggaaattcaaatttgccagtgtgttccactagcagtcatatcaactggtcatataatgatagtttctctgtacaaatatatttaagcagcttcaagtttgtattgtgcagattaatgcaagcaacatattttaacttccacattttctaaaaaagtcttgcttaaacttggttaaatcggtgaccaggttgagcagaggttgagatccactgttaagttatcgttatttgtactatagtcttagtctatgcttgtaggctgaagttctaattgcatgttactttccttgttcctttagctacttaactttctgtctttgaggtaattattgcatttgcatatgccaacttttttgggcccagctaagtggtactatttgaatggttatggtttcataaagaaaatattaaatcccattttagttctagattaggattatttgtgcctacacacacatttcttctcttatccattgtttgattgtattggaaattgagttcattaggaccatggttaaatttagctagaaatatgatactagttaaacttcaatcattaggaccatggttcaagaaagcactaggcgctagttgggtggctggggggcgcctagtgcctaattggcgccaaggcggcgcctaggtcaggtcaactagtcaaatccaaaaaaatagcacgcatattgcatagaaattagactatataacactaaaatagcaaaaaaaaaaaaaacactagccaagttagctcagctgcctaatacaccatcgaatgcctaatggcggcggctacccggcgcctagagacgacttttagaacactgattaggacagtgatatgcatataagaaatcttaatttatccatgctcttatgtgcataatgtatcttggtaacatgttacttgattccttaacatctggcaattcattacttcttaagttggtccttgttgatgtttctatttccccaatttgtacatacttctatattataatcagatacatgttgctctagtcacacatttatctacgttatgcagtctgcactgtgttatgtgcttcctaactcatcatgtcactgaatgcttcctgtcattatacgcagaatattattcatggtgatatcaaaccagacaatttgttggtcacaagcactggcagtgtgaagataggggatttcagtgttagtcagatttttgaggtgggcctttatcctctaacctctgtattgtagtaatgaatgctattttccttgtcatggcataaagggctttcagttgaatggatccccagaaaattgtgtgcatcatgatttagactgtagactgtatcaaaaatgcaattttggggctcaatttctaagacaagcattttttaattcaaaaacctcaaaagatattgttcatttccttccatcctgaatatttttaagattactcaagtagatgattgcatgccaccttttttagttaagcaggcccatgactttatatagtaaaacaggatggtttcataccacatttgattatctttaacttgatacatgatcttttttattgtgtgctaatgtagaaatgcctattaacatgtactccctccgtcccaaaatataacaacttttagccctcaggatttgtcccaaaatataacaacttctccaccaacattctcttcccaaccaatcacaaccctccaccattcacttttcccacctacctccactactcatccaatcgcaaccctccaccattcatttctacctactttcttaataaccgtgtctaactctaaaacttcttatattatgggacggagggagtaagtgtttttaggcaatttcttcgtacaattgtggagtctaatggcttagtactttactgataaagtgttatgtgattgtattgcaggatgatgatgatctgctttggaggtctccaggtactcctgttttcactgcaccagaatgctgtcaaggtacaactgcctaccttttatatttgagtactagtatttactgcgtgcagaatcagttagtcaccaaattatgtgtatgaagttcaacaattgctagatagacagcagctgtagatgttccccttttacttgattgcagaatagcagataaagtaatctgttctcgacagaacacccaactgcaaacggaatgagtccaacataaatatgcaatttagatttagaatatgacataaacgaattacttagatactgcaactttaagcggccaaagcatggctatgaatgttatgccaatgattaaaaactaaagagggcaaagaccatgactcttttgccgttggctcaaattgcgacatatagtctttggccattggtgcaggctggctaaatatgaccaacctttcaatctaattcacttcaggttcagcctaccatggtcgggcagctgatacatgggcagttggcgttactctgtattgtatgattactggtcactatccatttctaggagataccttacaggaaacttatgataaggtacaaaaataccccccttccatttccttttgctttaccttttcattcaactcattcaagacattgctgtggaatagattgtcaatgatccggtgcaaatacctgacaacatgaacccccaacttgctgatttgctggaaaggcttctctgcaaaggttcttttttcaaaataaactgtttcaccgccttatgattctggcacattttgtgtcttagtgccagatatattattctactaatgaacattctcttgtgtttccacatgtggttgtcttgcagatccagcaaatcgtatcaccctgcaggctgtaggtgagcatccttgggttgctggggaccaggggccagttgttgaatacttctgtagatgtgggtttggccgaagaaagagagatgatcttaagggagaagtacaatagcaaaggcttgttcacagtttatcatccgatggtttactgtagataggcgatgagtgtggctaaacaaagaaagtgagatgatcgacaaaccgtgttactcttttttgtgttcttcctccctttaccgattgacctgttggttgctcgcctcaccacctctgcaagttttgttgcctaaccgagggagcccctgtttccatttttctgtagatcaattttggctgctgcaacatgtaagcttttttcatttggttgttgaatccagtatagcaaccattcatagaaaatatagtgcaaaattctttgtgaaggctgtagtcggtgttagcaattcatgagcaccgagtacagatgggtgcaggctgatctgcgggtacccttaaaagtgagatttagtttattttagttttagttgaactatggtgggttggaagatgtggccagcaccatcctatattagattttacttaagactcatccattcatggtgagtgaatctcttgtcaacggaaattgctgtaagttactgcatattttccgtaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26669 - DNA, 1258 bp, Oryza sativa
ggtcattggtagcccgtgagggaaagtactccgccatgcctaggtggacctagaaatagattttaaaccaattcaatgatttggtcacccttccttacatcaccttattagggtgacaactagctaattggagggtggaaaagtgcttcacggagccttgcctgttgtccacccacatgtttcactcatagatggcgatgtgagccatggcgttggctgtcagtattaggagctcgacaacaaggaagaagtcgagcacacccaccaccaacgaagccatggtggactcgaagctcgctgcacataaggcctcaagcaccactatctcatcatcccggggggggggggaggggggcaactcgccgcgagacaaacttgtatccccgtccgtgcaatattcttctccgctacgtctagcttgtctacgtgccgctgcttggcctatgagcggcccggcatgccagattgcaaggggtaggtttggcttccctagtaaaagttttatgcattcttggcattcgtctcgccatcgtccccatcacccggtgccatggctaggcacactgccggcggttgtctgaggcgtcgataccatctcgttggcccactcgatagcatatgtataaactttatatacacatatatacaaagtttatacatacgtatataaagtttatacatacgtatgcaggaatagtagtggacttggttgacacgtgtcccgcgggccacgggttgaggagagtgcgcccaaccgttgattacaccaccacaaaaggcaaaaacattattgggaaccgctcagccatcgtctctcactagattgatctatctttctgtttttggctagatttttattttcggcatatgatctttctattttgagctacacacatgagagagaacggccgcatgcctggggccgatctcgactggaaacgcatgcagagcgacgagagtgctgattcgcaattaaagttcatattaggaaaatgcaaatcaaagtctattttttcatttgcattttaaatttgtttcgaacttatacgtacaagtttgtaagcatacgtacagacttctaattggtattattatttttttgaaagttaattggtattattattgccatgcattgctgtatgttttgctactgttattgttattactcatgaatggcccaaggcccaacgaaataaatggggtaatatatagttagcttttcaaccctttcaattattcatggcctaattgttagaaa

SEQ ID NO: 26670 - DNA, 957 bp, Oryza sativa
cttcgagtttgacctaacacgacaaccgatgttgacaccagtgaggcagtgacctttcacagtcaccaggactctggtagcataatctggtattatcctttttcgatgatgatatggttcaaattctggtatccatatttcgctttttggagtgcttaaacttttttataaaatatttgtggcggttttctgaacggtgtttcaaagtggtcctaaggttgtattcttccctctcttttcctaactcacctccctcatttttttttgatatactttccaaagtactgaacggtgtgtttttataaaagttttttttatagaaaagttgctttaaaatatcatattaattttttaaagtttattttagttaacactcaattaatcatgcgctaatgcatgctttgttttatgtgcaggagagaagggttcccaatccttactcctaaacacagcctaaatagcatcttgagacagagagggcaagactaatctcttttttttttaaaccttggagccagccagtgaaagtttttactcttgtgtttgatatttcctcattaagtatccctgagagaggcaaatcattagctgtcactagtggagatttctacatcacaaagtggtgatcagaggttgcaacagtgacaatgactgatgtttccctatcatctttctcctctgagaattgaagggcagatgtgaaggggaaaagaaagaatgtcatttctcttctttcaaatgcttagttatgtcttcccattttttttccttttttttttgagagaacatgtactacctcattgctcatccatttcatcactaacccaaatggacaaataaagcttgcttttggtgtaccaactgccaaaaaagatacatacttttaatatatagagttataacagttactagtagatttgtgatgtcagtaactaatggttcgttgtccatttctac

SEQ ID NO: 26671 - DNA, 1203 bp, Oryza sativa
ttgcccgttagatgcaccagcacctttgtgcgggacccacctgcagtctccggaaactacagaagtacatatttactcaaagcatccacatgctgatcaggtcaaagcatccgtgcagaggtaacacaaaagcatgtaggcgcatatagctaacacttgattatagaagcatcaaaatgcagaaatctaatacctaattactgatcgcttcatgagacttcaggtgggtcccaaacatcaggtgtcaatgcgtgtaatgggtaaggctaaaactgtagttttgtgataacggagacactcaatctgtagttttataagacaagttcttaaatttgtagtactgtgatagactagcataatacctgtgagttgcaacagatatcttttaagaaaaatagctcatcgtatatattctaaagcccacaataattgttcttattgcctaatattatcatcatgttacttttgcagtcactttctaggtgtctattgagctagagttctcagggtctgtggccttgggggttgggaaataggcaaagtctccctgtttatgggtcccacatggttattgggtacttgggtggtgattcaccaccactaccactaccatcttttacattagcacagatatagattgtgcaaagtacctgttgtcttgtgaaatttaatcattttcttttatggcagcctccttatgcacattatcctactgacatgtgggcccagacccaccttgtgagttgtgagtgatgcaacaaatgatttgcaaatttaagtttgcatttatgtagttatatttgtgagtgatacacaaatgatttgcaaatttaagcatgcatttatgtaattatattttttagtttatatagaagtaacacttggggtaatatggaaagaacaagataagttatacattgggtctggaactctaaataacaataagcaactttttattgagcaggttgaggatggaattgtatttctcacattaatattaaatgttaactactaatctttttgtgataaataggtttattgccaagtactgacatggtgatggtagtttggcactgctgcaatggactccagtgtaaaggaattggtgggatgatatctgctcattccaccactcttctgttatcaaaagcatacccataagtccagagatgctgtgattcagaaggaaggcatgggaggatg

SEQ ID NO: 26672 - DNA, 950 bp, Oryza sativa
ggaagtctgcagtgggatcaaaccagagcttgtaccgcttctctctgccaccttttcctctggcatacaggttagtgtgcagggtgtacggctccgcagtggagttccccaaaaactcaaggtcaatctcgtcgtggaattgccataggccctctgttatcatctgttcaagatcgcaacacaagagaatggttagtctaaaagatctgcaagtgacaccaatgctaatacagtaatctgttcattccctggccacttacataaagagtagtcacggttccagctgagtctccagcaacgagcttgatgtccatgtcgatcctactgaagaggtatgtgctcttcgaccggaatgcggaggtcgtccagcggtcaagagtcagtgagatagtctgtttgccggagttgtcatagaacacctttgagtttccccacagtatgtcgaggtcattggtgaggtcgccagtgaccatggagattgctaggatgaggtagaaagcccacagggaggctaggaggtgagccctagcctgccccatggcttttggtggtatgggagagtgagcagagtgagtgggtgtgctgtgtctcaaatggtgtgccctttatagactgaggtgaagggagacttggttgtgcgagcgcgtctaaacaactaaacaatatctagcttgccagtgactttgattcttggaagatgtaagaaactgaagagaatcgtctggctgctgaataagttgtgtaaaaaatggtgatgaaagtggcttccattaaagccagaatggtgatcaagttgactaactggttctagggttcgatcttggctccaaatctgcgagccgtcccacggggtcttctgacaagctaaggtggttctcaagcaagttgctgaaggcttatgttatgatgacaaaagagttttaggatccctttggccattgtggtgcaat

SEQ ID NO: 26673 - DNA, 1228 bp, Oryza sativa
ctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagctttgttgtggccagtgcggacctgtcgctgaggagagcagaggtggaggagaagagggacaaggtgcataaggaatcaaaggcgcttcttgattacacaaggaaggccatcaccaagcttactgagctcaagaagtgagtggaaaactattcactttcagtatacttaaggagatttgtgcaaccacttatatctcttgaggaaaatataatgaacaatgtatcatttgaaggatgctggaaaaatttaaaaatgatgtggagaagcaacaagcagaacagatgacggattggcagacaaagttggttatgatggactcaaaggaacgccaatatatactccaagtctccaattataaggtgactagtttttcttcttttgcaagtggtgtaatcagtatatggttttagttcttcttttgacctgatagttttggccgactaccactaaacaaagcagtttctgttgctgaagcagcatatggtgtttgctagagattgtcaactgttagaacttagaagtatatagtcagttatcatttatcaatacttgtgcttgtgagtttagcaggatgctgcaggacatgacatactattatcaagctaaccgtacaactttgaaatcatttcaatccacatatttcctgaatcttgacctgaagaggctgttgatcagatgcttatctg

SEQ ID NO: 26674 - DNA, 593 bp, Oryza sativa
ccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaatgtacatgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaaggggg

SEQ ID NO: 26675 - DNA, 217 bp, Oryza sativa
ggtggcctcggcgagcagagcagtggcggcggagcaaagcgccagcggcgacgggcgagcccgccacacggagcggagcatgcgcggtgaccgccatggtggtggggaaagttagcgctggtagcagcttctgggcgccacggcggcgtgagcttggtgagaggatgctacaacggatggagcatcgctgcgttgtcggctggctcctccgtcgccg

SEQ ID NO: 26676 - DNA, 1519 bp, Oryza sativa
gggcgaggcctacagtgacatgcctatatgcattcattcatgaatatatacatatatattcgatcgatcgatcttgtcacattcaacccgtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccaacaagctcgcgagtgaacctcagccggctctctcgcctctccggcaagaagggcgccaaggccgccctgcccgacgacgacgattacgagccccccgcaccgccgctcccacccggggacggcgacgatgacgaggagcccatcaacctcgtcttcaagggcagagatgaggccggcgagagagggggtggcacgccgcatcggcgaagaggtcgccgccgaccgctgccgccgctccacagccacacttgcccctccgccgctcgccgaccaagccccccgctccgtcgtaatcgcccgccgccctccgcccaccgctgcttcgcctaccgcgctcgtggaggtcaaccaacacgacaacaacaccggcggtgaaaagctagagcatgacaagcgccgccgttccgctgccactctcgcccgctgccctgcccgccgctcccgccgtcccagccgcctctctccccctctcccgccaccgctggcgcgctcgctccacgccgcccaccgccgcgcccgcctcctctcccctctctcgcttcttccccacgcgccgtgcccgcaccgccgcctgtcgccacgccctcatctgcccggccgcctcactgaagaagacgagaaaagaaaatgtgcagctgacatgtgggccccatgtactttttaattttttttttgctgactaagatgccacgtcagtaaaaccgggcaaaaatactgccgagggacctccggtgaacggtttgagggagtttaggggtacacatttctgattttgtggttaagggaccacagaaaatctcgctgttaagttgagggacccctggtgaacttattccataaaaaatctatgggctggccgactgggccttgtcgagtggaagttttgggctagacaatggaggggggttccttggtttgggctagaggggtgcccatgtggtagagatataggggttacaagctatttcgaattttggaccgggttcctgggcaccccctggtcctattgggctccgcccctgcttttacatagtatggttcgttgtttaccactgccgctacagccaataactgcaaatcactgttttgtactgtagcacaagacacaaattactgtgctactctgcctttagcaccgagaggcagagaagctggatctctttaaagagcactatattcttacccaaatgtgctggtaatatacataaagtgctaatatttgctaagagaataatattcgctatagttatgctttgtgtattatttatactt

SEQ ID NO: 26677 - DNA, 1560 bp, Oryza sativa
ggaggttgaatgaggaaattttaagcatgattcaagctaaaaaagttggagagcgatcttcattctattttgcttccactttggaagcttgctgaatgcttcctttgtcattccaaacttgtctttgaattcagccgaagataagtaggtctgcatttagttcaaaatggggtatgtggtcattacctggtctgaggataagtaatacgaagtagctaagtatcgaaaagatcatatattcacctctcgcctggtaacgtcaatttcagtgacaggatcagcagctgtagttatcaggcgatcatatgggtatactgggagcccctcgtcatcttctggttcattttcttttacatcttcattaatagtgagagattcaactctactggtcatggtgttaatgccttcttttgcatcttcctcttgctttggcttctccaactcagatccatcttaatttgtacagaattttacaaacaacaagaaatcattaacccttcctctgtttaaaggcaattttatgttccaagataagtgtatcacataccttttactgatttagggcgatcaaaagaaccagtgagagaagcagttgcagatgacttagacggtgcacttgatgagtcaggtgtggcagattttgggaaagttttttaactacgggtggaggggtggaaagatttctgctgtttgcactttcaaagttagcagccaatgcagtgaatgccggagatcttcccctaacacggacacgttcagggctgaaagacatactcctcgagcgctgagatttgtcttgtacagtgcttctccctgaatatgttggtgttcgtcgctttggtttctggtaacaagttagaaagattgtaaatgcaaaggttccacatccacagataggtctgctaactacagaaaaacacttacagaccacagacttacaactagaaatgttataaataggtggttccatgattgtacacacaaaagataaacagaacactgttgtctagcagaaaacgagtttgcaacaaagaataccatatatggttatttcgacatggcagactatcataagacaactaaagtttgtacatatcttacatccaaagcaggagaacctccaccctttacaatggaaagcttcctctggtatgaattgccatgcatctacaagagaaacaagagtgagtacaacacattgaagatgaaaacaaggagcattatggtgcttctgccaaaaggaacacaaactacagttgttcatcttatgaatattctacttacaagtgactttgctgagtcccaagtgaagaaccttgtgaaaaatgtaggctcacttccttccatgataacaaaaattggtgtgtcgctggatagattttccatcaggaaatcaagcttaacgaatttctgatgcagtattaaaaataatagtcagtgaccaaaagaaaaggagatgccacctaaagtgcttcagcatggaaaaacaaatcattacctcaccaatgtccagagcttgtaatcgcactttgacatctacctggtggccaacccaaacaa

SEQ ID NO: 26678 - DNA, 2200 bp, Oryza sativa
aagggaatagaaaactgctgggaaccagcctgcactagaaattctcaattctgtcattctgggattgggctaagtggagccaaatcatcccaagtttcagttagttatgcaaaacaaagttccaggttatgcacaacagaagacccaggttaatgcaaacaaagagagctaggagaagatgtccgtcaagtcactagtgcttgggatatgagctgtggtctggctatgctctcagtctttgtctagctggtgtcccttgtaggtgctctaggtgttgcgcgtgtcagtctgatctgtctagtttccaggatgctgcatttcctgtctttgttttgttcttttgagctgggctgtgctaagtctgatctatctagttttagtttttaagccgggtgtgtgcgcctcatgcctcatgggaagtttcattaaaccgggtgtaaaagcctttcctctaaaagaagttgcacttggtctgatatataagaaagtctatactcggttcctcaattcttcattggtttaattttcattcctcaatgcaataccaaacggaatccatcccccaactatcaaaaccatgcaaataatatccctatgattgttttgcaagtgattttgagtgtggtggcttgccacatcatccttttttaccatgtcatctgccacgtcctgtgtgttagtcctttctcttcctttttaatagaaaacaaataatgaaaaagaagatgcaaataatatgcctagtagatggatgatctaacaggttcctttgttttatcatttcccctgacatcttcatagtgtactgtggtaaacctttgcagggagtaattactcaagatgttaatgcaatatttgttttccaaaataacaataggaattgatcaagtacaacttcaaaagtgtgtatgccttatcaaggaggattgttccataccttaattatgtctagctgcctctcaactacctcttgatctaatgacgtagtaaggtttccagtccaagtgaatacagtatttccatcatgtaggatgtacgaataggatgaattcaaagacgatgccgcctaatgaaagagcatgatcaagttaccttggaagcaatataatctaattccaaaaggagttcaaacatatctttaggaatgaaaatgtgagaacttacagcatcaacttgaattgcctgcatgttttctggtcctgaaccttgaattcggaagagcgcaagtccatcttccaaataagtgtcatcatcaataccattttcagcaataaatttcttgtatccagagcttagaccaccctataatgaaaaagggaaagaaactaagaattggatgttgtgttcaacctgagctaacagtattttatagaagggaaccttaaacacttggaagctttgaaatatgacgaagaattgaattggttcttttccctcatatagtcgtgtctgcatgtaaccaagaacaattagatacacaaggaagtcatgtctggttcactaatgaaatatggagaaactagtaggttacctggacagcctgaaatttcgcagactcaaccatcttgcttgcaagtgaaatagcagttaccctatcctcctgaatccaaattgaaatattttttaacacctacattttctagtatgcactaacagaacatgtaacaaccgcatgctgttatccaaaatgccacttcttaacagaaacagatagatcattgtggcttccagttcataaatcaaaaggatggaaaacagaagcatatgctgtccatagaaccttctaagttctttcttcattgtcctaaagtccggacttcattgataacttaattaaaaactaattgtgagctataaggtggaaactctaaatacaatcttataactatgaacatgaaatcaaagataaattttacctcaatgctcttcttcccaaaccaacttccaataagacactcctccttgtcatctccagggtacatatattgaaatatgtagcaatcgccagtgtaaaattttgattggtcagcagatggcagaagtatcttgtccttatcatttatgcgccagacctgataacagatatagaaaaaagaaaaatgtgtggacattttagctctcagagacccagaaattgaacatatagagcagaaataaaatcttgacaggaaaacattcttgtaaaaattaaaaaatttag

SEQ ID NO: 26679 - DNA, 8969 bp, Oryza sativa
ccggttcgctttgtggcatcccagatgcgaatgcttttgtcctttgagttggacacaatgatgtcttgcttagcatggaacatcacgcatgacacattattcatgtgtccccgcaaagtatcaacttcccaagccttcgtgtctgtccaaaaaaatagcacatttagattacattaattcaaatacctcaatagcggtttgctgcatatgcatatagttttgtgtttggccagtctagcaatatgcagaagaatgaagtgctatgcaacaagaatgaccacctttcattccaaccaaagtgacaaactagaggtcaggagctagttactaattgagtaattgtgaagcatgtttcttgcattcagcttgttcggtaattactacttctgtgaaagtatgataaattgaagaaaacaaaaggaattcataataaaatcaaatccatagtttgtagtaataatatatggaaggacaaatgaataaaaacacaaatatgcaagcgtttatccatggaaaatggtaatagaaaagtttaaggccttgtagcagtattaccattcattctccatagcttcacttgtcggtcatctgccccggaaacaatgagtggcaatgtggggtgaaatgatgcccagttcaccccacggtcatgcccttccaacacatattttacaactgcatcaacacctccaaacagatctgtgttcatctgggtgagacgcaggatgtcatctgcaggtgacaccgtcttcttcctcaaagcaccaatatcccaaacacggacagtctgatccagtgatgctgacacaaccaggtcctccttgggatggaatgatgcgcacatgacatagtggttatgtccagtcagcacagctacacatgtgcgtgactgccagttccagatccggattgtctggtcatcactagcacttactatccatgggtattcgtggtggaattgcacggtgcgaatatagtcaaggtgcccgtgaagtgtgaagaggcagcggtgtgtcttgtaattccacaccttaatcttgtaatcatcacctgcaatgcatcacagaaatcttagaatagttcagaagttcaaccattccgcatcccaatcatattagtccaccgagcaatacgaccggacaccagtatgacttcgtttcaagtttcaacagatcccaaagtccaggtttcaacaaattccaaaggtccatgatggcaccttgccatcgctaacttgctacttgtatcagattcacactacaaaagctgattctctctggttgagggctacacatcgactcattctacttcctatcatatctcttctacggaaggattgcaaaatcgatggagatcccggtcataaatagaaacaaaatgtcacatgaaggtttcaaactaacaattcaccaaacagttcatcttaagctaagagaatagaaccagcaccagatccaaccaacgaggatcacttgcacaaccaccactgtacacgaaacgcgatctaatcgcaaaccacgtacgcgtggtatctacctcgagtgtcctcattgcaccatgaaatggatcacgcggaaatctaacggccacgcgagacgtcctccaaatccgaggaggaggatccgaccaaacacgcgtcgacgccacacccgaccccgcgagcggcgaaccaccacagcgaaaaaaaaaatgctcgaggcgggcgagatctaggcagggaggaatcgatgtttacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttctctagccgtccccccggcgcgacggcggcggcggcggcgaaacccctcgccgctgaggcgcgcggaggaaagagaggggggagggggggtggtatggcgttgggtggagaggacgaaggtgtttttgagatctcggggtgggaggaggaagaagtggggggagagatctgggtttcggacgcggtggtgaggtggtgggaggcttggccaccgttggattctggagacggggagatctgggccgttggttccggtgtggccgtgttgtcagattggggtagacttgtttaggggtgagtcagcttggtccgtaaggtacctgatgaatactgtagcttcagtacgaaggcagcgtttttgacttgtcagtagcagtagagaaaaaaaaaagtttagggccatttgaatcgcatggttgaaagaaatgtaggaatataaaaaagacaggattctgataagaattgaagtgtaaaacagaggattgcaatatacatgaatggtcgtttgattagagcgcagaaaaaaaacgcatgaatcgaatgagagagatagactcaaaggacattttctaagaggttggagctcttgctaaaattttcctctaaaatccacatgcaatgtgtcattccataggaatttcataggttttggaaagcttcaatcatttgaatcaaagtaccaaatagaaaaatttcctataggatttgaatcctatgaaatttctacataaatcctttgtttcaagaggccttaccttttgtagttatgtcatttatatttaaaaaacaggatatatcatataaaaaattataaccatgctagtagaaaaaaggaatttataaggctggttataaccatggtttatacttatgctagtagaacaaagagtttccatgtcttaaaatgtcacaacagatgcaagcaaacaagcacaaccataatacttgccgattttggcaggtacagtagtataggaatgagcgttggttactgcaattgtttctccgatgaatcaataagtgcattatcgattggaataagataacttaatggacgatccttcccgagtcttcatcaacaaccaagagaaaacgatagacatcagaaaaggttaaaggtggtaaacaacataattccataaatggaaggggacaaaagacctagacagtatatcactatattagatctaatcttgtaaatactttatttgaaaaacaaatctaaaatattcctaaaataaaatagaagggcctcctcaccatcgacaagggtgctaaagacagtagggaagggaagggggactagatgggttgtgaggacgaaagccttcatgaattaaattggtgattcatggtacgctctcgctatgacatattccagtttaccatccaaatctatataatactttatctatagatatatccacctagtttatttgctataaaaaatctagcacatgaagtttaaagtgcatctaggctctaattcaatttcagtaatcaatgactagcgattagagatgactaacacctttgcatataactctttgggcctacatgtcatgtcagtggctagatattatggaacttggtccctaagctttctaaaaatcttgaataggtccttatcttcaaccacaaataagaggagtgtaataagtggcgcgctcagccaagagccaaggcatgcccaggggacctccgtggtcccttcgggtgcagtaggcacatcatagagtggctagaggacgacgggcgacgagctcctgaaaagccgtggccatgatgcttatggtggtgggtaggcagtgctcgggtggtagaacggcaatagctctagcaactacatgcatagggaatagggaaaccgtaagcaggctagggattttctcacttagaagggcttttcccgcacttagtgatggcgggaggtagcagtggtgcttcggcaagatatgaacaatgttggtaggcgcggctattcgggaaggggaaaacgagatcagtgcaacatggggaaaaaggtgatgcacatggttgaaaggtgatctcaccgaggacgttgcgataggctcttgtgcttaccagcaccaatgatggctcctttattcctgacaagagagagagccatgagctccctcaagttggaatagaatggggcgagttgaggaaaaggagtgcaacaggaaggtttatgcgagggttgcaagctcatttcatggcattactctaatatggcgacctcaagccgtgtggtgatggaacgggattgtcgggggtaccgtggtatcagggaggagccaggaggattgatagcttgaaatctttggtcagcattgaaagatttggtcggtttgacttagtcggcacaagagggaccgtatacgttcaacgattagcgagaaagaaatagagtaaattccctgtgtacccctgaaaactcactcaatccctttcatactcctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaaatgttgtgaacattggtatacctatctttatatgaatgctcctcatttttatgacctttttttaaaaaaattaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctcaaagaaatatggtgagagatgagtgttcaaaggcgagtaaaaaaaattctacaaccacattgcataataaaaaaaatcaaataataatttcatataactagactagaacaaagcttaagaggtgaaaggagttttatgctatgatttagtagtcgttgagacctatgttactcaaaattttagactcaatctacggggttttttttttgcccacgggttggtgggtacgggcgtgtaaagaacggaccatacccatgtacctaacggctaagagttttcgcccgtcaatagactcatgggtataagagttagaacatgattagctcctaatagagtaaaaatccgtcgggtgtcgggtcacgggtccccattgacatctttacttccaagtcatcatgcatggaaaaaaaaaaccaaaaataatttagcgcatatgaatttatgtacatcattttgaagttttcactacttcattttcttcttggatgttgcgtcgatgatgaacaaattgaatgaagttaaatttctatttcaatggtagaatttaataagtttctaatccatgttaagctaatcttattgaagtataatattttctataaggtcatcgggctatgtgatgtattttgccaaaagtcttcacagtttatttatgggtgatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaattttgctttgataaaagtatttttccttgcatttcatttgcataaaatgttgttacgtgggtgcatggtttgggattaaagacgtttgatttattatatttgcgtatgctatgttttgattttcatttatatgtaaaataaactattaaaatgagttttaacattttaaggcagctaaatgcgtcccctccccggtccagtccccggcattctcagcggtgacgagggaaagggtacccatcttaggatttattccaattacatcctcctattatcaatctaggatatttctcccatggtgtttcttgaatcaggtttggttaaattcttttgctctttttacatctcttgttggaggttatttcgtttgcaagattcccagttcgccaatgaagcaatcaatggcaccacctttaaggttagggtcaccgatttgctgatttatcaaaggagtgaagatagtggcctgtgttccttgatttctttgtgtgcatgttggagttggttagagttgtctcactatccattgttaataagagattaagcagcaaacaagagactaaaatgtggtaaatttccagtagcatggaaggaatttatccgttcactaatgaatgattaccgcgtctaagagcataggggtttgacgccgaacaaagctaggcctatatttttcagttaggacaatctatatatatttttaacttttctggcatgaacttaatgtgtctaattgtactttgcccccaaaaggcctatgcccaataccttggatgtaaagtgttttttttagtcatttactccctccatctcagaatatagagagttttaacccttgacatggctattaaggagaagggtagaaagacttatttgccatcttaggatagatgatgtgcatgtactgactataattaaaacaaggaatagttaggtaatatgggtagcttagtagaaaaaatacaacctattactaatactattttgctatatttgagacaaatcttgaattctataagttgttatatgctacatttgagataacttttgaattttatatttgagataacttttgaattctatatgaggttatattttagtacgaagggagtatgggaaaatatgtaatgtagtagaaacctaaaaactacagttggattcaaaaaatagcacccgagtgtaaattttttactcttaatgacgtgaaaaaatctcatacatttattttttttatttttagatcaatgataattataagtttctattacatatgtgcatttttaggtgcaacggtagtttgctgggggagaattgctgttttttttttccagtacccaagtttacactgcgccaacaatacaagggaaatcttttcccagcatttgggtaaagttctctctcctacttgggagcaccggatttttttttctcacctatataactttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgctttcaagcacaagcctcatatgaactctctgaagct

SEQ ID NO: 26680 - DNA, 43115 bp, Oryza sativa
ggtggtgtttggttagaggagatcgcacggagggggactgaccgctctgtcggtttttttggtaattttgggtgcgtctgagccaaccgttcgggcaagagctcgtaaaccctccctgccctaaaaatattttcagctcactgtactaaaaataaatttatttttaataattattatattagagtagagtactagacagatctatattgtttattggaatttaacgaaatagggtaatctagttcttttgtttttttaaagtatggaatagataaaattgaatttattttaggacggtggaggtagtacttcggttcaaaactactccaatgctatggctcatattgatatatgaattttgaactagtaaacaattgaaatgttacgtaagcatgatcaatagataatatgcccaatagtagcatgaccccgcctcctttccttcacagcgttcggcgtcctatgcatccaaagtcattgtgttttggcggtggaatacataagtaaacaataagtaaacaatatgttagtatttagttatgcaaaacattgttgccaagacttactcaactcacgactttcacctgcttccggtgataattaccactatcatataaatgggagagtagagtaccaagatatagggattagctagcagatacggtttatttattacctttacttgataaaacatgagaggtgtaccaccttttgcctaaagtaaagaattcaaacgtttgcgacccaatttaatagcgccagggatgatttaaacacatccttagtggaacaacggcttcactcctaaaatgaaatcattaagaacccacgctcaatctctccacattgttagtccctcatgcagctttgaattaaatatatgatgtggcctcgctcattttttaagggttgtgtatgggctcttccctatatccgcaaagagtttagtttaaaactattgtgtctgtttgatcctaagctgcaaatgagtggaatttgatgttgaatttcaatcataaacttttgagagcaggaggttttgcctcaactcaatccatgaatgttatttcatttccgctgaattcaactcagtcttcatcctaccctagagttatctctcaaagttgaagctaggaggtatttgatttattggatttcgagccccttttcttgctccttgccattagcgcaaccctttttattttcttagctttatttgaagtatggtttgttacctgaaaagatactcatcatattgctgcggtacattgggcatattagcgggcctattccatcttagtatccgtccacctcaacgtctatacaaaggattacgtatggacaatattgaaactgtactttccagtagtatcgctgctgtttttttgcagctttcgtagttgccggaactatgtgatatgggtcagctctcgcaagcttattagagcattgaattgagctctactaagagtaagatggcttttattctactaaatccaaagaatgctggctagggtgacgctcgtgcttctttcgagtaaggcaaacttagtaaggggacttgtcttgtatagtgggcagcggatctcttctgttcagttctttccctgctacgctactttgtgatgtatcctgcctgccatcacttcctatcgtcaagtaagctgattgagtgattccaggtggtagtcatccttgtaatacctcatgaagaagcaaggctgcgctctgcgcatattgttcttcagatcgattgtgtcacaaggcagacagatagactcctttcccgctgctaagggagagcaagaaactaaatcaaatgattgtttttttcaccagcgccctttttttgcgggtactaagagtcctctcactaccaatctgcagacatcatcatttggttgggtcttgccggtatcaacatataataagcactcttatcaataaattaggttaggtattgtgcggttacctaaagatacctgctcaacgtagatgcaggggtagaaaggctgattcaaatttagcgccaactcttttgtagtgaccacagagtcccgggttgctttggtgcacccaacccgtaagtattgtgttgtacaactctcccccaacgtagattggtggcaatcaaccatgaacaaagcactacggtattgactcccaactgaatcttctatacctttaaaaataagcaaccataaaaccatcctctcagcataacaatctataataggcagataaaaaaatatctagttaaggtaatcaacatatcaaactgttatatttatctcggaatgaatacctcaatactatacaattaccacatcatgcatttgatatatacataggcaaaacaatacatgtgtaaataccaggtgaaaaatgggcacgcatagcactcttgtagtctcagtgaaatctgactacggtcaatatgaaatagattatgaagcagattatttctacggattatctacttcattataggaataaattaaatattttaataaataaacctaacaaaatcaagtggtctcattaatataataaaagaaagttttggtagaaactgtacttttttagtgtggagcaaataatcccattcaacaatccagtaaataattaaaaacaaagcctcaaatccaaggttagtcataacaagagaatgaaccattcaaattttcaaaaccatctgtgtaaataagcatatgtactgcattattataccaataaaattgctatggtagtccctggcaaactaatttttgttggaccaaatgcaacgggccggtaagccaaacatgtagatttatgcacctgtttttatctccttgggacttttctttaccaaagaagaggacaactgatccatttcttatcctcaataactgcaaaattcactaatctataaactgttcttgcccgagcacaatccacacacgtctggattgaaatttacaacactaagcgtaatttgttaacttggtcattggcaactgttacattcatagttactaatgaatgtaactaacacgacgccgaatgtttacatgagtgaaacaaacattggtacataacgtccgagcatagcatttgcatgagctgatcagaagtcctcaagcatgtatcaagtgtaacaacagcctcgaggcaaacaaaaatcaagggaaatggagaaaaagtgaaacaaaaactcaaccatgtataacactacttattccttacaatcagtaaacatcctggtaaaatatatcatagcgaagtcttaagagagactagaaagaatataagggagcatatctaccgacgcttatctcgactgcgtaggggagcagaggaggcctgaagcatctgcaccaaccacggcaagctcacatatggtacaaagctgcccttcgatcgaaggaacaaaccgggagccacagtacgggcaggaaacatccttctggccacggtagattggaacatacgtggcgccacagacaacaaatggatttctgtagtcatagttcagctcagagctatccttcttgccactgcactgctgctgcacctgtcgagccctccttgcttgggcctcattagggttgttctccagaagcatccttgcaaagtgctctgcagtagcgaagttcttttgcttgtagcacagacccatagcgcttccaagcacaagcctcatatgaactctctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacgttaggacttgcagactcgctccaacctttctcaacagcgattggtattatgggggcagttgcaagtgcacgaagatatgagtggctgcccatgtgcagatcaacaaacaggggcttgaggggagcaaagttttttatgcccaactggcggctaagcaacctcattgcagtgtcaaagttccctgctgcggcatgctccccagcaagagaagatttctgagtccaaatcaggctgacaggcatgcctggtggaggagcaacgaagaccgctgagcgtgcattgccagcattttttggggtctctgcttcaggcagaagttccagatcttctaggtcccaaccaccttcctcgccatcctcctcatttgcttcaccctcctcagcatcaaaaccgtcaccaccattcgccatcgcttcgcttgcatcaacaatatccaggtcctcatcaccccagtcagcaccagcagcttcatcgtcttcctcaagttcagccttcccagtagcatccagtccaccctcaaagataccatgcatcacccgaagcaatggccaatcaccactggctgtaagaggagcaggggggatcaaaagagagcgagcttttccttcaggaagagaaggaatattttcacccagctcagcggcaagcctatcagcaatttctgtgagcccatgggtggtagcagtaatataagcaagaggtagctgtccagcattctctaggatctcaactctcttcaacgcatcaccaagatacagagcattgtggaattgacccatcaggttattgttctgtccagcaattttgcacatgaaacccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagaattaacctttgctgcagatcaaagatggtcactcggtcttcggctttgcacagcaagttaccagtcccagcataataaattgcatccgtggcaataggaagagggcttttctttacgatttcattcttaagattcttcaccaaaacttgattgctactcttctcaaggactgcaaacctgttgcgtgccacgaaaacagctgacccaccagctcccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgctcccgcctgaacgtttgaataccggttcgctttgtggcatcccagatgcgaatgcttttgtcctctgagttggacactatgatgtcttgctttgcatggaacatcacacaggacacgttattcatgtgcccccgcaaagtatcaacttcccaagccttggtgtctgtcaaaaaacagcacatttagattgcatcacctattatccctttaaataatgcaatggtgatagtggaagtgaatgttccacaccccacaaagtttgcagcacatcttttttacttccttgaagttctttagtttgttaatatcttattctcatctctaaatcaagtttatcacagaaaggtctacggtggtaaaactgacacatatatatgtagagtaatgtaaaaatcattagtgctacttgtacctagaataacaaagatgaagggtgtgttgaatgaaaaagtcataattcatttgtttcaaacaatattagcacatgtacaattcatcttgcctgttgcaagtagcaatgcatggttatttagctagttcaaatattttgattgctggcatgcatatactttttattttttttaagtttgaacaatatacagaaaagtaaagtgctatacagcaacaataaccacctttagtcctactggcactagtttactaactggaaacatctcttgcattctgcttgtttgctgacaagttagttcagattaatgtagacatgggggaaacgctaattagttcttctgtcaaagaaagacaaatcaaggaacacaaaataattcataataaaagcagatgcataattctgtagctctgttctatgaaaaatgatggatgcaaacaaaaataatgaagttgtttatctaaggaaaaaaaaggatgtagtagcagtattaccattcattctccatatcttcacttgccgatcatctgccccagaaacaattagtggcaacgtgggatgaaatgaagcccagttgaccccacgatcatgcccttccaacacatattttacaaccgcgtcaacacctccaaacagatctgtgttcatctgggtgagacgcaggatgtcatccgcaggtgacactgacttcttcctcaaagcactaatatcccagacacggacagtctgatcaagagatgctgaaacaaccagatcctccttagggtggaaagatgcacacatgacataatggttatgcccagtgagcacagccacacatgtgcgtgactgccagttccagatccggattgtctggtcatcactggcacttacgatccacgggcactcgtggtggaattgcaccgtgcgaatgtagtcaaggtggccatgaagcgtgaagaggcaacggtgtgtcttgtaattccataccttaatcttgtaatcatcacctgcaatgcatcacggaaaacttagaagagttcaggagttgttcgatcttattttatgacagttccaaatcatatgggccactgttatgccaacaatacagatgaaactggtgtgtgacttagtttcaagttccaacaatccaaatgttccatgattgccaaccccaccattgctatggtatcagaaatacaaccatggaagctgctactcttcagttaaagctatagatcgactctcatgtttgaaaagattgtaaaatcgatggagatcctgccatcctgctggtcataaacatgaaccaaatggcccctgaaggttacaaaccaacaatccaccgaacagttcagcgtaagcagatatgataaagctcgcaagcactagatccgactaacccaacccaccaaccaggatccttgacaaccaaccaccactccaaatcaaacgcgatctaatcggatcacagagacaactagaggcctcgagacgtcctccgatccagggcaggatccgagcgaaacaagcaacacgccacgaagcccatgcccgccgccccgcgagggagagagatctagcgggtctactcacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgcttggccctcccgcccctgatcgtcgtctccggcgacggcgggcgcggcggcggaggcgaacccctagccccggaggcggagacgagcggaggagaggggaggcgctggatctggggcggggtggagggaggagagagagagagaggatggcatggttgtgagattgccacttaagcagtcacttccgatcttagccgttcaaggtgcaatcaacggcggatgcatttccctgttttcctaaacaccagaaccgagagaacggacaatatgccactctatacgtggggattcgataaaatgccactcaatatgatgcaccggataaaatgtcactcagtatgttggtatcaggtgaaataccactttgaacctatgttgatttatttttggatgaaaagaatgcttgttgtatcaatcaaattggccagacgcccattttgatttgatatcagcgtagttggcccattttgatttgatattagtgtagttggcccattttgatttgatattattgtagttcaaccggctaaatttcttgtggtaaaaccaaccccctaagtttaagtcctagtcttgacgttagtgcttataattatggctagttattattttccagtgatagataatgaacccgccaacaatgaaatgctcgtggtgacttcgtcaatcttaccgacccaatctttcggaggtgctcatagaggtaaggtgagtgccgtgtgcacgttataaatgcttgtgtttgtactgtgtttcaaaaaaatatatgccttaccaaattattgataccttaaaagtactttagttcctattaaaaagcactttggttagtgtttggtttgctattaaagtgttccaataacacatgtctatattgcttttttaaaaaagttagtgctcgtagtgaacttgccacatcacctactctcattataaattttacaaaataccctttattaaatgtattaatattaagaaacaatcaaatctaaatgaatatctgtcaggattacggataagacatatctcgtatcctacaattaaccaagtatattagatcggtatacctcatatcccaagatatgtttctatatgcgataaggacatatataaaatattataggaaatatccttatgagctggagactactagagtcctactcgggaaggactaggactattctatatcgtgcagggttcattgtttccgagttcaacttggagactaaggcaatccacggtataaaaggcatacccctggaggggttctggattatcgaatcatagcgccaacacgccgaccatagttttcgaagccgaaggacccaagctgaagccgccgggagatctcatcgaacaatctcgactagggtctcgtcggtctcaacgagttcgtatgttctctctgtattctgtggtcttccatatcaatcccatataaactgaattagggttattattttacgaggggccttaaccaatataatcattgtattttgtctattttaatgtcgtatcgtatagatcatcgtaccaacataccctaataccctatttatctggtctacgggtatcccccgttgacaatatccatatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaatcaattacataaaaacgataaccatcaatacccttttacagtatcatatgtcatacactacccgaattcccgaaaccatgttcaacgttcctttccattcagacagatccagcaggctcagcctcctctcggttgcacagcacaacactaggcataaaatctcatcatcttcttctcgttttccacacgcatgcttttcaaactgctaaacggtgttttttttaaaaaaagcttcaatacgaaagttgcttaaaaaatcatattgattcgttttttaaaaaattaacaaatacttaattaaccacacgctaatggacggttcgatgaacgcatcaggttgggaagccaggcttccgaacgcagcctaatccagcggcggagtactgcccaggagaagcgttctgaacacatgccccctcctgaaacggcaggaacatggacgtgggcacgtaacagcctgtgaatgcagccaaacaccgctgaaaattcccaacaaacttcgcccgtttccaaaggctgctacgacttcaccataaacaaaagtcacctacccacagcaagaagcactcactgatgactaatccctgagagaacttatcagctaaacacaatcaagtagtgtaatcaacagctggaacagattttgcccagcactccatccatccgttccgaaataaactacactaaaataaataatgtgttatttatatgacagtaccttgtcgcaaaataaagatatttctccacatatctcctcctatcaaccagtcacaaccattttctttcacccatttttatcttcttaaccaattacacccttcctctaatcattcttacatattttcttaatatctatattaaccctataaatacttattttttgaaatagagaaagtataacaaatattgatatatccttagtttaatttattttaaaacggagatatatcttagtttttttttttgcgtgacagcctgacaggcaagcgtgagacagaccccgtgaatgtgtgatgccccccgagtgcccagggaccctacctacctccacctgcgacagctgctgctgctgcgtgaaggcacgcccatgacgaacctaggacctcgtcttcagtgtcgccatcacccggcagcacatgagcacacaacaactttgatcatcatcatcaccattgttatgcatcttatccggtggagattggagaaactgattgagatcctcctcgttgtcgtcgtggatggaaggaggccttctttctttctccgcgtcagcaggctgatcgctcagtttcggtccaaaagcaaaagagagagagacatcgcattctcagattctccgcatcgtctgtggtacaggaaatttgcgtggaaaaattggtcgccgagcaggtgagcgagcgagtgaccgcgatttcggtcgtgttcttgtccgtaagtctgtccgaatttatcagattgatgctgcagattgcgttcaggtctttcgacagtccaactgtaacatccgcggttcatcacactgtaacttcacacgccaacagctcagacatttctaccaggagacgaaacgaatagattgacagctcaagacacgctaagcaacgatattggaacacttcatcaacaaaactcgggtcacctttggaagctagtaactgtacaggattttcaccggaactagttcaattcccgtgagaaaatcctccgaaaatccttattccataggagggatcaagctgaagacgatgggcattgatcatccttatggatcaagctgaagacaatgagcattgaccatcatcaattttgcagcaggaacaacagcaaacaacagggaagcagtgagtcctttgcagttcttgcttgaaatcaaccactacaatgtcaaaagatctaggcagaagctaaaatgatcaatgatcaatacagtcatacactgaaacaagaagcacaaacccggacagtatctcccccgaatcaaaacgatcaactaaaaattgcattgcaatttctgggcgtgcgtgacaacagatacaggatacaccaccgggaagcaaaggctgctccggcgacaaaagggtagcagcaacaccacgaactgaaaacacaccacctccggcggcaaccggcaatcgccgtcgtcgtcgccgtcatcgtcatcgtccagcacctacacacgctcctccctgaattagaacaacacgaacggagaaagaactccacatgaaacaacagcagcagcagcaggaaacttgagtgaaatgttagcgattcctctttcggccttgggcttgggcgtcgtcgtctcacacgaagccgacctcggcgaactgcgggcgcggcttggccgtcgcgccggggcgcgtcggcggcggcggcaccatcccttccgggagagggttcttgcgcgggcgccctcgcgggcgtgggatcttgggcggcgcgtgcgggtcccgcggcttgggcgggcggccacgccggcgcggcacggcgggggcggcggcggcgacggagccgtcgaccggcgcaccgacggggacggggacgggtgcggcggcggcgggtacggccgggtagcccggggggcgcaccttcgggggacggccgcggcctcgcttgggcggaggaggcggcggtaagtcgtcggccgagtcatcatcggcgaggaactcctcctcctcctcctcctcctccgccaccgccgccgccgccgccggatccgccggcggcggcggcggaggagtcgggcggagcgcgtacttcccacccgcgacggcgacgagctccccggcggctgacatccgggagaggtgcgccgcgacgagcgcggggtgcgacggcgggaggaggccgccgccgccgcgggccgcctcgatgcggcgcgcgatggcggcctggctagacccgttctcctccgccagcgacgcgatcgcctccacgatcatctgcagcaaagagaaggagaagacaacccaagaaacccggtcaattccgccacagatctgggcatctggccaggaacagctagggtttagaaagagagcgtgcctcggggtaggaggggaggacgaggtcggcggcgcggtggccagtggaagtggaggtggccatgcctggctggctggctggctggctccctccctctcgtagggttggggtggcgggggcgaggggcgctgtctccttccggcgttggtgctgcgctgtgcgcgtgtgggatttggggccgccgcgacgcggatctgagaggagaaggggggttgtggttgtggtcttgtggatgtgggggggaatggaatgcaagtacagtttagacaaggaatctgtcgggtggtaccgggccggacgaccggtcgcggctgcacgctctactcctcctgtgactccggtccggtttagggggtgtttgggataggaacttcttttttttttagagagagagagagagagtttagcccctctctcccaaacagccccttagtctattcgcaagcttaaattctactccctatgtactaaaaaaaactcaatttaaaagagagaaaaaaacagctaatgagaagctcctttgtcgtgcagtcttgtacctagctttgatcgcttgtcttatttattttttaaaaaaattaaaaacataagtcatgcataaagtactattcatattttattatcttataataataaaaatactaattataaaaagttaggtacggaaacttatggttgcatttaaaatatgacggatgtagtagttggtaataatttggataagctaggaaactcagcttcttctagtttctaattcattttatgaattctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcggagggagcgtgcctgctcattggcgacgtcacgggcgcgcagctcccggatctcgtcctcccacctctccaccctctcctctccttgtggatcctgcacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggaggatgcgctgcacgtgctcctccgtctccgccgacgccgccaccacctcctcctcctcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatcaaaaatcaaatgcgcctcaacaactgaactgattgagacagtagatgaaatggaacaagtcgatcggaacggaatcgcgtggccttggttcgatcaaagcaacgaacgcagctgacgaccgaatccaatcccccagaacgaacgcagctgcatggactcgcggaccacgaccgccgccgcctctgctccatcgattcccgggtgcactcgccgccaacacctcacccgccgccaaccacgaccgcgcggccagcccagccccgcgtgagcgccgcatccacgaccgcctgccgctggtctcccgcgcggtccgccgcctgcgccatcctttccccatgccggagagtgtgatcggggaggacgagcccgccaccgcgttcacccgccgccgccgccttgcccttccgccaccctccccttctcccgtgctgcatcgtcggccgtcggagagaagagtgtgtgagagagagaaacagcagaaaagggagaggagggaaaagatattctgacatgtgggacccacgtgggtcccacgctaactcagccaccacgtaggccaaatccgggatcaaaaccgccgaagcacctctggttctgtacagttaagagaccctgtatatctggttttgcggttaagatgtttttttatcccgttgacaagttgagggaccttcggtgtacttttcccaaaaggattcggcgagaaaaacaagagttcgtaggcccatcagcccatcccatgagcccacctagaaaaaaaaaaccctaaaacacgcctgccgttttgatcggcccaagccaccatcgccagccaaccacagactagaggagaaggaacacttcgccggcgacggcggcggcggcggcatggccttctggcaggcgcgggacttcctcttctgcggcgtgtgcggcaccctcctcaaattcgactccgtccgctccgcctcctgccccctctgcggcttcaagcgcaaggccaaaggtcgtcgtcttccccatctctctccctgcaaagccctgggctgtgttcttcttgcggctgatgccttcgttctctttttttacggcgcagatatcgaagggaaggagacgcggtacacggtcacggctgaggtgcggccgattgctctaccctctagctcgcgcgaaaccctgggctcgtctgtttcagtcgcgaccgattttgtttcccctcaagtatctaaaatccataatgcgattcattcagtgtagtaatcctaggagatatagtttagtttgatttacgcgaggagtatatatggttgtgcggtggagcaatccagtcttgtggtttaggtaaaaggacggtttcactgtgtcgtgcttcagtatcgtatttcatatagaggaatggcttggtgattattgaatctacatggcagtgcactttagtagatttttagttttacaaatatccatgctgccttccttgggataatgcaatgcatctcttgggagctactccctctgttccaaaatataaggatttctaggttgtttagcaagtactctactaagattaggtcaaaagattttttttttctttattcattgcagttgtcaatttttgaactttgattttcttagattcccttctgaagcatctgattggctctgcgatcattgaagtgatgggaatcagtgcagaaatgcttatattgtggtacaacatttgaatcctagaaatccttatattttgaaacggagggagtattggtctgagattttattttatgtgctgagatgactcaaatggcaatatcctcatgctttcacatgcatgaatcaactgtggtaatggaatagtatgagttgtaggcaaacatcttatggagcagcaaggtaagatgtatagtgattttctggcttggcatttgtaggctactctgagtctctgattaagtcctatgctccatacttgtacacttctagtacttaacaaagacatagcacctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtcaccttagaatgagctttttgatcacttctacgattgtggtctaaaaaatggccatgctttgacatgacaagtgattttgaaatattttttttatgcctttgcttgaattatgacaagtaatggtgtgttcgggagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccaattcctggtctaatggtctatatgaatttctggctatcttgttcttgagctcgagactgcagcttgtttggttcacgttctggttgctcatgccgtgccgagcactcgtgctacctccgtcccaaaataagtgcagccattgatattcgtgcccaatatttgaccgtccgtcttatttgaaaattttaaaaatatttagtcacaaagtactattcatgttttatcatctaatagcaataaaaatactaattataaaaaaaatttaaataaggcaaacggttaaacattaaacgtgaatagtataaaattgcacttattttggaacggagggagtagtattagctaaagctgattgtggtaaagagccaaagaggtcagatgagcagtcatgctcatgcgtgatcagaattcagaaggatttgaaatcctttgctcagtttgttccccttttcccaactcctatttctcgttttccgcgcgcacgcttttcaaactgctattttggtgcgttttttttaaaagtttctatatgaaagttgtttaaaaaaaatcatattattctatttttttaaaaaaactaataactaaataatcacgtgctaattgattgctatgtttttcgcgcggaggagtttggttcccaaccatccgaaacgaacacaaggtccgcaaaatgaacacttgtacactaaaattttggcgaggcatactcatttcagattgccgtagggatgcgaaatgcatcgcgagacccagcatttgtgtacgtgtatgagaatctcctacgtggatggtcactgtgaaaggccttagaggcaaggggttgtatgtcagttttttacttgcaacgtttaaccacttgttttatttaaattctttttgcaaatataaaaaacgaaaaattgtgcttaaagtactttagataatcaagtaagtcacaaataaaataattaataatttcaaaaaaatttaaataagacaagttgtcaaacgttgcaagcaaaaactcaaaatcccttatattattatatgacagagggagtagtagcaaacctacattatacatattacctcataatttattggttgttaacaggaatgaaattagacgtaatagccacctccactgcaaaacttaggcattcaccattctctacgagaaaagaactcaagaccgcgcagtctcccgagttccctcgattggtaaagatacagtgaatccattgactaaccaagcgaaccaaacagagcagtatacttgccccgagaaaatttgagcactgctatttaaccagatttatacccagtgaatggtattttgaagtgttgatagttccgagtacagggatacctccgagatgacaggaacttcattcggtcattcccaatcacatgccacaatgaaaaattgctcagaccatctacatcttcaagggttctatttgcatacagtaaccttgaccaaatcttggtggcacccaaggccgatgaagtgcggtaagagaagggaaaaaaacagcgctcctaggtgacgcattccaacttatggtcaaggatgtttcatcgatgatgacacgggaattgttcgaaaacaagcaacatcaaaactgtactcggctccgcgaaatgtaggaacaacctcaataggaacaagcccatgcctcacactttcatctgcaacatttgtagttactactggattaaaccatgaaacagcatcacaatatgacatttgactgctcatagaagaactggaaatacttacatgtacaagatctacaccacgcgagcaccttgtaaattgtttggttacttcaaatgaataaattccgatataacacgaactgctacgtctcagatttcgttggtggatcatccttcaatcctttggtgagcaaatcgtaattgatagagacaagttgtgatagattctgcagcaaaagaagttagaacggtgtgcagaatataggcacaaatgggctaacaataagttttctacccctacttttaaggattgatactgtcaatgaaacgtgacaatcacaaatttaatgagaataaaaaagaatatgtatttgttttgttggactgctagacactaagaactttggtttgtctttgtcgacactttgcccaattccttttttccactcattgtctcgctggcccacatgtcagtgagccatcagtgataaaatattcagtggatttttagattatgtatcacaaggatctaggtgctattttataatgaacattgtactatcgtttactgtgtggaacaattttgccacattcaagggaatcatcaaactacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaaccctcaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatattctcaagagatctgaacgggagctttgcatgcttaatgaaagaactttactcaacgtcacataaatggcagagaaatattcagtacatgaaagtctgatacctgggggtgttctgcgttgaatggaggtattccaacaattaattcaaaaagtataacacccacagaccaccaatcagcactagtacctgcaaggacaatcagtactcaagagagtcaaaacgagaagacaatgcagaggttgaaagaaaactatgtcgggcattttaccatgtcctgtccccaaaaggatttccggtgctaaataatcaggagttccgacagcagagcgcttttgtctccgtgctcggtgatccatttcctcaaattcgctcatctgaggttcatcatctccatacaacgaagacccgctaacagcaggaccagatagatcatccgtgctgttgatcagaccaaccttggacaacccaaaatctgtcaactggagaattaagattgataagcaggacatatagaaggcattaaaaaggaacatattcgaaaaagaacgaaaacaatatttattgctgaattacaggttaaatgaaatgaaaactcagaaggaaatatgtgtagcattatcatcaattcattaagatatggattcacttaattagaaaagagctagctgaaatcagcatatatttgatttatgtggaaaccaacatgtcatgacatgaaagtttttatgcattgcctgattgtcatgtggggacgtcactactcactaagtccggcgccggcgacgacagcaagatacggaacagtagtttgttagcatcctttttcttagctaaattggtttgttagtttagccctatgatttgttatgatcttatctcttagatgggtatattaagctgtaaggaagttgattaatgcaagcagaatttgagatcaatctcatttcattgttcctgcctcaagggcgcgtcgcggatcacggcaccgccgcgccgtcgaggtccagggccacgtccgatcacctctttcaaatacaatcttcgccgagttcctccttccaatttgctaactcgtgacattgatacaacacagtttgaaacctcaaaaagtttcaaaactccaaaaactgattctcctcagaactctcataggatatgtgtttattttatctctcactagatgatgccattgtggcaattgctatgaactgctacatcactatctcatttggttgctggaaccaaaaataggaatatatcttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtcaagcccccaaactattgctttacatcttagagctatcatgctgagcagaggcaaggtgttgtgtgctcagcaaaaccaaaattactataccaatttatcattacttccttttttgtgaggagtcaattcatcattcatgtgaactaaagtcacttcaatctaaaacctatgatggtcaagttgtcacaagtaaagcatgaacatgatgggccgctccactgtcattctgatcccatttttataagtaagctatgactatcaaggagactaatgcaggtaaaaataactacttagagtccaatatcatgtccagtctacaccatagtctagaaaacaaaaactaccaaaccaaacaggcaaacacaccatcaaaattttgccactaccaaaactttggcattgcccatatatttgtctcttgttggcacaaattggcaccaaaccaaacctaccaactctaccctaccaaaatgtgatagtgccaaaagttgccaaagatacggcattaccaaacttttggtagggtatcgaaccaaaatgtgatagtgccaaaacagcataatgatttaacgggagcaactaaatggatcccattggaaccgactccatattagttaactttttaaaagcaaacagtcatataattttaacatatcctgtaatcacataagttacttatctaacaagacgcagatttgattaaaaaacaagggatgcctaactaatgaaatcgagtgcagtttctttctcgaatgaattttagaacaagtgatataattcgtaacattgaccacatgtaccaaatgaaccagcggaacaagtggtacagccaggtttttgtagtatggatagtgtactacagtactataaatatgaagaggtgtactacaaatatgaagatgtgtactataaacatcaaggtgttaatcttttttgtggtcaactagtcaaactgggagcaaattaaaaaagcaaacgcgagaaataccatctctctaatcttccttctctgaacattgaaggtccacaggtatttcctttcttttgcaaaagttttcaatccaataatttgaccatgtcatgttgatcacaaggggtccttgataataaataatgaatgacttccagctggtggttctcatagaaatgtgttgtttagaaaggtatgcataaatgtacgaaaaacctcaaggccctttctaaagtatcattgcaataatatcacaatggcaggggttatcaactgaacaaaactaccgccgagtatcgacaagaacaaatattcttgagtgtgttttattgagttttggggaagaagactggcaagtcaacatatttacatcaaaagcaatttcctttccccttttttgcatgctaaaattctggtttgcgtctgaaagatagtcatatagcaatatttttggtttttggtcaagaatgcctacaacattacaggtacaaccaaggaaagcaagtctgggtacataagggaacaaatatatggcaacaaatacctttatagcaaagaggtctcctgtagttcttttcttggccaagaaaacacgtccaaatgctccacggctgataggtttaatgatttcgaagtcatcaatcgaagtacgatccttgactgggtgaacaggactagctcgtaagctacggacaacatcatcttcttcatccattacagtactcgctgaatcaactttgtccatatcaaccgaatcacaaagcagtaggtacttctccctaagaaattatataaatgtgaagggaaattacaaatggaaactaatataagtgctaaaagtgacctgcaagaattattttcatgtgcttatttagtataatgtcaactaagataagccacttgtgtagtgaactcagcagagactcaccggtggagtttttctatacgtgtgccaaatgtctgcaccgtgagagcctcatgcttcctacgattgacaatttcttgcagatcttctatgcaggtaaccaatagggagagtgccctttcttcatctagaggagtagttgcaatgcaccgcgcaatatcagcaagttcaacaatctgcacagattgaaggacactgttaatcagcacttcttgcattatattacattacaaaatcatttactactggtagatgatgcatagtgatcctaacctagattattatatggtaaataccacactgaggaccagtgtgaaggggggagtccgcttggaaagggaggtaaacatgacaggagtgaactttttaatctttcttcttgcttaattcttaaaagaaaacaaatccccttgagctcccaaaggtgcagctaagacattggagatagtagatgccatctaatcagcaccatctctaggtatacttggtaacaaagcaaactaaccaactaacagcatctctaatgaagggcttgattggtatagcttgctgcagctgcagctgtaactacagtaccaataacaggttttgtgatgaagctgctatagtgctgcggctgtgcagcagcagcaaagctgaaccaatccggcccgacatctaacgtgtggcagtggcagctaagcccacaatcatacatggcacattcgttccagccacccaaccatcatatatacgcatgacacagtggttgattggaaaaatagtggcattattaccattccttttcaacaaacgtattctgcacaagagaaactaaattttcataaacaaacaaaatattttaccatggccatagctttgctcactttgcacattgtaccttgtacaaaaataaacaccgactattttctatagtttagcctagcaaaataatcaactatctaatatatgtatgtgtgattgagagagcttacctgaggaagatcatcgctctcattaattgcacttcggccagctaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttggtacatcacttttgctgcctctggttgtagtgtcatcacctggttgagccaatatctgcctatcagcagattgtatgatcttatcacgttgatccataacaacttcatcctccgcaaagccactctctttgtgaaattgaagcaatcttgtacatctggtaaggataaaaagcatccgagtgtacagtttcttcagcacacccattgggagctcctgacgatgatcatctaaatcttgcactatgccttcacattgaagccaaaactcccccggtgtcattacacagcagctacgtgcaagtatgagcaaatcttccaaagtttccttccactcaggatgagaatctgcgtacttttccattacaccaaccaagtctcctgcaaatactgccaaatctgaatttacctcctcctttgctttctcaaatctcacctgaataacttttaacacctcctgtgttgatgacagaaaacaagattaattttgctccataaatagcaatatgaaggtcattaatcactatccacgaagaccatgaattgagaataccttcaagttgtaaatgccccgaggcttccaaaaagggaatggtcggacccccttggagttcaactcatgcgaaaaactttttatatctgcagggactctcttccttggagcactggtagcctgcatgatggccttaaagcgtggagattccgattcctttggtgtttcacagggatcatatgcacactgtggattaagatgacagtacagataggaggagtaagaaaagagcaaaagatggttttgtcattgcttgtttaatttaaaaatgtgaaatgggcttgtagaagcatcagtaccacattatctggtatgtgagttggagtcctcaaatctccagaatggttccgcaatgcattcggtttaactgtgtatgagatagattgggcacacacatatcagattttcaagttacaaaaagacacacagattatacattgttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgccgccgacgccccgcccgcgcccccatcccgaagctgcgccgcggcggccttcctcccgtccgccgacgggctcgacgaggccgacgcaggcgccgcccccgcgccgcccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccgcgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccccaaggagagagagagagagagagggagagcgtggtagtggggacaaggccgcagatgtagagagaggagagaggagaggagccgaggaggaggaggactcggccggtcggtcggggcgcgcggcgcgtgctctccctcctcatccccttcccttgcggctcacggctcgggcctctgggtgggacggtacgagagagagaccgcggcttgactggggcagtagtgggtcagctacagtgctactggctatgctaatgctacagcagctccactggggtcagcgagggagtgtggtggctttggtgggccggaggagagggggttcgttgcagcggggaaataagtccactttgactcccttcggccttgtttggtttggagggagttgaaggggactggagaggtttgaggagaattattccacatcacaataggtgtagaataaatgtttttggcttggttatcaggttgggtaatgaaagttgtctgttgtaaaaaaaaagccgtggaataaatcacttccaatctctcactcttatgcattaaccgaacatggacttaactagtgaccaaatctgattcgtatccttgaaacataatacaggatatctcgacccccaactattaaaacaggtgcagtttaactctctcggcagttttggagggcgttttcactaacgtggtagtattgacctagtctgtggcgtcgacatggcgctttggttctattataattaaaaaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaaaggagaaatacatctaggtaaccttgtaaacatgaatagaaaataaatgatctttgtagatatggcttgcataaatcactctaaaatctttgccatttctctgtaaaaatgatctataacatgtgcattgatgcaattgctatcttcttggaacaaaattggtctttgataagcttgagaaaacaattaggacttgattttttttctttgatatttaccaactcaattctgtcaagagttgagcataatgaaatttattcccttccataatatcagaggttatactagattctagatatgctagattctgcatggatagtttggttaggccatgtttatttcaaggtgaaaagtttttaagtgtcatatcatatatacgaacacatatttaaagtattaaacatagtataataacaaaacaaattacagattccgtctgtaaactgcaagacgaatttattaagcctaattaatccgccactagtaaatgtttactgtagcaccacattgctaaattatggcgcagttaggcttaaaaaattcgtctcgcaatttacacgcaatctgtgtaattattattttttctatatttaatactccatatatgtgtccaaaattcgatatgatagggtgaaaagtttttctttgtaaactaaacagggccttagccaagctctgtggatttggttgcccgatggccaataatgaagcccataagtaaggccatgtttagatcatttagtccctggatattaaacttgtcccttactgttttgatctaggaacttcagtaaaaaggactaaaagcacgtagaccgagggagaaaaaagagagtggttatcattttagtccttataaatacctctaagagggtctaatagattttagttccaatatacacctttaatcccttttagtcatccctatttagattcttaaggattaaaagtgactaaaatggagggattaatagattactccatgaccaaacatgacctaagaaaacatgaatgcagtttacatttaactatccttcgagatagtcacgtctacaaactaaacctatttttgaacggaggatgtataatgaataaaaactgaactactttctatgaaactgaactagtgatctaagggcgaggtcagcgaaggtgaatagactcatctgcctaaggcttttttaagtatacagacacacatttaaagtattaaacgtagattaataacaaaacaaattacagattctgtctgtaaaccgcgagatgaatttattaagcttaattaaaccgtcattagtaaatttttactgtagcatcacattgtcaaatcatgtcgtaattaggctcagaagatttgtctcgtgatttacatgtaaattatgtaattggttttttttccacatttaatgctccatgcatgtatccaaacatttggttttgatgtgatggaaaagttgaaagtttgaagaaaaaattgtgaatctaaaggcctaattttaatagaaacgttcgcccaacatatgtttgcatctcgagcctcataactgtagtgggagtatttgatacacacgtatacgactgttccatcttgttttaattttcgacaaaaatattgataaattttttgatctttaagcctgaggaacaaaaccgtatagtcgtgcgattttactttcaaaatgacgataaaaattcaacgaatgtcaaatgtcaaaccttgatttctcccttccagaagtcgagagtttttgaattcctcaacttgccgtcggcttgtccctcttcccgcgtgttgaaatcatcttcccttccagaaagccaacgccttcatctgatcatctccttggccaccaagaaatgccttcgtcgaacacctcgccacgccacgccgcgcgcgcgcccatggccctctcctgcgccgccgagtgcgcgctctccctcgcctgcgcgcgctgggcgctccgccgcctctccctgtccggcgccgacgacagcgcgtcctggcccgcggcctcgccctcctccttcgcgcccgtcccgcgcgcgtgccgctccgcgctcgcggcctggcagcaggggcacgacgaggcggagcaggcgccgacgccggcgccgtcgcggctgtgcccgccgtaccgcctctcccacgaccgcgcgcgcggggaggtcgtgctcgccgtgcgcgggctgggactcgcgcggctcgaggactaccgcgtgctcctcgacgccggcgggcccgagccgttcgcgggcgggcacgcgcaccgcgggctcctccgcgccgccgtgtggctgctcgaccgggagggccccgcgatccggcggatggtggcggaggccgggccggcggggtgcaggctcgtgttcgtcggccactcgctcggcgccggggtcgccgcgctcgcggccgtcgtggcggtgaggtgctggctggagcggctcggcctccgccgcggcgacgtgaggtgctacgcgatggcgccgccgcggtgcatgtcgctcggtctcgccgtcgagtacgccgacgtcgtccactccgtcgtgctacaggcaagcctagcctcccaacaacattgttgcctctttccccttagctgatatcgcgtccatttctagcattgtttatcgaacattctgcaataagaacggaatccgacctcgattcatttcgttgcaatgattttggaattcgaatcgcacactcaattcttgaatttggatgcaggacgatttcttgccaagaactccagcgcctctgcaacacatcttcggatcaattttctggtaattaaaacagctaaaaatactcttgttatccatgtgttccaacggcgttgattactggttgttccagctgttgattcaccaatttttttagaacaagtgattcaccattttttctgtttcttgcattgcagtttgccgtgcctgctgtgtttcatttgcatgagagacacgtttgtgtcagaagagaagcttaaggatgcatctaaactctacgctccaggaagagtctttcatatcgtggagagggagaactgcaggttaagggccaaaattccaaaaattaaaacttttttaaaattaaaaaaacaaaatccttgtgtgctagtatggcattagacattagttagaagcttccgaagattagctgttatatttacacttgattttaattggcattgtatccacattggctgctatgcagatgtgggagacttccgccgcaggtcagaacggcagtgccagcagagggcagatttgagcatgtggtgttgtcatgcaacgccacttctgaccacgggattatttggatcgaaaaggaggctcaaaaggctttggatgtgagtaatttcgtctttgcacatgcctgcctgtcaatagtaaaaaaaaattatccctctttgtaaccgatcaattattctttcttccctttttacgaatcggcacaagacaatacccgtttcattgtatagagtaggagaaaaagtggtataaccaacatgttgcatggctttctttaccaagttgttgttcatccttagcaacatgatttcattaatcattttacctgatgtttaatttcttcgcatgttcctttttttcttttctttcgtttgctgtcctgcatgttctggttgccaatcagttaatggagcaagaagaattgacactacccccatcccagcaaaagatgctcagagtgaaagaaacggaatcactcgcagaccaccaaaagctcagtgcagggaatccacaagaagacgacaccctctcctcctcgtcaccgttcagtagccctagaacttcgacgacatcatcattgcgcagcgaatcgtcgtcgacgaggagcgagtgggatgagctcgtggagatatttctgagtgaccatgaagaagacggtgatggtaggacaaacatgtgtaaccgggcaggttgtttgccttgctgtaaataaaagattgttgcatagaaattttagagtgtaaatgaactatattgaaattagagtgtaaatgaactagaagatggttaaattttattccaattcgacctcacgatcaactcgattgaatgttaatatacagaggctccaataatccatccgtaccagtgtactattgtcccagatactagtaaggctaagttatactcctatttctcaacttgaaactttaacttcctcgttgtttttcaaactgttaaatgatatgtttttttaaaaaaattctatatagaagttatttaaaagattcaaatagttattaatcttaattaatcacgtgctaatgggatttttcgttttacgtgtgtcaaaaatctctctcaaaaacaaagagatcgaacgcagcctaagtagtactccatagtattgatccaccatatgggtactagtagtaatttttctcttcacaaaaattattcagttaccttatcactatatatatttctaatttctatcaagcttgtatggggtaaaatgggtaaaagaaaaacatcatattgaaaaaaaagaataaagacaacattattcatcgtttcgcccacaaataattgtaatattgtgacacttatttctaactaaaatttaattatatgaattcatattttatatatgtgttcttaatgacttgaaatccaatattgaaaaataaattatgatgaaaacaaatattaaaaacaactttcaagttagaatttaaaatttgattgtgtttactctccctgtttcagattataagtcattttgactttggttaaaatcaaacagttccaagtttgattagttttgtagaaaaaaatgtaatatttttaactcaagacaaatatattataaaaatatattcaattattgatttaaagaaactaatttgatgtcgtaaatattacaatatttatctacaaacttaattaaatttaaagtagtttaactttgatgaaagttaaaacgaattataacgagggattaataaactgaagagcagctgaaaaatttgtcatcacttatcaccatgacacggccggtgaccacatttcgccggtgaacacacagacacaaaaactagccgttactctatatcgtagtagcattcaaactaaccagccacgcgaagccaccacgacaaccgcagcaaaatctccggaagccgccccgccaccgaaccgaagagcgccgccaccgccatggggagtctcggcggcaagtccgactacgagagcgtccgcgacgcccgcatctccgagaacctggtaagcatccttctcctcgatcatcaactttcgggtttcctctctggatgaggaatctctcgcgcgcggacgcgatggcaatggctcgcccgccgcgctgattcttgggcgagtccccgcaggcacggatggagatgctcggcctgcgccgctgcgccggggagttcagtgccatcgcctccgcctccgcgtccgcctcggcagcagccagccgccgcgccgggatcggcggcacaaccccgaggaggaaccccaagccgccgcgtgtcctcaccccgctccgccgctccggccgattggtcgccatcgccgccgcggcgccggccggatccgcgtcgggtccccgccgttccgcccggcttaacgggcagacgacggagcacaaggcgctgcctctgaaaggttggtccctctcgctgccgcgttcgctgaaatgctgaatctccatggcatctggctgcctgagatgggaacaaattcttgtgctctctctctcttaggatctttgagtaagtttgccgcggaggaagcagaggaggaggaggaggaggaggagcaagaagagaagaaggcgatggtggtgatcgacaaggagagggtgcggatcctgcaggagcggaggtgtgacagcaaggggaggggcgccgtgtacgaccctgttcttgggatttgctgccatttctgcaggtagattctccccactgtcaacatttacgaccgattagtgctcctcatcttgttcttaatcaagaatgctaggtaccatagttttcatactgtgacttgttgagaaaatttcttcatagttttcgtatgatttgttgagaagtctcttctcgtgtgatcttaggcagaagaaattgtgcggcgaggagggctgcaagcgctgcggggaaggagac

SEQ ID NO: 26681 - DNA, 17215 bp, Oryza sativa
tttgacagggaagacggattgctcctcttccattcttcttatggaatactgtgccgtgcttgcctgaaagtgaggtatggggaaggtaagcttcatgctgtcaagaaatgccattgttgttggtcagcttattgtgttggtaaagcttctgattttgagatgtggtatcagacatggatgaggtcaggaagaacaagaactggatgtgccctcactgtattgaggagaagggtaccaagaaattctggatatgtaacaggtatatgattcttacaaagctttgatatttcatcccaatatcaaactgaaggaatgtatgactatgctcacttgctcgatttttcataaaaactatgcagctccatctgcttgaagaagaggaagttatcaccaactggaattgccatatacgacggtaattctgcgtccacaacttgatatatgaggcttatccatactgtcaatgctaattctaccatgatacatgttgttcttgatggtcctaaatcctatctatttttggatcccttaacaacagcgcgggagcaaggttacgagtctgttgcgcaccttctcatggacaagctgaagtgccgagcattctgaggtcttctatgtcgttcagagacgacgatgatgtttgcctagcgcactggaaggtggaagggccccttttgttttgttgacagtaggtatgacgcactttaggagaaaaactagtgtagaaatgagtaccactattgtgctcaagattgtgaatctagtactagaaccttttgtagccgatgtttccatatgctgcttgtgtttgggggcagctgggctattgactgttcttctgaagatccaagcaagggaacatgtattgccttttcaatcagtggttgatgagtcatgaccataactgtgtctgctacttgctaatttcatggcttaatgtcatttgtaccaaacgataattttgttaaacattggtgccttggtggcatgccatttggataagtagggttttttctgagagaccatttgaatctctaattgtgaattgtgacaaacaagctacaataacttcgcaaatgctacttacgttatggcagtttcaaaaccgtttcagtgcacggattttttgctgttctcacaaatattaggtggcctaccttgcacttgcataacaagaaaaaaaaatctgcctttatccaaatgaaaacttaggccttgttttagcacgtctgatgtctccaacttcttgatatttctacacagggaaagtcgtgtgcaataaaaaatacaagcacaagtcgtccttatagaaaatagggtttataaactaaactaaagtggcttaaactacaaaattctcttatttcagtccgaaataaatacacaatgtgttactaacaatcttaacctgcacccatctccaacttcaacaatgtctgtaactagaaattcccagctcaagaaaaacctggagttgaagttgtgccaaaagggatcacctatacatttgtcaacaaattttctcctaaaaatttgacagatgtaattatagtacaatcatagtgtaattacactataacttgtatataacacagtaacttgtatataagttccatgtaattttgaatcattagatctattataagatttgttctgatgaagaagaaaaaaaatcacagcacacatatgtgagaggatttgttcccacgaccttcattttacccaaaaaacatgttacggggagattcttgaaagtgtgtaattatatgcaagttatagttgtcgacgtttgatgtcgcgattccggtatttgcatagtatggggatcgttggtactaggatatacgcgagactgaggtaaaagatagagacagggatttttatacaggttcgggcccttgaatggtcaggtaataaccctacattctgttggccgaagccgatattgctcttattcaccataatcacaccggtacaatatttggggtagcttatataagtgtttgtcgacatggcggtctgaagctctgactcgtagtcgacaacagggtagtcttcctcctcgagttcgtgctcggcgagatcagagataacgctatgtctctcctaacagtatccggagacaccgtaggggactagccgtgcttatctctaaagtcgatatccagcgtcttgtcttggcgtatgttagtttgtatgttgtggcctctgttgtcccgtagattgtggtgggtgtgtcgtcgatgtccccctctcctcctaaggggccttgtatttatgtccccttatccaagtagaactagggaaaccagtatggatacaatccgagtagtctttgtcgtttccatatagaactctggttgtctttccttatccggaactcctcctatattcgcaggttgtttccgtatatgacatggtaagtggtgggtcctgctgagatttagtcaactactattaggtatgtggtatccataaccctgataacagtgtaattacactatgattgtactgtaattacatctgtcaaatttttaagagaaaatttgttgggaacctctacggctcaggtgcccgatcatttggagaaaaatcgggcgatgatgtcatgcaaacttctttaaactgatttatctcttaaattacttatccaaatcattatctgattgcaccattaaatttgttgcaattaaatcttaaaaacaagaccacacatggatatattccgacgaaattttttttagcttattattgaattatttttaaatgttgcacgatgttacacctggtatatcggaattgtttcactaagtagatcgaaaatatttcactcgtttaaattgagtgttgtttcaccttatatgaaaacaatgtttcagcaaatagcgaaagattgtttcagttcactgcaacatttaatccatacatagtaaaacattataactacactaggtgaaacatttttcggtggaacaaaaaataaaacgaattcccttaatagggggtttccaaaatatgtgggttttttttgttgcaatgaaagatttcagttcactacaacattagatctatacatagtaaaacattgtgagtacactcggtgaaacattttttgtggaacaaaaaaaaaatcaaattcccttaatagaggatttccaaaatatgtggttgatttgttgcaggtgggggcaggtattgtggtggggcccaacgacatcactgcctgcgggggcgggggtggggggagcgcccgatttttgctccccccgcccgatcgcccgaggacaagtattctcgaaatttgtcgcaaaatatatagcaaaattggtgccaaaaagcccaatgataaaatctattgtcggcccaaactatttgtactgaactgggcccggttgggccagttttctcaaccgggccgggtcctggaaccggttggaattttccatttccagcaagtccacggctttacggctgcttgcttttgcgcaagtttcaagcgatgcgccaccgcgtcggccccgccgccgccgccgcggcggcgctccggcggttctcccacctccgcccgccggccccgccggacccgaggctcgccttccttcgctcagagtttgatggccgtgagcccggccgacagccaccgtcaccggaaacaagagaggagccaaaaggtggcgagcgcgcgcgctcgccggtggccgtggatatcgcgcacccgtggccggagtgggtggcgctgatggagctcctccttcagaggggccacctcgacgcctccgtgttcgccggcggcgcggctggctcgccgtccaaggattccaacgttatccgcaccgcctgcctccggtttgggcgagagcggccggagcttatcaggtgagatgcttcagctcgtaggagtcgccaatgtgtgtgcttctttgctctggatgttgcggtgcgccggtgtcacttgagtatgcgattgtcattgatagggctatggtttagctgcacgcacgcgaggtgtttgtggaaatgccccgtcaatatagttgcattttcttggtcaggtagcctgatgcactcgaggtggtctaaatggcgtatgatattcatgtgccttgcatatagagctgaaacccttttgttgcaggcatctatcaagatgggatatccaggttgctctccggtatgggtgccccagcattgacaggaaggttgttaattctgggaagcgattacgtgctcatgtaggccttgatgaaggagaggtaactaataaatacacaattatttattttcatgtactgtatttttctctattacttttattttgaaattgtcagttaccaatgtttgtgaatagaaaattgcctagtagcagtatttctgaataaaatcttcaaaccattgggttatgaaaaaaattgcaacattataattaggatcacaaatggagagaagaaacttctgcatgcttacaatagtttgatgacaaaattagtattttaatgctgcttataaatctatatgttatatagcatttctccagcatcagcttatgctgacaggtctgcagccaatgcaatttaaggggtggatgcgagagggcatatgtaaaggctcggaaggaggaaattggaagaactgtggatgttatgcgcatccttttgacttatgggcttgacacagttactggcaatgtggagaacagagcatgtctaaacaaaaccgttaaagaatccattaagagcctacttaatgagattgttgggttcgattccatgggtcctggttccagcactgaaaagcccacacaccgtatgccaaaaggacaatcttctattcctatgaagcagggtgattggaattgtcccaagtatgttggagccttttaatcacatatacattttgtgataatgccacgctttataatgtcatatgttattgtcagatgcaacttcttgaactttgcaaagaatataaaatgtttacgctgcaatggagaatttgaagagaggtatcagctgctccatgagaaccaagagcatcttcctctcaaaaagggtgattggatatgcaaaaggtgaggtttcacaaatctctagtttataagattgactcggagttggaatagtcttctttttgcacctgtactgatcttatattttcaggtgcaactttttgaattttgcaaagaatacaagatgccttcagtgccatgagaaaccaacaaaccgtcaactcaatccaggggaatgggagtgtgtctcgtgagtggcatttttgttacatatcactgcatatttgcattctcttaatagttagtatcaatatgagaacttggcaacaaaatgatgttagtggctttgtctggtctttcagtgtcatgattatcttctgcttactataaaaaattttccaagataactatacgattgattcatgacaggtgtaattatttgaacttcaagaggaatgcattctgtttgaaatgtggttggaaaagaccaaaatcattgaacaaccaagacagtattgaatcacaacgtgacttagatgataataagcattctgctatttcatttatccaagatggcatccaatcgaggaggcaaattctgcaaaataaggctccattgtctgacgaagattcagacttctggagctccgaggaggaaggggcctaccacagtgacaaaaacattcccccaataaagaaggattacaagttccttgaaagttttcccatcattgggggtaggactgctatgtctcaagatcctcttgagagggagaaatggaaggacgaaatgtccaggagaaacaaagggctcctaacagaagtatcagaagaaagtaatcggccttcgtgccccgttcgtattccgagaagcattgagcagattgaatctggtgacgacgacgacgacgacatttcatcatggttttctggtggtactagtaatattaacatgaaaaaggcatagccagatttctgtaaacgctagtatctgcacaatttcatctgtaatatttacagtgtaggcattcagtaagaaaaaatcatgtctcgcaaagaacttcagtattgtacttctgctatgatctgtcttggcaaataatatactatgattttacaagtttttgtattcgtgtagtggctggttccatccactttagtactaaacaacgtcgagttcttatatgtacatgattaacctgtaacgagtttcgagttttaacagttcttgtactgtcgaagagcatgagaccaacctcttatcacacagctagacgcttgttttgtagtttcttgttgcatttctctcttgtgccagtactccacctgcacgattttgttgtgattgaatttcaacaaacatatccacccaattatgaccaatcaccaaacctgcaaataactggagacccgacacaaccaacacataacctgcaatttctacgctcataaaatcattgaatcgccccctccccctctcccctccccccaaaagaagatgaagaagaagaagaagaagaagaagaagaaaagatcagtgtattataaggatcgaattgtcttctttttctgtccttgcatgtttggtatgagattcgagcccaaaaaaaaggagatgatgcttaacgtttcaggaggttcttgtgcattgattttctagttatcatgatcatggtccccaaccttcttccttccctctgaaattcccattattcaattcttgcaaaaatatcgcaaaattcctttattccaaaggaggccgcaaaacgccttttgaaaagtaaatataaggaggaagaaatggagatgtttaacccatttttgacatcaaaatggacctaggaattttaacccatttttgccggaatatgcatttaggcgcttggttgcattgtcaacctgacagcgacgcacaacggcaatgtatggttggtaataatggaaaaagacatcacatattttcgtagcagtagcaattagcaccaacaactgtcaactcagatcccatgggtccgttgcatgtctcgagtggttaactccgatttggtggtagctagccagctatgtgtgtgtgagctaccaaccattgagctgcagaatcaagcttttgcactgtagattatctggattcaccttgcatattttagcttttttttttttaagaaaagcctaggactcttattacaaggtgtgtgatggtcgatctggcttcaagccttacccctgtcttaataaatttaaatacaagagcccttcctcttaccacggccatgtagatattttgttttatgggcagtgattatggcatattaaaatgaccatgggcatgatttgattttggtgcaatcccttcttcctatatagttggtacccactacaatattaactcctataaagaaagcaccaggttaagccacatcatcaggattttagagccgtctgatcaatcaattgtcagatgcaaggcaccgttagatcttcttccttgctggacacagaaataaggaccaagttggtgagccggccctgttaagtctgtccgaattcctgcaaacctctgctggacacacaccacgaacgatgccatgcactgatggggatttcaatcggctaattcagttaacagaaattgtttacagattatattcaagatgaaattgcactattgcaggttatacatatttccatttgcaacagttcatgctctatctcaatgatattcaaataattcatttttcattttttttatatctacagtatgttgtttgccgtggtagttcttttccaggactatcatgaaatccaattcacactaatatgtcattttgaatttagtacttagcataaaccaaaaggctttaatacataaatgtacgagtctcttttgacaccattgatagtgataaaaagcagttggttcatactaacttttcaggtttgaaataactcaataagcccacagcaacgcgcagggaatcaactagtatatattacgaatggtgtctaactgtccatattctactgtataagattgcttggaaacataagtattgttaaaagtcatttatgtcttttccccttttcccctttgactatattctggagtactggataactagaaattacctaggagtaactagaaggcattatccctaaattatagcttttataacaatgtgaccttggcaaattggcctaaaaaatttccatagctcaaattgaaccacttggtaagttcagaacccccccccccaaaaaaaaaaagatctagacattgctaaaaaaaaattcgaccacatagctagatatttcttagtgccatcatgatttttcggtagtaatgctcatctcacagaccgagacctcgttatgcatgtattccatagaaattcgtttacataactttatctccggaagaaatagaaaaaaaaattcccacattacaaatattttacaataccgagcaggttcaaacctacagtctgaaatctgattgtttcagttacgattgataagccttaaaaaaataaacaaaacaaccaagtaaaatttttatatctatgttatcaatgatttataaactaatacttaaaaataagctatgttaaaaaaataaaaaaactttaaaatttacttttaaagtttaaatttaatggctggtagctaactagcggactatactagctgtgttctttcctctatcttaccaacttctactacctcgttttttacacacatattatcgaattgttaaacggtacatatattttttaaaaaagtttatgagaaaaattgtattaattcatttttaatttctaactaatatttaattaatcctacactaatctatcgttttgttttgtgtattccggagggagaagttgcaaaacctgtgagggccgaactcacctgagagggtgatactatactgttgcccaattggcaagggattagctatacatttatcattaaattttaattaaaaagtttgacatatgtaaatatagtacaatcataatgtaattacagtgtaacttatatgtaactatagtataacttgcatgtaactttttgacctaagtgaaatgctaatactgtgaaaatgaaggtaatggtactgaatcccccttacatgtgcgtgggttgtaattttttcctatcacccttgcacaaattttaaagcaaatcgaacgattcaaaattacattgtagttacatggtagttatactacgattgtaccatatttacattgtcgataaatatatagctaaatcgattgggaattgtcaagtcaaccaactcatcatccaactggagaaaaataaaggggctcaaatccggtgatccgccgcgtcgtccttcagtcctcctcctgattgctgcggtttgcgccaaaatttctctctctctatcccctcgcccttcttccccatgacgtgctcccctcctcctctccttgggccccgctctccagttaccgttaccggcaaaatcttatctgctttctactaaaagctgggccttcatgctttttatctaaaaaacgtggcacataaccccaggtgtcatggttataaagttccacaaaattacactattattcattttgattttgatctaacatacttttgagttctacgatcatatttaattttataatttctttctccatcttgtaagtatagccttttaaaattttgatacaagattgttgtcgaattagttaacggtgtggttttatgaaactttaggatcataatacctaagttatatgtcacataccaaaatatgcaattttgtacaacttggatcataataatatggggttttacgaaatgtactcttaaatttacgctgtggctgatactccctctgtcccgaaatataagggattttggttggatgtgacacattctagtactatgaatttggacaaagagtatgtccaaattcacagtcgcaggatatgttatatccacgcaaaatctattatatttcgggacgaggagagtaataaactaactagcggatttataaagtgactatgggtgtgtttagttcacaccaaatttccccctaactcccacttttccatcacatcacattacatccaaaactttcctacacacgtaaactcttaactttttttttccaaactaccaaccttttcaaacttctccccaatttcagaaactaagacagcctatactgttgcctaattggcaattgtcaagtcaaccagctcatcatccaattgttggaggaaaaaaaaaaaaagctcaaatccggtggtccgccgcgtcgtcctccagtcccagtccctcctgattgctgcggtttgcgccaaaatctcctcgcccttcttccccacgacgtgctcccctcccctcctcctcgggccccgctctccagttgctgcaatcctcccaaggagaggagaggactccactccacgctggggattgggatattccttgtcccgcggggtcagtttttagcagcagcagtacagtagttggctggttgctaccactacacgagctcgggaggaaggaaggaaggaaggaaggaatcgcaaggcgaagagtcggagctggcggaggaggaggtgctcgcgatggggtccgagggatccgccggggtcgtcgtcggtgagtagccagggaacccttgccgaattttggttttgtggtggtggatttgggtggggtggggggatcttcgcggccggtcaagaacgcgagagttggttgagttcttgatgggatttttaggggctgattctcgtgtggtagggcgtaatttctctggacgtgcgcgtaggcaagattcaagaaactctgagagcaaatgtagattcgtgaggaattaggatttgttagattcgtgaggagttaggattgcttcgggattagattgttctgtaaaggggaatgctgagggggtagtctcagctctcggttcccaattcgccgaactcttagcactgtgaattcttgttcaattgtttgttcttttgtggctaagctaagaattggagcaattttatatggatggaaacgatggatttaggggtactagctggatttgttggttgctcacgtttatcttcaatcgcgaattattgcatatcaataagtttgtcttatcattagttcctgagtttgatcctaatatcagtatttttggcatttctaccatttcttggtttgggtattttttgcataacaagatgaacaatactgctacttcatagggggggggagagagagagagagagagagagagagagagagagagagagagagagagaggggatccctatatttggtcattgcaaaataaaaaatccgcaattaagtcactcaagtctgatcatgtgtttgaatttggtttactaatactttacagccacagctgtggcttgtcagctaccccacttgttcatagacatgttttttttttaacccaaattgtagattggcacatttttttttccaatatgcaactaaggccgagtttagttctaaattttttcttcaaacttccaactttttcatcacatcaaaactttcctacacacacaaacttccaactttccgtcacatcattccaatttcaaccaaacttccaattttggcgtgaactaaacacaccctaatgataatttttccttgaatacgcaagatgcgctcattgcattagtagaagaagtaaggcatccaaacacgccaaagaacagcaaaaagtacaggaacttgcaccaccacaaaacaacccactgcaagggcggtgacaaaaccaaaaagtactaaaatagaagtccctagccggggtccatgagggccccttagcccccgccaaactccataggcgggcttactcacttgctaacatcaagacctaggcgggcttactcacttgctaacatcaagaccctatactaatgatattaaaatacaaccagggtgatgcattttacttttgtgatccactgtgttgtgactagcatgccacaaaataaccaaaaataaaggaagtcattcatactcttaagaaaagagacttctaagcgaatacaaagtgaatattacttccaactaataagaattgttccagcgtattctttccactaaaagatgattcgtcctcctaagacatccaactcaatttattggcattcttttctcttcttacaaatggttccaattctgaaaaaaaaaacgtaaatcttttgctttatccgaggccttgtaattattttatcttaccatttatcgtgttcttttctaaattttgcttgaaagtactccctctagtcattaatatatgacgttttttaacactaaaatatgtattaaaaacgtcatatattaatagccggagggagtactttacagaaatggaataaggttagagtggaacataataatctcaataaatggatattgaatctaccctatccatgcactgtagttttttggatgactataaactgatacattcctttatcctaaaatgatactggaactactttaggatttaatgaggaccaaaaagactgtcctagtagcatatgcattttgttaagggagactcaacttttatgattcttattaggtctatgcaccaggttaatatattgttatatctagagcggaaaccagagtttactttcggagtcaataatttgctctttcgttaattcataatggcaggaaagacccttcatttattcacacaagatggccttcttatttcccaatagtgcagctttgcttcccaattggtacttctcgagttaaaaaagaaatattaagcatggaattctcaacaatgcaatgactggctaaggcccactgtgcttatctttttaattgttgcagaaatgtaaacttagaaccattgcattttctttacaaatcaaattaaggttagacaaaacatggtatccaactgttatgtatttcacaatcgttctatcttttctgaatgcaataatattgccgtttgcatcttaaattaaaagaaaaacatttagccaaacacccgaacatctaaaagcagttgaaccaaatgagaatatgataatccacctcaatcgaacaggagtctaagtcagctttgcatgccctaaacatgcatttttatcgtagccatcctatagatggaccatggcaaaacagaactacagaacacattcccttgttcttgaccccatacataattgatagtaactgaaatcaattcactatatacagatcctgtgagttctgaccttagaaactttctttcttgtcactccatgcataactctctatctcatcaatgaacaatgtaagacatgaaactggtgctgaacaggtttctgcataataggcccctctgttcatctcttggctacaagttatttaatttggatgctttagtcctgccaataagtcctatcatatctctatctgaacttggaagccttttttctgaaaaaataaacattgaaggcattttttctacttggtccatcccattttagtgggcaaaatggcatcaagggcggagctaccattgaaacaaggtggtgcactaccatcgaaaacctagaaaatttcgatggaactgtgcattctagcgtttataagtgagaaatcttggatttaggggggtgggggggggggtgggtgggtgcttgggttcctgtgcaccacccaagcttaatgtggctccgccactgaatgccatgtgggtttgaacagcatgaaccatgtgctacatattaataagctgacacaaacattttaaatattactaaatatgctattggaattatctttaataaggaatgctttgcaactccattttttttctttgtgcttatgcagttgctacattatgttagttagccttctagtaataataggtaaatcttgtgatttgtggcataacattttctctattgttttctgtacattagttatgacttgcctttgttcccctcaaacaacacggttcttctgttatttattacatggatagatgagcatgccaatggcctggtgctacagctcatgaggaaactttcgaaatataatttaaatacgtgaatggagtgtgctcattctggaaagctgttttgacttgtgttgatgcaaaacattgtcggatcggttactacactccaattttatgttctctaaacagattaaatattattcttttttgggatttcaagcctcatgagtagctgcatacagaacaaatctagtaattcatttattgaattctttactgtgctgagtacatctctgcagttcccagaaactttagactgcttgaagagcttgagcgaggtgagaagggcattggtgatgggacagtgagctatggaatggatgatgctgatgacatatatatgcgttcctggacaggaactatcattggccctcctaatgtatgttgtataacacccattagtagatattaactgcatttgcttctgtatgctcaaactgaatgatcttttacattcaatttgtcttgcagactgttcatgagggacgaatctatcagttgaagttgttctgtgatacagactatccagacagaccacctactgttcgattccagactcgaatcaatatgtcatgtgtgaatcaagaaactggaatggtacatgtccacttgctttcctttaagctaaagtagttggtgaatcattttattggcgtagtacttacaaggagctactttctaggttgaaccaagtctattccccatgcttggtaactggcaaagagaacatacaatgcaagacatcctgatcggcttaaaaaaggagatgtctgctcctcagaatcgtaggctccatcaaccccatgatggtaatttccatatctctgcttcagtgaatttgatctacagcctcgtcgttttcccttaagcttataaaccgcaaccaaaatttgagttttaaaacttaatttcggagttaattttagtgcttttttttatcgtagtttatttctagcatttgtttttaaatcgctgaggacacgtatataaaagtttcgctcacaaattattttttgggcactgataagcagttacagtttataatcagcataagcgaaacaatgaggttgctacttgctagactgaagttgcatgttgggttctgaacctagttgctgtttctttctgcaggcaatgaagatcaaagagtagaacagaaagggctatcgcttaggtgtgtcatcatgtaagagatgcgaattgcaatgtacagtattattaaattgagtagcatcaggcgcaaaaaagagaacccatgatctcctgtaatttggcagtaactacattggatccaaaccgtgctgtcgcctcaataaaatgtcggcaacttcgttaatttgcacattgtgtaaaccgttcatcccctcgttcagtaagattgcaacttgcaagttgcaacccatgtctccattgtttcaggaaagcatccgtaccatctttctgcttgtctgttccagtctgaattattagtttgtctggagacctgtaattttcttcagacacctggtatgcatgctagttggagagcagtatcttcagaatgctaacctggttgttgatgtcaagatacccctctctttttattttttatcactgcacccaaaatataggtgctccaaaactgggaatttggtttttttctatgaaattcagtgaattacactcaaaacttttttgccgacaaacttatcccggtaacctagacacctagtatacgtgcaagctggaggtccataaacttccgaatgctgtggccggacggctgctgtttgaggcgattttaaacttcttgcacaacaccaaatccagacgaaattcagctaaactcattagagaaacctcctcatgaagtcacccaaatgctgaacctcacctcttgcaaacaagcaggagaccgtgccctcctcctgttgagagatccttgacgtttcaggatgagaaaagcatccgtccaagaaaggggaaaaaaaaaagagagacgaacaccaaaaggcaaaggcaaagcatttacagggaacatgctcctgcgtgcccacaagcctacagcgcaagccaaggaaagcgaggctgtgcctaccctgccatggccatggccatgccttctctgcttgcaactcgcacttcgcaaagctgatgacaacgcctcctgtcctatccaatgtgattggaatcatcgtcgactcgatctttttcctcatcgaccaccggccaaaccccaggctgccgacacggcagcatcaaaatgatatggcttgtcctactcttcttcttcttctttttcttttttttttcctactatttgtttggagattgacagattgtggaagtaaaacttctggcctctctgcatcgtgtgatgcaaataaccaatttcagaagaccaaaaatgctgagccgagatcggtgtgattctgcatacgagttacttgaaatgcagggaattattatgaactttatgtttttttttagataatggaaataggttacatctctggtctctgcccgtaagcacacagccaaaaagtccagaagattatgaactttatgtaactctcagtagtgtggagttctacacttcaactcattgctctttgaaaccaatgaaacttgcagtgcaaactgtggcctgtgggtgcagactactacagaattacaccctcatcaatatcgcagccatgaaagaagattctaccattgactcgtaaagcagactgaaaatttgtttttccaaagtaaagagaagatggaaacgaaattcaatgttcagagtttcagttctcaaaaaatgttcagagtttcagacttatgtaccacaagaaaagaataaataaacagctgactattcagactaacatgctgtacaagagacaaacacccagcgtcagagatactccgtaatgttcgtttcactcttgcagaattctgatcccgaattctgaagtaacacaagctggctgatgtggcatcagagatatccagagcagtgcaataaacatctcccaggccagtttaattgaccgtacagaaactacagtgcttagcagatcatgtccaagaaaagggaccatttgctgaaaagtaaacactgacaggtcctggatgtaagtactgaaaatgagtactagctacaacaaattcag

SEQ ID NO: 26682 - DNA, 14237 bp, Oryza sativa
ctgttcttgaataattgtcactgttgactaagattgtctcactttgattaattaaaaatgattatactataacaaataaaaattgtaatgcgcctgtggtgacttcgtcaatctccaggatttattcgttcagcctttgaatatgttcataggggtagggtttgcgtgcgtgtgttcataggggtgagtatgcgtgtgttgtgagtgtctgcgttataccgtgtactctaaaaaaattttattagccccctccccccctcccccaaacacacacacacacacacaaatttgggtaaaaatagatcaaataatatctgaccgatttacccggaatccgatcggagcgaggatatggtacatgtattttaaaatcgggtgaaaaagggagttttttttttctcgcttagatcatatttgagactttgacgcagaccaatatggcatgctggaaaagggagacagtgtcgctctcggcttctcgcctgctgactgcgagagtagcttttttacacagcaacgtcgtcacagttgggtggcttgtgaacatcatgaaacacacgccatgttcccatgaattaatcctgaaaacctctcgcgatcagaagcatttttcttttctcggcacagtttcctctgctccctttctggtcaatctgaagcttccataagccacgactgaccaaaatatttcagctgatgtgacatggggccgaggttacaggtggtgacaagtaggagtacttccgtacgtgtttaaatattacaatttctagcattcaaattttgttttaaaatataacaacttatatatctattcatttctcaatcaataacgaccttttacttttagtatttaaaatattacaatttgtttgttaaatctacttccgtgcttaaatattacaatttatagcattcaaaatttgtttcaaaatgtaaacgatcttttaccttttagtatcctcaccaatcacaatcttttcatatttaatttcacctatgtttataatactcatgtctaattttaaaacattttatgtcttgggacggagatagtagctgttagtccaatcaaattgctaaatgattttttgtttggaggctctttttctctagtgaggaggaactagaagatgttgacatggcaggctggcagtgatggttatccctttatttttgacttgattgttcaaagaccgtgggaatactgttagtgatagaagtaaaaatacaagagtagtttcagtttgttcctttgtttaaagatgttggggttgttcaaaacattggtggggggtgggggggtgtcgagggtcaaggttccaaagaatggtggctggaggaaagaagaataatctgatgcaagttcacttgtttaatattactagagtcaaagagattgaaggaaaaataaataaataatctgaaagctcgaagtatgtcgtcaaacgctgggctccatatgttcaatgttaatactctatttaagcatattatggttactagcattctcaacgtgactaacagagaaggatgtcatgctgaacctgtgagctgagacgtactgcgattgtgagtaggcgatagcaactctaatcatcttcatagtcgctcgtaaaacgaagcatctaagagttgatactattttgaataatactacagttgacttgaaactcaaaaggtacatggatgaccggtataaaaactagggatgaatcgggttgggtttcgatccttcttatatcttaacccatattttatgatcggaattggatcggacataagtaattattaaatacggattcaaatacagataatatcgattataaatatgaaatgaatatgtagcaattgcaagcaggtacgtattactacctccgtcctaaaatgtagctatttctagccagtactttgttccaaaatgaagctatttttttacctaccttctcctctcaaccaatcacaaccattctttttcacctactttctcttttcaaccaatcacacaccttcttcagtcattctcatctacttttttaatacccatgccaacctcaaaaatacttacattttgggacggaggaaatatatcggtaaccgaatattgagtcaaagggacgatcatatacggtaaattttcaatcgccattcaatccctaatgcaactagattaaggcatagcaacagcaacatagataatatctattactccatcacaccattactagttttagcactagcactcccgttttgtgcttgatttatggtggttatgagttgatgtaagtttcgtgggctatggcttttttttggactaaacaaaaagcctgctaaccggcaatatttggatagtttaccgggtaatatttatttacccgtcggataccatctttcaatcccgtatcaataaaaagcacccggatatgatttcaataactatataaaaattcaagtacccgaatttataatccaaacaaatttatcttaaaataatatggtcgggtggtgggcgagaaatacccatcttgtttttacccccactaaaatccgatgtgtcttttttctttctttcatcatacttcctgttcttgaataacttacactttctatgggtgtctcgcttgaatcacaaattgctatgatgaatacacttaaataatataacatattttaaggatttataaatttttaccgtaaaaagagaagcggttaaaagtttataaacttaaatgctagtgccattttcaattattcgagaatcatcatccaatcaagggcggtagcaattataggactgcaaagatatccaaggacacattgaaatcattccttgcaatggcaaattaccacgaaccaatgcaaacctttcctggtgtatgagcaatcagatatgcctcgatcggccgcctttgattgatcatttttgcgcacatttctgcctagcttgtcgatgtgtctccggcagttacaagtaacaagttgcatatgccgatgggacgccgcattgacacgcttgacacgctacaatgctacatatggcatctagctcaccttccactgttcctccagcgcctatacatgaattattgttacgcccaatcaaactcaaaccgcagggcccgttgcaatcaccaacacatgtacgaaccacaaatcattctcaggtttcttttttaaaagaaaagaaaagaaaaaatcgcacaaacattatgaagccttgtatggaacaagaatggagtatctttcatctacatcggggacaggagtgtattctttccaaaaaaaaaaaaaagaaaagagtggctcattggctcctcgcaaaagttgaggggttgtcgtatgaattgctcggagttttacagatctacaccaaatgtttagcactggcttaaaagtatactccctccgtttcacaatataagccattctagcatttttcacatttatattgatgataatgaatctagacatatatatctatctagattcattaacataaatatgaatgtgggaaatgctacaatgacttatattgtgaaacggaggaagtagatgtcattcggtggttgaatttcgaagtatgtataataaggtctgtgccacccgcacaacccgacagccatacctatcggtgtggcaatccgttacaacaaaatacacaacttaattcaaagttagtctagtatgtatgctgtaatatgtacatcagaaaacaaccttaaccgttttcataatttattttttctctcaaaacatggtcgaaaacgataaatctgaaaacggaacaatatcgaaaaatcagaaatgaaactatagtgatgaaatcatgtcggtatcaattggagacgggtaatgaatgtcagaaatattggattataaaatcacatggtatttaatttaatatatctgcatatgaccaaatcaaattaaaattacagtatgtaaattacaaattttctcccagctagctaataattaaattaggaatttggttgagcggttgttgcacctcaaaactatgggtcaaacagagacaatagatattagggatggaactgcctatacatttgtcgggtgatttttaacaagaaatcacccatattttttttctatacttagatttatatccaacggactacaaaataaaataattaatacaaatttacttacacaacatttttatcaaaattacagtgtacttacatgtcatatcaactaaatttacatatgtaattttagttatataggactgtaattttatattttaaataattacatgtcatatcaactgaatttataaatataattttagttatatatgactgtaattttatattttaaagaaaataacgaatgcatatttacttacacaatattttttatcaaaattacagtatacttacatgtcatatcaactgaatttacaaatataattttagttatataggactataactttatacaattatagtgtaattacattgtaacttacatataaactatagtgtaactttaatgtaacttttaaaacactgctggtcatacgaaatagacatcacagaagatttctcacctgtattaaaagtagtattatcgttcaatcactttcgttctatacagtggcaaagataaaaagatgcgtacaatacctcacttggttatcagtgccttgccttaatcaggtgctaattggtaggttgaaaaaacgtcaaattgtaagtaaaaaatttgacgacagatttatagcaaaactattaggggtttcaaaaatgaaaatggctatacatacgaccggtgtgtacaacccttgtccgactagttctctagttgttacttgcctggtccgacatggacaaaaactagcttgcatggagaaaaattagacacacgattggtagatgagccatggtcagatgcgggtcggatgatacagtaattactatatcacagaatcggtaaatcttcatgagaaaagggtaaaatatggaaacggttggtagaatacgttttagtgtcattttcaattttatctcggttaccttttctatatggttacgtcggtaaaaaccagaaacgagcgtcggttgatcatcaatagccatgactgttttcaaccccaatcactatcaaatatcgtatctacagaacaatgcggccaaaagatgtagcatgtgtttgcctttcacctaagaaaaacctactactactccctataacacatccaacattcaacgtggcagccccttgcattgccatcaaaccaaacgacgtgtaaaaaaaaagtgaacgcgcggggcctatgtttagttacaccaaaattaaaaatttggttgaaattagaatgatgtgacggaaaaattaaaagtttgtgtgtgtagaaaagtttcgatgtgatagaaaagctagaaatataaaggattattttagaactaaacacggcagtactaaccttttccatccggctcctgcaccggagatgcgtgcgtacgaccgtccgtctctggtcccgggccatggatcacatgagcgcgagccgatccgatgcgtgggcgtggcggcgtggtggtggtggccctgccaggtgggactagctcgtgccatgtgacgcgccgccgtcgtttaccccccttctcgcttcggatttggagggcgcgcgcgcgccggtgtgtgccgccacccgcgccactcacgccaggtgtgtgccgcaggcgtagcactagcaccgggacaaaaacgcgtaggtggcctacccggctacccgttgaaaaggccggatctcagtttcgtgcacgacacatgcgtctcttgtataatcacacgctcctgttcctgcgtaaccggggcttgtttcctcaaggcttcacaaaatacaccagatccgtttcaaagtgtgacacattgtcggattacaaatttttaacatgtgtattatcttatattatgttagtttattttaggaagcaaagaataaacgtttgcctggtaatcgtagagaaaatatagaaacactttaattctctttctgtttctttttttttcattttttgcccttctaacattaggcttaggatggtgaaaagtagaatcccctcaccgaagcaaagttagatgtcattttcgttgggaaggaaatgaaaagctagccagaaactctagctcccaccaaacaaaaaggcagatttggaggttaaaccgccttaccatgttcctagctacctctactttagtttcatccgttatccagagcatgaaaggttcaattgatacatactacctccgtttcaggttataagactttctagcattgtttatatttatatagatgttaataaatctaactacacatatatatttagattcgttaacatatatatgaatgtgggaatgctagaaagttttataatatgaaaaggaggaagtactaaatgtttacactgattcagaatatggccagtttcttttttttttttctttttgagacgaatatggccagagtttgttatggatgctgatgcaacgaaggcacggagctagggaaacactgctatagatcgtggtttgatgagatgtagcccaagccaaaaacggcacgacccatttggatcactcaaccagtacgtttcctgtacatatttttcctttggaccaccctacgtacagggtaacagtggcatctatttatggaccatgatcaataatgatagcccaacagtcacatttctattcgtatcaggcagattgaattcaaaggacgaaaccaacaaacaggggcgattcaaaaaacatctcgccgaaaacaagacccgtgccaccggatcgagagcacgttgctttcacgaaccgaaggcgtcaaccagatgcggccacaggagatgcatgttttacagatcaccaaaccatccaaagaaagacccagcaatcaatcacatcggccatgccaatcggcaacaactccatcagggagcgaactcatgaaatatgattctcaggcaagaaattccaagcactagattgcggtgtaattacatggatagctaaagaaccaacctaatcatcagctagaataagcagatcgattaaagcaatcacaaacttggggtggtgatccctaaacaccaccagaatacctaccacagcacagagggtgccaagcatcatgcgcaatcgaaagacaaccatatggttgacaccaatggtaaattcaatattgccaaaagatgaaagtagtccactcaattgaagataggattcatcaaatccatgaaccaaatgtgggctacagcagttagccgattcctccatcatgttattcaatatcaaggggcaaaaggattgagcccctcagcggattctggcttagaagtctgatcatcgcccgcttcgagatttgaggcctgctgctgcggatctctaccttctaatctttcgcttgactttttgatctcctcgatccgcaaaacaacatgtggcattgaaggtcgggcatctgggacttgtgcaacgcagtctatagcaagctgtagtagctgaaccatctgttcctcaacattctgatacctcaggagctccatatcaaacacctctgcagtccattccgagcggacaactgactgcacccacctgggcaggtcaacaccctcatcgttaagagcggcctgactgggggccttgcctgtgagcagctcaagcaagagaacaccaaagctgtacacatctgccttctgggacaccctccggggatcagtaacctcaggagcacggtatccactggcacgggatggtgcggacgatggaccaacaagagcagaaagtccgttgtctgataaacgtgcttgatacgacttgttcaggaggacattggatgacttgatgttgccatgggatgctgatgagcttgttgagtgaatgtactcgacgccacgggctgcagccagcgcaatgcttgatctcgtctcccagttaagcggtgtacggccagaacctctgttccctgcttagcaaataagtaaagatggtgtgagataagttttctatcctcaagtctaagtaccagtatcatgattagcaggagtcacaacagtaatgatgaaaacattagtattcaactatatggctataacttaaaatgcaaatattagttccagcatgatatcaagacatcagataccatcctaattaatcatgtaccatccccagaaactataagcaatgtaaagaaaaatcacactaaccaagctgagtcaacacattgaaggaatttgtgcatataaaaaaaataagacaaccaattctgcacctcaaggattgcaatgtcatcaattatgtttgaactttctgaaaagtatgaacaattgaaaagtttaaccagaacaggggggaatcaagaaacagtcacaaactaaatcgtagtcaatcctgaatgagtaacatcaattaagaatcactacccaataaacaacaggtactttggataccaacatgataaagaaaacctacatcaacaccgagcctgactaagtctcctagagaagacagaatcggagtagagtctaaaaccggcagatgaatagtcaaacgaggaaaggaaaaagtaatagccacaaaacaatcaagcgccactcttatcatcaccaccaaataacaatgcatcatagtactaacaaacacaagaataacatttcattgtgaattaagaatcacaacaaaatacaactgtcaagttctcaccatgcaaaaccgcagagaggctgcccatgggcatgaagtcgtagacgagcagcttctcgtctttgctgtagtaataggcacgaaggggaacgatgaactcgtgctgcagctcgccaatgtcagcaatccggtcacggaactccggctcggtcagggtcacatccttgagcctcttcactgccaccgtcgccccggattcaagaacagctttgtacgtcgtcccgaatgcgcctttcccaagcacctcggcggatgcacgcagcaggtcctccaggtcgaagggcgccactgcggccgcagacccgaagaagatcagcttcttccctgaagtcgactgaccgagaggggcgtgaggattgcccacggtggccatgggtgctacggccgcggcgctggtcatctcaggtggtttacggccggcggcgacaacggcaggagccgaagacggaggcggcggcatctccatagaccgcgtcttggtgcgtcccgacctgcagcagaggcaaataaggaggaacaggagaagcgcggctcccacggcggagcctatggcgattcctgcaatggcgccaccagagagcttcttgctcttcttgccactttcacccccatttccgcccttgtcgccgttgttcgccggagtcggcgacaccggctgttcgcccggagccggggaaggcgagacctcaccgggacaaggccccaaggggcccccgcacaaccccgtccccaggaacgccgagcgcggcatggtgcggagcgtggccgggatggatccgttcagctggttgaacgacacgttgaactgctgcagcggctgcttgaggtcgggaatctcgccggagaagcggttgttctcgaggaggagaaccttgagccgcgtgaggttgcccagcgcgggtgggatggagcccgacaggtcgttcccgccgatggcgaggcggacgaggccctggagcgcgaggaacgcccgcgggaactcgccggagagcctgttcccgttgaggaacacgttgcggagcgccgcggcggaggtgaggtcgcccgggagcgcgccggcgagcgcgttgaggcggaggctgagcgtgtgcagcgccgtcaggttcccgagcgtcccctcgggcacccgccccgccagcgccgccccggggagccgcagcaccgccaccctgccgccctcgcaggtcacccccgtccacgagcacgctccgcccgggtcgctcccgttccacgccacgtgcctccccaccgcgtccctgaacgccagcagcgccctcgcgtcccccgccaggtcgtccgccatcgccgccgccaccaccacggacagcaccaccatcgccgccagcgccacgcggcggccgctcgccggccgccacgccgcccgcatcccggcggcgcgcagaggaggaagcgagaggaggagggcggcgcgtgcgcgcctttgtttcgcttttggttgtgtgtgtgggtgtgtgtgtgggcggtggtggatgggggagaagagagagagagagaggtgggcgaaacggaaaaaccctaaaaactcccgtgcgaattttgcggaatgggcctcggggagttggggttttccgtctttgggaggccgggatttattccgggagttggcgggcggttgggaaagggaatgggaatgggtggcgccgcccgcacgggtgggaatgggaatggtaatgggatctcgtttgcttggccgggatggggaaggggaatgcgactgggtacgatgactctggcaatgctacgcctaggggagagtgccctgttggattgactgtctctgccagccatccagccgagacaacaaatgcgccttgctgcgcgtgctgggagggctcgctgacaagtgggcccgcgcccccgggttaaccggtcactcggttattattctggctggcaataagagcgagtataattgtagaatataagccggttaaatgctgagttggaggaaagaagagaggagagagagaagaagcggactgtaaactaacagccggcttggacacaagaaccaaaaaactctgtgagagaaacaagtgggtcctgtattaattgtgaagagctaactattatatggataggctaagataaggctataaagaaccttatagccagcaggtcggctgtattattagccttgctctaagagcaagtttaatagtatagtccactactagatccaaatcatttatagctaatgtaatagccaattcatacaatagttatttactatactattaatatctggtcccacttgtcatacacacattatatcttggagtccgtgctgtagctggctacagatctgtagcccgctgctcttctcttctttttttaactctttaaaatatgtttataactggcttatacctgctattgtacctgctgtaacaagcatgtcagccagttccatctttctttttctcctaccaacagcactagcagtataaaaaaagaactattttactcgtactactactgtagtgtatttgtttctttttcttcctcgcattgaaggtttttccggtgaaattgcgttttccgtgttgaccaacgcagccgattagcagaaattttttttttctttgggcggccgggtaggcaggaaccgttcacgtacttcagcaacgccgcgagctacttttctcgttttagtgtttgggaaggaatatacgaaaaatgaggttttaggttaacgttttgactttgttaaagtcaaactgctctaagtttaactaactttattaaaaaaataataatattgataatactaaattagtgtcatcaaatcaataatttaatatatttttataataaatttatcttggttgaaaatattttttcctataaactttatcaaacttagagcagtatgactttgatcaaagttaaaacgtcttataacctaaaacggaggtagtaattattttaaatttaaaagttgattaatataagtttttaaacgaattgtctataaaatattttttagaaaatacaccatttaaccgtttaaaaatagtgcgcagagaaagtggaaaatatcctctctttagggcaagtactataatatctcatatgttgcctctaaaaacgctacattggattgggtgataaggtggaggagagaagtggagagagataagatgagccacccctaaattaagaggcaacttccacacaaatttcaagaaatgtgtgagagtattagagatattggtatttgtatattagaggtgatacattgtatgtgttgcctcttaatttatgagtgaataaaatagataaatttagaggtggtagtcacatctaccttatacttggcttaaacgcacgacgagacgtggcttctgaacccggggggatgattgggtcatcactgccgccgaggaggagggctactcattaaacgctcgacgacgtagaagcgggtactttgttaggtgcgcgaccgaagaagtgtgtggttgcgtttccgtgcggcgtaggagtacacacaaccccttctgcgtggatgacgtttcggagtttcaacttaacgcttcaagaaaaacgcgcgttatttactagtggcaaagatggacgggacggttttgggtggctccagcatactatggtctgggagattcggggtatggtaggagaagtggtactactatccaaatctagtgtcaatttggatgcaatttccctggagggattgattccatttcaaccataggagtcaagtttattacgcattggaaacttccagctgaaagctacagtagcgagtaaatcctgccgttgttaataacagaaagtccgtgaaaaaggtgccgggaaaagaggcccagtccggggccatgttctccgcaatgggccgtccatttcgagaggagctgcaccacgccacgcacttgggacttgggagagtgtgtaatcaatgggtttctacgtggaggccgtggaaaatctgccgcgacggcgaccgcggcgcaccacaggccacagccaaacacctgcgcgagcgcgacggcgacgcgacgcgacgcctcggcctctgcggccacgcttcgcctcgccattcgatcaattcgtggtgttccatgtgccgccgttttagttgggtcgcgccgcgagtccaccgaggccggcgcccggcagcgggcggcggcgtcgtggggttggcgcggaaaattgatgggcggtaagagcatccgtaatagtaaagtaaggtgttctaaactagattaatagtaaaccacctcaatagcatatctacatgggtatctatagctctcttatgcattgcctcgtttttctctatagactatctctaatttagtagacagctttgctctatctcttcatttaatatcttctaaatagaaaaatatgctgatattgatctcttgtagagagcttatagtgggtgccctaagcgaggtgccgccgtgccggtgcgccgcagcagacgccgacgacgacgcggtccaagtccaacgaggtgaacggcgacggctgccagcctattaattcgggcgcgcggatcgggagtaccatagtgtacttactagattactcgtactcgtgtgccactgggttcttgattgttcgtacgcgcgcgctaattggtagggtgcgggttaaacggtttcttgacctatgatggttggtcgctggggccgtggggcgttccaccagtcaatttggcacggaacaaagtgacaacttgttttttttttttgtgacaacttggattggatttggattagtaggttcaactatataagaatgcgcgcgtgaaaagagtgtgacaagtgccgccggaggcagggacaaaatgtagcatcgcacggtacgggccactaatgccatcatctcaaatggacatgctaagtacacggggatgcttggtttttttttttttggaaaaagtacgaattaaccccgaactatcggggtcgtccgaattacccctaaacttttaataccggacaaattaccccctcgacccaatccagagcggttttgtccaacgtggcgcacatgtggcaatccagtcagcattttatttaataaaaaatgtgggacccacctatcatacttttttcctctatttctattctctcgctcttttctctctcgcgctacgcacatggcaaggacgagcgatgggcgtgggctgtcggcgaggacggcgcggggacgggcggtcagcgtgggcagtcagcgaggatggcgcatacgttggcgctcaggacgtcggcgcggaggcggaggcggcggaggacgtggcggcggtgaggtgaggtgaggacggcggcgcgcagggggcggagcaagttgtaggtggcggagggggcccgaggatgacggcggccggcgacagatgtagaggccgaccgggcgcgcggggacgcgcggtgggcggcgggctcctcctcggcggtggcgcacggggacgcgcggtgggacaccgccgccaccgcgggctcctcctcgtcata

SEQ ID NO: 26683 - DNA, 11541 bp, Oryza sativa
  unsure (1)..(11541): unsure at all n locations
ccgtcccacctccgtacgcgtcgcttcccgtccgtctcacactctcgtcgtttgccagcgatacgccgccgctagcgcagtaaaccgggcccaagggcgggaggaagagcgtgccaccagccgcctctcctcctccgccatcgcgctcgtctcacctcgccacctcagcctcgcctcgcatcacctcgctccgctgccacgttcctccctcgccgccgcctctgcgtcacccgccgcgcactccgtgtcccccgccgccgccgacccacccgtgagagagaggaagagtgaaacagagagtgagagagagagaggaaaagtggaagagtatgacatgtgggttcgacattttttttataaatagaatgatgattggactgccacgcgacgccacgtagaccaaaaccaccgcggattgggtcgagagggggtaattcgtctagtttgcatagttgggggtgaagaatgtccggttttatggttcaggggggtaattcggtcaaccgcgatagttcagggggaggggtaattcgtactttttcctattttctttagataatgtattttcattaaactggcctctatatcacgagagatatacatagccaaaacgatataaaagcatttggactcacacctcaacaaagagaacacacaaccaaaaaggaaaaacctacaagttcggcacatccctgcattccgacatcttcttttgaaacagtcaaaatcgatgagtggaagtcgtctagtcaccaccacccctaatgctttgtcactgcgaaactccattggtgccatcttcatacacttaagtgaactaatgccacgcgtcgccggttagcccacctttatctgtcgtcatccagtcagaactaaccgaccagacacaagatgaaaggttatggttccgtttcgtcgtattcctaagcctctgccaacgatagggctgccgccggcgtcggaatcctcctccgctacttggactcctagcccgctaccatctctgcttgaatcctctgccactaacgccgaggatatcatctttcgcctagactcccagacctttgccgcccctagagccactgtcaccaacgagatccacccacctgatccaccttgcatcgacacttaggtcaccgctgcccctagggcggcaaccaccgcaaccgaggaggtctctgctcagattcgcatgccaccgccattcttaggatcactgatgcctcgaaaccaccttcgtaggatccgccttctccttgccgaggattggtcgtcgacacttaagagttaagacgttatcgtcctctgcgacacccgctgtcccccaaagagacgctgctgccaacgtctcgccattccaccgcctccccgctgccatgcgcaggcccgcccaccgccgcccacgacccgtcatctcccgctccgcccgcgcgggctgcttggttatgtttgggtagagaataacacgtacgcgtggaattgatcatgtgaaatacctgttgttgtatatacgtagtatagtagtagtagttttctaaccgtttgtgctggtctataaagaaaacacttgtgctggtagtagtttgatccgttcatgaaattaatatatacttaggctatttaagacttttacagctgcagtacagtggtgctaacgtgtacagtcagagaagttgttgacgtatcgcccccttctttgacccctcgggcccgtgcgcgtgcgcctccattcgtcaaccgtaaatgctgcaatccttgcacccaatcaagttcacataatctgatgaaatttcacaaaagcgttattcacaaaccggtcagtattagctgattctcgtactacgttaatctaaagtcgtctgtttttattagtttttgatagaatttcagtatacattaataagaagcggttttttacttcgaaatcaaaaaagacaaaccctgcaaccaattgttcgctttctcacacttcacgttgctacttggcccacccgtctcacgatcgactccgcgatgcaacgttgcgacgcgacgcgctcgctgccacggtgcgggtggtgcatcctcccgtcatcggtggacggaccgacgacggtgtggtgtactggtgtggttagtggagtacgtactacgtccgtagccactgtgactgggcacaatctctcgggtattggggcagcgggctagacgacggcgacgctaccggccaaatggacccctcaattcccccaattcgtcttgtcgtggtactacctctgtcccaaaataagtgcagccatgagtttcagcgcctaactttgatcgtccgtcttatttgaattttttttataattaacaatttagttgttataagatgataaaacatgaatactactttactcgtgacttatgtatttaatttttttcaaaaaaaattaaataagacgagtggttaaagttgagcgcggaaaatcatggctgcaacttattttgttacagagggagtacatttgtgctagcacgtactacgatcgagtgcacggtacaggtacagtgcaggaccatggtggacagataggacaccacgcgtgttaatcctttgcaatttatttggatttcatcatttcattatcataataaattattagtcaaacacaaaaacttcgcaacttggagaatgaactgacaacctgacgtcaaaaaccatatttcatgcggcttaatttattggaataattaactatttaccactcttacgagtgggtaaattatttgccacttgacccatatgtcataaacacatgaggatccgcatgtcatagatagcgagtggcaaataattaattatcacatcttaaaagtggcaagaaattgaatgtccctaatttatctcacagaacagtaaggcagcgttcgagagggtgagagagtatgtttgtttgtttcgttttccgcgcgcacatttccaaaactactaaacggtgcgttttttgcaaaaattttctataggaaagttgcttaaaaaaatcatattaatccatttttgaaatttaaaatagttaatactcaattaatcatgagctaatagcttacctcgttttacgtatcttcccaatctcctcgagccccttatcctcaaacacaccctaagaacaccctgagactcctccctctcaagaagctctttggcaatcctgcggcctctttccaccaaccaatcaaccaccgggaggcccttaattcttaccatcggatccatgatcatacagtcaagtctaatagcacaacgaagaatgcagtgtgctagctctatcagcccctgccaatgacaggctccagacatgaccaccctcctgagctttatcatgccgatacggtggcatatccgctctgatcacctgtctgatgacgaaatcagagatgtcaaactgcacgcaacaattcagcgcacttgtgagactcatcgcataatgtttccgtcagtaattcatccaatgtttggaacgcatgaatttgtggaagaaggaaaaaataattggaatgaaaaaaagcaaacacaaaagtcaaaaccagagtgtttgcaatcaggttggtggtgttttatgagcagctgcaacaacaacatcatcaccaacaatagttagaaaatgataataataataatgcactaatatgttgtcttcagaacagatgttatcctaacgaatctaccttcattaatctactagattttatataacagattgttttaatctatttttaaaatttttctcttataatcatagatttcaagatgagaaactgggatacatcaaatcactctaaccctacggttttctatttcaaactgtgttcggataggggaagttgggaactaaactctccgcacggaaaacggagtggtccattagcgtgtgattaattaagtatttgctaattttcttcataaaatggattgatatgatttttttaaggaactttcgtatagaaactttttgcaaaaaacgcaccgtttagcagtttgaaaagcgtgcacgcggaaaacgagggagggaggttgggaacatgggattgcaaacacagccgagcatgtacacctgcagcttaagaatagggtcatcgcaattgccaataatttttataaggtgccaacatatttcaaaatttaaagagtgaatttcataaaaccccagctattattataatgcaagttgcacaaaaccacatggattttggcacgttgcacatatcctcacgtattatatcctaaagtttcacaaaaccaccctgttaaccaaattgacatactcctatatcgaaattttgaaaaacatttacttacatggatctaatgtttatatgatggataaataacttataatatgttattgtagaactaaaaaatatggtaaatcaatatcaaaatgatcaatagtgtggttttgtgaaactttatggccagaatacttggggttatgtgccacgtaccgaaatctctggggttttgtgtaacttagatcataatacctggggttaggtgaaattgactcaaacttaaaacaatccgatagtatatataggctatgtgacataaatgggatgataccattgaatatgcatatgaaattacttccatattgtcatgactttgtaattacaaaacaacagttaaagtaagctcaaaggtcaaattgtaattgtggcttaaaaatattaaaagaaggaatggttctagaacattatgccaataaagaattcaacaggcttcgaaatataaacaaatttgtattgtatcaccaaataataaggtaataaagcatggtagtctccaatttccaatagatagaaactttgttacccttttgtatttttcaactataagatcaaaatcaaccaactcgtatggtattccaattttaagcaatgtagttgtagctttagatgaatgaaaataacaaacatacaggaaatggaaaaaaataaaaagattggtttcagatgaatgaaagaaaagtaggtaattgaaaataacaaggatgatgctgtgccaccacaaaaatgtctacatataatgcatgcttaagaaactgtcaacatattatgaagttgttaaagccactcacgtgcagttccaattcctctagaactggagctacctccaagaggtaggccaaacgaagaatcccatcaactgacctgccgttcccataaagaggcaaatacaagttcagatgcctcaaattgatgaatctgactgaggttttggcgaaccttttcaactgaaacacaaccatgatagtctaatcgattatggatgagatgacgaacagatgtctaactgattaatgaatttaattgctttcagaaagagacaaattaaacctcatcatagatgtagagtgtctgaggtaatggagagtttctgcacaccaggaagaacagcaggaagctcggtgcatatgtaatccagattatcaccatagcgcacgctcttatgtagcagtttaaacttcatcacctttggagattcacttagtgccaacggaattggccgattgatcaagtcaaacgatgtgagatttggagcttccagctcaatcttttccaggttgcagtagtgcaaacaaagataacgcagccgcagcagcggcttgcacaaggttagctcggtgtaggaacagcagatgatgctcagccactcaagagcagtgcattccggcagcatgactgcatgaggcattgggagtcactcaaaaacaaaactttgtgcagggtgagcttcttgaggtttgcaaagccagcaaaaccagtggttgttgtgttcaggcagacgtaggccaggttaagagatctgacatgagaaggggagctgtccgggccactgaaaacatgcagtgggaagatgtacttgtcatcaggcaagcccttgaaaatgttcttcgctccaggagtgaaatcgaaagcgatgtgccttgctctcgacgcggcgcagaagcgaacccatccatcgacatcaacatcgacatggcaggtgtgcttcctgcgcagcccgaacttgacaacaaacttcctcagggtaggaggtgaacatagatgccgcagaagactgttcactctcctggcaaacttggtccttgtacgtttcatgcttgtattcttgggctggaacatggtgcctcttttcaagaccaatttcggacagcagcatctccacagctgctgccacctgcgagaaagaaaggccatccgcgaggactctctgaatgcaaccgtgacaatatgctgcgtagaacatcctgcacattcatatgtaggcaggtaacatgaataaagatttattaccgagtaaattggtttgttgattaattagtcataagtgataagtgatgagttcagtggaatcgtttagcagctgtttaagtatgaaaggcacattgaactggttgcttacatcggacagatggtgtagttgcagggcttctgaattgaccatgggaatagatttttatctgctatacagatgccaggttatgagaatgaaagaaacagattcatgcacatcttataaccatattcatctagaagattataaaaaaagcattagatataacccccaaataaacattggctaatgccttgttcggattcatggtgatcatcatctgtaaacctcaaaaaaaaaaaaaaaacggacaagtccctagcatagcatatcagtatatcactgaacagtcccaatattaatatgcaaataaaacacacttgcatacagatcaacccaaattactacttcaacgcttgtaataatggcctaagatgaagaagtagaactgaatcagagattcagagggcggcaccgtaaaaggaaagaaggcagagcggcggcgagcaggaccccgccaaggtggtaggtctggtgcccccagcgagctgatggcgcaaggccggctcgccggcgacggcgaagaggaggacgacgaagacgacgtcgtggacagcaccggctcacggcggacggcgcggacgccgggagccctcgcgccgctcgaagtttcggtcgcatccgtttcttcctctccgattaatgtataccggggattggatcttttgggctgacggctaagtgggccaggcccacgcggccatctctgggctggcgaggcccagtaactattggcgaaaggataacagagaggctgggcctgcatccagtgtcaagcctccacgcgcctcgaggagccgagccagtggctctgggcccaccatagccgaatcggatgccgcgattgatagggcaacgtcccaatcacttgtgccacgtgtaaacctgggaaaacgcctctggaaaatggaaagagatggggagttcgcgaccacaggattggatcgcctctgccctctggaagtggaacctggatgatgacttttgattttactgcttcatactaataaagaaagttatttaggataatatttaaatcaaatctttagaatataaattatgaataactctcaagttgttgagtttagaaatataaaaattatatgtatagatttatcttgaaaaatactttcataaaagcatacatatatcacttttcaataaatatttttttatagaaataagaagttaaaagttgtattttgaagattgtgtcgttgtcctaaacaattttctttactttataagtatggagggagtactagttttgacgttgtttacatgtgcgtcaatgctcggaggaaaagtttgattaggcaacaaaaaccagcggctaatttttggagattaaccattttgccttcgtgatgatgggaggttgggatacttgctcaatgcctttctatgcgtggttttgattatgaatgctgtcgttatcttggaactttgacagcaacggtacatataaacttgctgaatactaatatgtcactacatttaggatgtatttgaggagaaggggattgagttgattgggaagatacgcaaaacgaggtgagctattagcttatgattaattgagtattaactattttaaattttaaaaatggattaatacgattttttaaagcaactttcctacagaaaatttttacaaaaaacgcaccatttagtagtttgggaaacgttcgcgcggaaaacgaaacaaacaaactcactctctcaccctctcgaacgctgccttagtttttttaaaaaaaaaatacattttctaacactgtacaggtagaggcgagcttcaagattatggcaacttggatgattgctgcaacagatgtctggcttcagctaggctagctagctagtcgggaataactttgtaaaaaggaatttgcttggggacttgtcccatcaccttatttctcattttgatttacttttatcttacctttttattactattaaatttatggctgtgtgtcttatgacagaagccggagatgtaatccatttttattattaaaaaaaggaatttgctcggattaacaattattccctgcaacatataacagcagagactatagacactcaagctgatcatatcatctttactcgtttcctttgtttattttccttaacccctggatgaaaagcacaagtaggtgcatttctcttttaatagtgagagaatattgcttcttcttcttcttcttcttcttcttcttcttcttcttcttcttcttcttcttcttcttctctctctctctcttttaaagatggggcatctacaacttcatctactaatgtgtcgttatatttattttttaaatttacatttgctattacatcacaggcaaatttgaaattttggatgttctttgtgatatatggtttcacctagagtagctaggcaagaataactatgcaaaaagaatttgctcatattaaaaagtactccatcatattaaaaaaaagtcaaattaggttgggatttgacaccatatataactacgaatctagatatgaggttgtccaacttcattgctttagatggtgttaaatcctcacctaggttattttctgggacggaggaaatactcccttgcaacatgcaacagtagagttagttaactgaataacaaatcatgttagtttttcttatctccgtcgtttattttccttatctcctagatgcaaagcacaagtaggtgcagttctctttaacagggaagaatgttactgtttctttataggtatctaacttcaactgtaaaccataatttttcttattaactactgttaggtcttatgtcatctagaacatcaactatatgtaaatcggtatccaccatatagttgcaaactggtaaccatagaattgtgaaataggagtattttccaagctaatcatgccacacaaatgaaaaaaaagagtaggttgtaacatgacaacttaacgatatataaatctatacacaattatatctctaaattcattaacacctatataaatgtgaacaatgctagaaagtcttataacctgaaacagaggtagcaacaaataagcgcaaaaaataacatgagaaagtgtgcacgtgccccagtgacatgcatgtataaaatgtgagcaccattttgaaaaggctgtacaccagtattttcggacaaaattatgaaaagtaaaatcactgccaaaacctagcaatcgacaaaatcagctgaaaaatcattgcaaaaagtgcatatgctgcccacggatacgatggaaaacaccaacatacggcctcttaaaagccagaaacggtacagatggcaccagccaccagcacagttttttccacggcattctctatttctttacgtccacggtaaaggaaaagaaaaaaaaaagcccatcgtttcacttacgtttgcatgacttaatacaaaatttatatatacgtgtccatttaaaataatgctaataaataaaaaatgttaaaaaatatcataaagttaagttttaaaattcaaattctaacatataagatctagttctcttcttcaacttcaaacttcaatattcctgttttccattagtgcgtttttaagctgttaaatgatacatattttaaaaaaaaattctatacagaaactgtttaaaaaataattaaatcttttttaagagaaaatcaattaaatatatttttcaagtttataattattaaatatttaattaatcatatgctaatgatttttctcgttttgcatatgctaaaaatatgtagcctaagtataatcataagagaaataataagctgaagaaagaaaaaaacactttaaaaaccgccccaaaaatataagcggcggaaaagaaaagggataaaaaaacaaaacggcacaacggaatgatcctctcccgcaccagctataaaccgccacacgccctcgtcgctctcgcccccgcaccaccactccctcctcctccatctcctccgctcccgatctcacaaccaccgactcctcctcctcgcgcggcggcggcggcggcgtgagccagcagcagccatggtgctgttctcggtgacgaagaaggccaccacgcccttcgacggccagaagcccggcacctccggcctccgcaagaaggtttcccatcccaccaccacctcttcctcctcatccgattgtctccggtttcccgtcactagggccccgatctggatctaggcgcgacgcgtggtggatgggtaaaggttgtcccgatctccgggttcccgccgcggatctcgtcggcggtttgctcgcggcgcgggggccttttcggctctcgcctgaatggtggcgtgggctgggatctgatactgactccgatgctcgccgtctcgagtctggaatgtgcggttcctcgttgcggtggttgattttgtttgtcccgcgaccagtcggatcagttagtctcgtctggagcgttggatcgatgccggattcgattgatctgaattgtatgcgttcgtgggatttgattcaggagatttttttttcgctctcattgattagctttggctaattgtatcgggatcttgccgagtagtttttttttatttttactcattgttagcgatttgagcccgagcagataccgaaggtagatagtgactgtgtgccctctggcttaggatctcaatccggcttgttgctgctctggatttgttagttgttagcttgttagtcatcgtgaggaatgtccataagattctagaatgtttcgctgcttttgattgggcatgcctgctgcccaattagtagcatgttgcatgtatcagtgcccagtctattctgatgagtctggatccaggccaaaatgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26684 - DNA, 1339 bp, Oryza sativa
cttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagattcttcattcatgccgagatgagctatggtctattttttttccgcattccatgcctggatgagtttggttcagtctcggaggtcgtctgcacatacctgatcttgccgctagtcatttggaaccttggtattcacatcttcagacaactcgctgaaaatattggatgtttcagtcaaacatctactgaaattattggatgatcagtctatatactatcacatctcctctcctaccctatcttaataatgtttgaagacattaagcttctctctctgcttatgaaacggttttcagattattgtgcgcatggagtatgttgtatatggaggagtgttacgaagtaatcgaactatttttgcaattggttcaattatcccatgagtagctatgagttcaacaggggaaaaaaatctaatgttacaaatttcaaaaagccaagcgctagtgtctagcgctgcctccaccgagagacccgactgtgtgcctctatagggcatctttttggcagggggtcgcctgccgtgccccagtaggggatcttttcactgctttttttttttttttgcagctgaaacggtagtgcggatacacgccctaccgctgcccattgcagtcggggtgggtgcctctggggtggcgatggaatggaatcaaatcgagctaataaacaggtcgtgttgtctcagaatcggcgatatggtacaaaactaattgttggatggattcagtcggagccaaagaacagcggcgcagaccgacctaggagtagaggcggaagcatacctgctctccacggaagcccggcggcgaggggcgccatcgatctaagccggtgctgaatattcgcgccgccgatgtaggcatgccacggagactacaccggagatccac

SEQ ID NO: 26685 - DNA, 1585 bp, Oryza sativa
gagggagtgagaactctcgggtaccagacataaccgacctcgcccttcactcgttaaatcccttggcaaatcatgctcatatccaatattgtttgaaagtaatttttcccctatcaagcatatcataaaacccaaggaataaattccgagaagagccgtattaaacaaagggaagctaagacgcagtttcctttacctctgagcatacggtacgtacacatgccaagcttggcaccggaagcaccgccggtgccatcttccattgacagaaatgacgccgacaactctcatgtgcctagacatttgcaaagccagaaacgaacctgatcaaaatgccttttactaatccaaatcacaacagcatgaatcgatgcgatctcacacatataaaaaaacagtagccattaactagaggaggtaggaaatacgtacatcgagaaattacggcccatgtgccatgttaatttggttaatactgcaagcccctgcaagctgcaagcttcacggtgttctacacagacatgtggttaaaataaaatggcacactgactgtaagtggagtcaacgcaagatctgtaagaatgacaaactggcaagtgaaaaatactggcatcctgcgccaaattccagaagatggaatgaagaaatgctgatccatgaataagatgcagagatgtatgtagcttttgtcagagattgtagaagacatgaaaagaattgataaattgatgcgatcactcaccagatgcttggtgtaatttcagtggtataggtttctttttacttgaattcagtagtataatttgtccagcaattaatcaaagccccaacaacttcagtgattaattccatacttcattagtatcattaccatcctggagaacaaaaatgtatatgagaattatatttatcagaaaatacagataaaaatcagacaacttaaacatgagtggtacggcaggatgcagtaagcgcaaaagatttgtttcaatttgggaaaaatacaaaagcaaacatcagatttaactcaaacaagtgctatgttgacatttttacgatcatttaaagcaaatccagttgactttgtcccaagacaacatttgagcttctcaaagtacggatatgtgatgaacttgtactaagatgtaccgttataaatttgcaaattgtttatagcacaagttctggggttttgttcccatgagcatccatgaaaaaagaatatgagtgcacagccgcacatagggcttagtctgaaacttggaggtctgaatttactggtggaattttggtatgcatcacctcgtaatccacaactgacttaccctttctgacttgcagatcaatttgtctatggaagaacagttcaccgcgtcacttgcattagttgggtttctagaccagagtgtcggtctacacaaaaaccatcagatcaatcaaattaatccaccagtcaggagtaactcctttgaaagattcctctgaggaacgactgatatctattggagctgcacaaacctgacaataatgagggactgagttgaacaacagcaaatcattggtaactgttccgaaggcattgact

SEQ ID NO: 26686 - DNA, 655 bp, Oryza sativa
gccctgccgctgcagccatggatgcctccgctatggaagaggtgaataccgtaccgaggaggaggaggatgcgaggatgtggtggcaacaggagcacgcgacggggaggaggaggaggaggaggaagaagcaaggcatgaagagagccaagaacacaagcaagcgaagagccgtgtgctcgatggctggaagtttcgaggaaggagggagagcgagaggaaaaaagttaatagaaaagatgtggaggagaaggtagttggagttttggataaggatgaagccgtccgatatttcacatgcgctcggacgtacgtcggaaagcatttttgaataattaaccctaggaactgtaccatttcaacaaactaagacaataatttggggagggataagtcagacttttcccaaatccaaatgataaatgactgattggagggacatcaaagaaatgtaatcctatggcaagtaaaaaaaaagaaatgtaatcctagatattattttcccctgtggctgtgttgagaagagtttaagattataagaaaaaaactgattgaatagttaagtttctaataaactagaaaagttagatttcataccttcttgcttcttgtttattttctgaattttataacatagattctaattaggttacgtt

SEQ ID NO: 26687 - DNA, 696 bp, Oryza sativa
cctatgttgtttttgggtgatctggactaagtaaccaaatttctaaaattcagcacaattattggctcatcatttcatcaatgccacaatgaaaatgcaagcatgtgggaaaattctggtttcattcctccaagctttcaagcttatgtgattactggaaaaaatgcccgtgcattgcaacggaagaaaacatgagaaatttaagaaaaggttaagaaaaatttacattatgtaattaattaaaatataaaatcacaactatacatgtatacgatgttgaagaaaagaaaggctcgtaaaaatcaaggtaaatgtggaaaaataaaattttccaaataaactatggctggatttattttttattaaattctccatgattaattacactatgtgaaatttttccgatattttcagagcaccattgctaatttaataatacaaacatcattttagcatttatttaaatggaaatctaaatgaaaaccctcctttctccctgggccattttgagcccattctttctttagcccgtagctgagccggcccattaacctcacttctcctcccttccacctcggcctgcaagcgcgcatccagcccatcaagcaaccacaaagtctaatcagcatcccttctcctcctctcactgtcgcgtgggtcccagtgctacagggtcgtcccctacctccgtccgac

SEQ ID NO: 26688 - DNA, 638 bp, Oryza sativa
ggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcaaggtggagatgtacaggcccggcagggtgtgcagcggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagagga

SEQ ID NO: 26689 - DNA, 1226 bp, Oryza sativa
  unsure (1)..(1226): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaattttgtggggaggcccacgctatcctgcgattccaccatatccaatcctccttggtatcttgggtaaggtaccgaggtggtacctggtacattggtatcagctggtaccctggtatcgactatcgactgatacctggtacaccctagtatcgactgatacctggtaccctgggtatcgagctgatacctatgtatcaggccttggtacctaggtatcaggtcttggtacctgggtatcgactgatacctggtaccctgggtatcgagctgatacctaggtatcaggccttggtatctgggtatcagtgtgatatcccaagagagaggaggaggaggagtcgtgggtcagggaagtcgagcagcggggcgacggcggaggaagaggaagaggaggcgatagatctggtgcctaccttgtgccattccgtcgctcgtcgtcgtgcctcgctccaaaccgccaaacccgtggctccattgacgccgcctagagcagctcctcgtcgctcatgttgtgccaagtgctcgcccccggtggccgcgtccatcgctccccgaccgtaggaggcgccagcgccgccaaggaggaggagggcggcagcggcgaggaagctaccgacaagaacgacgaagaggaggagcgccttgaggagcttgatggggaggcttcttgacggcggccgtcgcccgtggtggtcgggagctccgccgactgtcgtccaggtcgtccgcgggggctggtggtgacggcaccgtcgtcgtcgttgccgccgccgtcgttgccgccgtcgtcgccgttgccgtcgccgtcgtcgccgcctccgtgctcatgggtggtattcacagagagagggatcgaatggaggggaagagagagataagggagtagtactattccgtctccacggaaaaccgtaggatagattttctcaaagataaaattctagaagaacaatcaaaaggaaagcatcaacatgt

SEQ ID NO: 26690 - DNA, 1809 bp, Oryza sativa
ttcatggagagtacatttgtacatatatacagtacactgatatttaattgagctttttcttaccagccagcagccatgtgctcgttggttgcgactttgcaatcgtttacgtcgtcctctgtcgtcgtgcactgtgtgaatggagcaactgttgtctgtactactccagttgtcatgatattcatgcgttccatacgaggcgagcgtatgaaatttaatggattttcacagaaactaggacaatataacatcactgttatgtcacataagtcgagccagccattatgagtgccgttctaaaatatactaactccgtcccaaaataaatgcaactgtgaaaatccgtgtccaatgtttgaccatccatcttatttgaaaaatttataaatttgtttttaaaaaaattagtcacacataaagtattattcatattttatcatctaataacaataaaaataataatcataaaaaattttcaaataagacgaacggtcaaacgttagagatgaatagtgcaaaacttattttgcgacagagggagtaaatacgttttaaatacttctatttatattaagtactcccatcatctaaatctggacattttctagtactacttcagcattgttttacttcaaaggatctatttgtaaagtatatatatgttggtataaattttagatgttacgaatgtttatattttaaagtggatggagtagaactgatctatctcaccctgatccaatgctactacactggagaactgtaagcgaagtcaaaatctctttagagagctcttctgtattgcttcacagtactcgatctgttaagctagttagaaacacgaagaggtttttagctagcttcataaggtggtgggctagtcggcttgagtttaaaacctcacctattttatttatttgatattagatatttctctaatatttgtgtttttcttctgataaaagagtttaaatttatttttaggatttaattatttttgggataaaggaagtactaattcacaacctggaaactaagatgcagctagcaaccaactcaaaagcaagcagcaaagttttttcgaggggattttttttttcgaggggaaaaaagcaagcagcaaagtagctttcccttccctcccttccttggcctcttcccaacagtgcaatactgcactgattctcgtctcatcagatcagttggaatcaacagtgttatgtcttgtcggattcagatattcagacatcacagacacagcctgataattcagcagtactagacgacgtgtagaaaggtgataaatttccttttcgcatcaaaaaatcagcgaatatttaggtggtgtttgaatctcctcaagatttgaagataaatattaattgttttacgcaaaacgaggtgataataacgtgtgattaattgagttttaattattacaaacttgaaaaatggattaatctgatattttagaacaacttttacatagaaagttttcgtacgaaatataccgtttagcagtttgaaaaacgtatcattttaatccaaaagtttatcctctaaaattaggctgctttttatgtgcacttttccttctgattcctagttttttcatatccacgcttactgagctgctaaacggtgttcttttcaaaaaaaaactatagaaaaattattttaaaaaattatattaatctatttttaagtttttttataatagttccatccaaaaatcataaggatattttatttttttattttttttcaaatgagatagtcatatttatagttttcatgcatccagcactt

SEQ ID NO: 26691 - DNA, 5023 bp, Oryza sativa
ccgtcgctatattttaggtgccggagataaaagagttctcaacctccccgaaagaacacgggctacgaatcatcaaaaacattaatcgccactctctattgaaggtgtctagacggcggctttcagaatctcttctccttaactttttcatgatgctagcggctagcttgatgggtcactatagctcacttgttagtctcctttctgtctagttttaaggcgctgatggatgatggatggaagttagtttatgacaattactttaaatattagaaagctaaaaggtcgatttaattaagtttctttaagaagtactccctggttctatattaattgatattttggacaaagttaaggtcaaacttttataactttgaccatcaataactttaaaaatatttagtttaaaggaactagaacaacatatatagatttgtcttttaaagcactataataaaagtaaacatgcatttatttattatatatattataatagaaaaataaggtcaaagatatatcttgtagaccgtgttattatccaaaacgtcaattaaaatgaaaccggaggaagtactaaggaagaaattagttttttcttttataaaattcgtacacttcgtaaggctgaaaagcatgccctgaaatcgctcttgcagacacaacacaatgtttttcatcttctctcgacaggtaaagaatgcgatggtaatgtggacagttggaagcatttcaagtttgcaactgcactgaaaggagtaatactcaaagaaatgcatagcaatattcacaagtacacatgcaaattaaaaatgatgatgatagtatgatacatcagtgttaataagaatttagtaagaaaaagttagtatgtatagccttttttttattttgcatgttagctttaatcgtgctacaactagcaatcatcttttttacctccttactcaattaattaattattctatccgttctaaaatttaagaaattttgcttataatttgggaccgatgtgcaagtaattaatgatcacagtagtcctttcgcagttggttaaaaataaaacttgcaataacccctttcaagaatcccccaaccgtcaacagaattatttgttaactaatcaccgacaacacatttgggtggtcaccataggttcaaattggtctttctcttcggaataaaattcattaaaattaccactttgcagtacatatcgcgctccattcatatatattggtgcaatcttcttttccaaacttgaagccgttggtaaggaaaatattttttttgcaggaaattaaaagtacttatttttaaaaacctaagccagccgaactggttttgtatctagagaggtaagcactgtacaggagtcaccaaaggtgacaggagaagaacagggggaggtcagtagaaaggaaaaaaggaaaaattacatcttaggaagtagctaaggaaaacaagaaagtactttttttttgcacgaaagagaaaagttaattaattttgatatgatgtttcgcactatatgtgatcagtgtacgtgacatattcatgtgattcttttagtacttccacagttaatgttctaactttacaaaaaatattattctgactgcaggaagaagtcaacctgccacttaaaaaaccagtcgatctcgagctgattagccgtaataaacttttatatgtgtgtttctactttctagggacttataagccaatattgaaaaatagattatgatgaaaaaacatcataatcaactccaaaattaagatttaaaactttgggtactagtgataagctgaagagtaaacaatgatctatttgatcatagatttgtagttccagccaatgtctacctcatttagccctttatgctctactccctccatttcaaaatataagcatttttagcatagtgtcaattcaaacatttttaactttgactattaatagcaaaaaaataaaaaatataaatcatgtaaaattgatgttactagatttatcattaaacaaactattataatatgcaactgtttttagttgaaacatcttatttttatatagatattgttaatcaaagtagaatctcgaagactgtgacgaagtccaaaaatactggtattttgagacggatggattatttatttcctcttacatggggctccgccatcaccttccctctgtataggagtagtattttttttccgtagttttttttaaccttagcactttagcggtctttctgtttcctttctcttttttccttgttcccaagaaatggccatttggctggttgtgttgtgtaacaaaaactatgatttcttctaatacatcgaaattcaatctttttacacgttcgcagaaaaacaatttcctcttacatattagaaactatcacaggcacgcttcctaaacttataaacggtgtgaatatctaagaataatattaaaacaactttaattttcaactttgtactagaaaattcattcatttgtacccttaaaacattattacaaaatcagataacgtatcatttactatataatcagacaaaaagaatagttgcagagaccatcgtggctccatatcatcatataattaaagtcataagtacaaaatacggactttaaacaataaagtactccaatttcgtcatgcccaaaataaatcatggcaaaataatacggtttaccgtttatgtgacaagttgacggatgtaggaagccggtttatttttttgctgaatggctcaatagctaaatgatttttggactcgaaagtacaaacaaataaattaattattataaagttgaaaagtaaatttaaaacatattttaagacattcacatatactatagagttttatgaaaatcacagagagctgcaggtgaatgcaatccttccattctttagaaaagaagatacctttaccttataacggttccttgaaagcacatcaagtagtattaaagtaaatttattcgttgaaaggcacagaataaaattgaatccggcatgcatgtcggaatctttagtttgggttcgttttctaataaaaactagtaaatggaaaataaattgaatttcataataaggcactggctactcctacctagctaacatttgataaaatattcttaaaaatctattaaacctaattatggcataattatgttgtaattataatataacaagcatatgccattacaatagatttcctcgattttctcttaatttttctagcgaatgttttttttttgcggggaattttttagcgaatgttatgtaacaaattaatccgattgtaaattaatatatgcagtctgcagaatgaccaccatcaccgtcagtgttaatctctggcaacaaactgctcttggtcaaggatgcagacgccgggacagtagccgtacagctgcccagctctcgatcaacttggttttccatcaaaattaaaagtttggttaaaattaaaacgatgtgatggaaaaattaaaagttgatgtatgtagaaaagttttaatgtgataaaaaaagttaaaagtttgaaaaattattttagaactaaacacggtctatattaaggtcataatgatctgatcaaaatctcataactagccggctacctagaatgtgttagctcttgactctttagaagcaggcaggacatgtgttgaagtcgttctctttgtcagtctcttccatagcttaatttaattcgcacactgatcagaccaagacaatcaatcaagacgtcagcttgattagcaagtgcattgttgtgcacatgaatgccccagttgattccaacacgagatgacaagagtgcgtgtcgatctggccttgacaaaagctctcgtcaccctcactgcattatttctattctcctctgccggccgtagacgttttaattattacaaagttaaaataatagatttatttgatattttaaatcaactttcatttaattttttttcttataagatatattatttagcagtttaaaaaatatggtaacagaaatcgaggtaaaatatatattaatgaggaaagaacaccatccacgctgtgcataggtcatggccggatagtagttataaaatatattttaatgctacgaatttttataatgatccatccagatttactagtttgctacttcatccgtttcatattataagtcattttgatttttttctatagttaaattattttaaaagtttgatcaaatttatataaaaatataacaacatttcgaacacagaagaaacatattgtcaaaatatattgaacgatagatttaataaaattaatttgttgctgtagattttgctaaatttatctataaatttggtcaaacataaaaaaaattgactagaaaaaaaaatcaaaacgagtaataatataaaatggagagagagtatattttaaaatgagtgaatagctagctaggatgcattgcgtgcagcactacggtacgtactgtgtacaccgtagagaggcagctgtactgagtacactgtggccgagctagctagtcgccattcacgggcatgtacctagcttaggctttggactgcacagcgatatcacgcgtgcattgtcaccgtggccacagggcaccggcggctagctatcgagtacgatcaatcaatggatatatcgaacggccagccgcgtgtgttcattgaatgaagtgggccggccggcgaccgagacgaagatggtgcatgcagtgatgagatctatctctcacgacttcgtacaagtgaagtcaatcgccctacgcccctaccataggtggaggtagaaaggaatgaagagtgtgttgcttgagttttgatcgatgcagagtgcttaagtttacattgagggcttggttagttcgcaaaaagaaaatttttgggtgtcacatcggatgtttgaccggatgtcggaaggttttttcggacacaaatgaaaaaaaaataatttcataacttgcctggaaaccgcgagacgaattttttgagcct

SEQ ID NO: 26692 - DNA, 4313 bp, Oryza sativa
gtctcgcgattttctcccctaattgtgcaattagttttttcatttatctatatttaatgcttcatacatgtgtccaaagattcaatgtgatgtttttgggaaaaaaatttggggaactaaacggacctgagtggtgcacatatgataaaaatagataaattatatcttgaaaaaaaattcttggttggattcctggtagagctagaaagttttcaaagccagaacaattaatctagctaactgtttacacccaattttagcacctagaattaaaatagggaaattgccaaagtttggacgatctgccggttttcctctgagagggccgatctgaccgccatgtactatccggccagaccgccaacagtggaccggtcagaccggtggtgtgtggccggtctgaccggcagagtccatgttcaggactgtttcaccgggtctcgaggtttccttgctcgggaaggcatgtttcgggtttcttttggattctatcccgaatagtacgtggaggagtacctatagagggcaagactaacccatatataagagggtaaggctggttcattgtaaaaaatcaaccaattatcaatcaatcgaatcattattttacttttacttctagttctagttcagtttgtccatctttgtcgatttgcgccgtaaatcgtccgccgccgctgcgagagtgcgacacctctttgtagttttgtcctgaaaaccttccgttttgctcgcgagatgggtagttatccatagtttcatctagatcggctccgctagccggtttagtttattaaaatcctatattgatttagcttttgttagattggggtggttggcgactctaagatcaccgcaaagcgttaggtcctgcaatcgtgcttgccaacttgtcacaataagttgccaacactaaccacagcaactatttgctatgaaaattttgtgttcgattccataatataacaaattttacaggtgttcgctgcgacgagcccggggtcaccgggcggtggctccgccaatcgtgagcacccctcaaatagtatagatctgctcctatctaccctaaaatacacatgtaacatagggcttatttgacacatgattttcaaaacacaagaactagcattttttttttcatttcaaatttggttgatttttcccaatcgtattcctttgttccaaataagctaatatgaaagaaatatctttttatttcgcgaacgcaatatgaaagaaaaatcatcaggattgaattgaaatgcttcaaatttcctttgaaattctttggattataggagccctataataaaaggtgccaacggtttttgagctgcattgctgcatagcatgcggagttgctgctactgatcattatgatcaaattgaggtcgatatttatgagtcgttgacgcccatgacgaccggacatgcatgcatgtattccatgtccagagttccaggctaattaattacacgcgtgcatgtgttctttgtccaatctcacagcgaatcgctgtactctttggtccctcggtcccattttaactgcagctgtaattttccgtgctcaactttgatcgtccgtcttatttattttttttaaaaaaaaaattaaaaacacaagtcacgagtaaaatactattaatgttttatcatcttataacaacaaatatactaattataaaaaaaaatttaaataagacggacgatcaaaattagacacgaaaactcatgattgcacttgaaatataacggatataatggagggagtatgtccaatctagctcacacggtcacgcctagtaagtacataactctgctctatcttaaaatatacgtcctccaaattaacaatacttattattgtgaataaggttgatgttaaactttaaaatctttgattattaatagtttctaaaatacttgtcttagaaatataaaatataaaccataatacttcaatatcgtaatttgttgataattctatatatattgtaatagaaaatagttaccaaaattattttctgaggctgtgactttgtaaaaaaaaagtattatcaactcatagggagtatagcaacctaatatcagattaaacacattctaatattacgatggataaaccttctattcggattaatcataataggatgtgtctaatcgatcctaaattagaatgtgcctaattcgattctaaattattatattttgagataagaggaaatatatcgttggcatattcagacgtctgccacgagaaacatgataattcgacccattctcatcgtctctgttctatgacttcacgacatcttattaattttacccctgcaccccattgcaccaccggatcatccttctgaacccaacctaaactcatattcttagttaatttcctatttactacatttcatattataattggcattaactatttttctaaaacaaacttctttaaatttaactaagtttttagaaacaaactaacattaaaaaagacgcgctatcaagatatattcaatattatatttaatataactcattcgatattctagatgttgctatatactcccttcgtttctaaatatttgacgccgttgacttttttaattatgtttaaccgttcgtcttactcaaaaaatttaagtaattattaattcttttcctatcatttgattcattgttaaatatacttatatgcatacatatagttttacatatttcacaaaagtttttgaataagacgaacggttaaacatgtgctaaaaagtcaacggtgtcaactatttagaaacggagggagtatattttttttaaaaaaaatgatcaaacttaataagtcaaaaaagtcagagcttataatataaaacggaagggaaaatatcccatcccaaaaggctggctgctttttatacaaataactataccaactaaaactgaaacacagctatatatatttatggatacaagatttaaccaactcgatccaacccactacatatacagctccttgtagtaaatccaaattaaggatctgaatgccaactatatagtacactatatatcgattagatatatcttggatgacaccaacaattttattgtatctatatatgcttttcaaatatgcttccgtcggaaagccattttatagtttaaatgtgcatatccttcgtcaattatctaaataattataacttttttaaagaaaaaaatagcgatgtagtatattacaattgcatatccatcatatcgttccataaattcaccaaaaacaaggaggaaaacaaaaataaatccaaatgcatatctgatatatattctccacgtgttagatcaattttttactcttgcgcacatgcatggtttgtctagtacaataacaggtaataatataaactgagacatttttttctaaaaaaaatcttagttatttgaatagcatgcaacgagaagctgcttgcaaaacactctccctctaaaatacgtgccgtgccatttgtttttttctttattttcttttaatttttgctttgagcactgtagtgtatgccgtacatgtgccaattaatcagcaagagaagtagaaattaaaacccaaccagccaagtgtgtgacagaacaaaagttgcactgtaccgcgtaccggtaccaaccactaaccaaatgcactgtcgtacttagtcgtctgacaacctgaatatctgacggtatacaagtaattactctctccgtctaaaaaaacaaacactaaatttccgtgtccaacatttcaccgtctgttttatatgaaatttttttataattagtattttcattgttgttagatgataaaacatgattaatactttatgcgtgacttatctttttaatttttttcataatttttttaaataagacggacggtcaaatgttggacatagaaacccagggtttatttttttgggcggagggagtattttttaacgattcacactggggtaggagcagaagattacacaactctaggagacaatatggatctcatcacacgttgtcaatctcactgtatacaaaggattcttatcgatacaagtttacagctaatcaaattgttgagatatatagtttaactaattatatatactgtcacaattttatcttatggtaatattgtaacggtttcatatgagcactgtagaaacgaaaaatccatgtactacagtttcttcgtattaaaacaaaaaataattaaaatcatagtaatagatgctagctttaaggttgttgtatacatacaccgcaaacattaaggctcgattgaatgt

SEQ ID NO: 26693 - DNA, 8993 bp, Oryza sativa
  unsure (1)..(8993): unsure at all n locations
aaaaggtaatttttaaatttttaaaaaagagaccttaggacccaatatatatatatatatgtttcctatgcgcgtggcctgtccccttcggcgcggtggtgaagttggcgacggaggacagagatctagccatgtgattgttaagtgcgggagctgaggtgttctggagtcgacggcggcgtcccttcggacggcggtggcctaagtgtcgccggtgtatccttggcaaggagatagcgggattgggtggaggtggtatctttcgcaacagcgtatggcagaatcgcctgggagtccgggcagaaggcttctccggcggcggcggcggccctaggggcagcgtccaaccgagacggtggcagcctgagtgccagttcaaggttcgcagtgaggaggcggatcccgttgacggtggctgccctaggggcggcagatgcctgggagtccggtggaagagattgattttcctcgacagcggttccagaggtctccgacgacggccttggggcggtgacgagctgggaatccaggaggggaggaggatcccgaagatggtgacggccctaggggcggcagaggcctaggaattcagtgaagcggaaatggatctgtcggcctgcatttggttggcttgtttaggctgggcaacgacggatgaaggtgggctaaaccgggacgtatgacatcaactcatctgaagcgaatgaagatggcatcagcggaggctcgcggcgacgacgcactaggggcgttgacgactagacgacttccactccgaatctcgctgatttaggagaggatgtcggaaagcaaggatgtgccggtagttgttttttctttttcttttggttttgtgttctctctattgagatctgagtctaagtgctcttgtatctttttggctgtgtatatccttcgtggatatagaggctggattattaatgaaaatccattatctaaaaaaaatatagtcaattaattagtgatagaatgcacgcgtggtgcatgtatactctatatgtcgatctgattattaccgaaccaatacttgcaaccaaatctggttgaacaaattaaagcgtggctgacgacgattaattgtgtgtgcaacgaaaagaaacgtacagtgtgcagtgtatacacggaactggccatgttcttgcgcattgtcaccgtcactcgtaacaatgttcaggcttcaccttaattaatttcgctcagctttgcaggtgagctgaaccgtacttgcattgtggcttacaagtgtacagatcgtggcttacaaagttattaaaagctagctagataaagttatttgctttgctgcggaatatatggacaaatttatgttgaatgagaacttgtcgatagatttgatttgggttaaatatcataaacagtaccgaggtatatattatatcgtaatactgtacggcatataacatattttgatactgtaaatctataccgagatatatattatcctgtattatttagatttgtttattttagaatgaaagaatacgcaagtagtgaaaagaataacttattcaaattaatggatatgacataacattcatgcgaacgtggtcaccatactttgtcatcaattccattctgaatgttctggttgacattccggcgttctcgagccgtagttctatttttttttattatgtactctggaaacaatctgtgtcaataaatgtgtatatatgattaaaacagctagcaaaataaaaaataaaaaatgcgaagtgagcatagctcaactggttaggttacttgtggtggaaccagcccacccgggttcaaatcctagagttgacacgggtgctcgcatttacggctaattattttttcagtggtagacgacgtactcgtcgacagcgaggcacctatggtgacttcgtcaatctcaagacatgccggcccagtcttacggaggtgctcataggggtagggtgtgcgtgtgtaataataataataataataataataataataataataataataataataataataataataataataataataataataataataataaagaatcaagaaatacatagacttcaaaagtggttttgggtaggaatctgacttcccgaactgagcgttcgtttgaaaaacaaaaaggcacaaaagtccctcgattttcacgtgcacacttttcaaactgctaaacagagaggccaccgctaacttgaagaaagccccaaagaaagcactccacacgttaacactcctggtcaactgggaaatctagaacgagagaaactgtagaattttccagcacaaagagctatctaccggaagtctgttggctaaaattaaagaggaggccaaaacatggtctcgggcaggggcgaggtttccagcacaaagagctatctaccggaagtctgttggctaaaattaaagaggaggccaaaacatggtctcgggcaggggcgaggcatcttggtagctggcttgctttataattttagctcatttggaccgaaggtcctgagccttgtttttcttacttgtaaagtttactccttctctattcaatgaaattggcagcttgccgattcgttaaaaaaactactaaacagtatacatatatacatatatattttaaaattttataagaatgttttaaaaatcatattaatctactttttaaagtttaaaataattaataattaatcatacattaatgactcatctctttttcttttattcttaatttcccttttttactcttctcaaagacacagactgcccgaacagatggagaagattgtgttcccttaagctctcctctttgtattcaaatcaataatccacataagaaaatatagccgggtcactagagctattatcttcagaaagacccaaacctgataaaaatctatctattaagttttagacgatcgatcatagctttaaacccctcgtcgaacaccggtttaacgccgaaacttgtactatcattttgttcagtatcaaaatggaattaataacccgtcctcctcccgtaaagaattacctaaaaatacataatgatcgtatcaatgttgaaatgctttggtaggaaaaagaaaaacaacattttcatgatggaattcgattatatatatatatttattatttgcagttaattatgttacaaataataataaaaaaataatacaggaaggttagcttagcagtaactcgtttgtttttggtacattcatgccgtctgctgcatctatcacaaacctgaccctagttacctatttctgacgcacatgattcataaaggaccgatatcttcccttcgagcaaccccaatcaatgcaagaatatttattttgaaggtagaattattcagaagttactggcattctctctggtactccttccgtaaaaaaaaaaaaagcaaatttagtttgatgggatatattacagtgcaacgaaatctgaacatacttctcatctactctatccgttctaaaaaaacttaaatccggatttaaagtactatgatgtgctatattcaactaaaattccttatattttaagatgggggagcactatgtaagagtagtatatgagactctgacacgtacgcacagctagatcgaagccctggtcgagtttataaattgagatatatccgtcctccattctcaggccagttcttgcaagactcttgccgtgttgagactgcagaaacgagagctagctagccagaggctgcaagaagattctgcacccatagatcgtctaccatggccacaaacccaggactcttcacggagtggccatggaagaagcttggcagcttcaaggtaatcaaaattaaccttccatcttcttctccttaattcagttacttcactgtcttctggcagctcgatcgagcaaataaacgcacagcttctagttccatccatggcagcactgcaccatgaccattatgttcttgtttgagttcgctagcttctgtttgatatcaaagcatacattgccgcatgtgcagctagcagtgcatgagattaattctcttgcatctgctgcagatcagtaatgcaggggcatgaactttcctgcagcacctctgtgcagcaaataaactgttaaagagtacatggttaaataagcttttgccacatcgtctttgattaggcaaaaacattcagtatacacaacttccgacctttacaaattacaacagtaacttcagctataaattatagcacatgtgagttaattcgatggatggattcatgcatgtatatgtgtgcatatgcagtacgtgttgctggcgccgtgggtagcgcacgggtggtatgaggtggcgaccaaggggtggcgggaggtggatctcgggtacatcgccatcctcccgtcgttgctgctgcggatgctgcacaaccaagcctggatcaccatctcccgcctccaaaacgcccgtggccgccgccagattgttcgccgcggcatcgagttcgaccaggttgaccgcgagaggaactggtatgccaaacaccataaaattacgtacaacccacgcggtgtgttcgtggcggctagcttcaccttcgagattaattaattcaacctcattatagttgatgtgttgttacgtgtatggtggtgtgcgtgcagggacgaccagatcatcctgagcggtatcctactatacctcggcgcactgtacgtaccgggcgggcaacacttaccgctgtggaggacggatggcgcggggctgatcgccttgctgcatgcggggccagtggagttcctctactactggttccatcgtgcgttgcaccaccactttctctacacccactaccactcgcaccaccactcttcaatcgtcactgagcccatcacatgtacgtaattaattgccactagagacggtttatcctcgaggctccaaacattacattctcttttaggcaataacctttgagcttctatattagtatcgaattgtgttgcgtcataaatatttttacaaaatttttattcatcatctaaagttatcaatgatcaaagttcaatcaatactaatagttacaagtaatttgaaatagaggaagtaagttgtactacctagttgtaccatcattgctccaaacaacctattacatgatattactttcgtcccaaacctctaaatgaatattaagattttggtaatacaaattcttaaaattttgagacagaaatattactagacctgtaaccttgggataaattaaaccacggtaatcttccaatagaacaaagtaaaaaacaagtcttttccataaggacacaaaacaggaggtgtacttcgtcagatgcaagtgtcgcgcgtgtccgttcctcaggaaacacagagtgttcctgtggccagtcgatcgctacttcaattccctcctccttcaatgcatgcctgaacaataattgtaggcctagagagtgtgtgagttaaggaatgcaaaggacacacgatatttcatggaccattgagatcgaagtaagccgaccgatcgatcgcgagctaaatttatgtagcccatcgaatccgttgctgaatgcctgaccaaacggagaagcaaacgtggtccatgaacaacgtatcagagacttttagacaagagagaaatcacattctaaggggttttttcccccttttttttgagtggaagagttttttttattgagaggtatcgagaagtactatatttttcgtgtaagctagccaaatatcagtgcgttgcaacttgcaacggattattaaaaatagcaaaattaagtccttgttaaattttttttaaaaaaaaatggttgaaacacaacttttcatcttaaagaaacaaacaaaaatgccatgcttagaaaattaaagagctaaagtatagtacagtatatatagtacaggcgactctcccaaaccttaataccatggcccatatatcagtgacccaggccctgggcaaactggtccacggcccagggcctgagatgaaaggcccgatgagaaatatgcatttttactaggaataagtctatttttcctcctttcaaccatgtaactttgtgttgggccaaaatttccatggggcggcctangccttggcctatttctgggtccgccccttatcagtgattgtggtgatggcagattcactaccaccactactatcttttaatagtagtaaagattttggtgtcatcttgtaattttaagatgtacaagacggtaccataaattgactttaaagtgatttgaatggatgtgtaatgggagaaatcgcttttcaaatgtaaaataatgcactacttgtattagtactaaattttacattagagaacacgatatattcagtgattcttgataaccataaaatccctttaagattatggtgttttctttaagtactgttaaaaaaaaaccaatagtgtctactggttacactgcagaagaagagaaccctgcagactgcagtatttgtaattgagcaagcagatacatatacctaaatgcatatatgttcattacctacaattcctaacgttgttgcagccgtcatccatccgtttgctgagctcgttgcctacgaattgctcttctcgatcccactgatcgcctgtgccttgactggaactgcttccataattgcattcgagatgtatttgatttacattgatttcatgaacaacatggggcactgcaacttcgagttggtacccagctggctcttcacatggttccctcctctcaagtatctcatgtacacgccatcgtaagtacttcatcaggctcttaataatacttccttcttccttaaatgtttgacgccgttgacttttttaaacatgtttgaccgttcgtcttattcaaaaacttttgtgaaatgtgtaaaactatatgtatacataaaagtatatttaacaataaatcaaatgatagaaaaagaattaataattatttaaatttttgaataagacgaacggtcaaatatttttaaaaaagtcaatggcatcaaatattttgggatggagggagtatgtaaaagagtaactttacagtttttaagaaagcataggggaagtaccatattttatattggagaaattttacggttttcagtatttcttttaagataaaggaggctttattgatcttggatacaatatactctaaaaccactcctgatatctgcatagctaggatgcacatggtctatagttattgaaaaagccaaataaaagaagatgatgtgcatgtcactctgcaaaataaataacttgatcatacatgctgttttcactgttataataatctgaacttatgtgatatattaggtttcattctctgcaccacactcagtttcggacaaactactcccttttcatgccgttctacgattatatctacaacaccatggacaagtcatcagacactctgtatgagaactcactgaaaaacaatgaggaagaagaagcagtggatgtggttcaccttacacacctgaccaccctgcattccatctaccacatgaggcccggtttcgccgaatttgcgtccaggccctacgtttccaggtggtacatgaggatgatgtggcctctgtcatggctctccatggtgctgacatggacgtacggttcttcattcactgttgagaggaatgtcatgaagaagatcaggatgcagtcatgggccataccaagatacagtttccatgtaagagtaaccatgttcagtgcatgattcacagatggtgtgcatgataaattgataatcaggttagaaacattttgttttgtgcagtatggattggattgggagaaggaagctatcaatgatcttatcgaaaaggcggtatgtgaagctgacaagaatggggctaaagttgtaagccttggactcctgaatcaggtagctcatttcctaatgaattcagagcaagttgaaacattatcatccatacttcagaattcagatgttagctatatgtccacatgtactgccaaattttagtcaagataaaacagttagtgcttaataattgtttatcttcagggaaaaggtttagtcataaaggtaggaaaataaaaaaattaagtagcaaagagtccgttgacagtagtccaacagaactaataaattctgtacatttcatgagaatacaatatgtagaaattagggaagtatgtactcatgcatggttgaactggtaattgacatacaatatcttcaatataaggcacataccctgaataaaagtggagaacaatatctgctgaaatacccaaagttgggagcaagaattgtcgatggaaccagcttagctgctgcagtggttgtcaacagtatcccccaaggcacagaccaagtaattcttgcaggaaatgtttccaaggtggcgcgtgctgtagcgcaagcattatgcaagaaaaatatcaaagtaattaatccactactcacctctgatttattttatagcatgcaaaaggataccatgttgtaacaaaccactattcttgtacaggtcacgatgacaaacaagcaagattatcatttactcaagccagaaataccagaaactgtagctgacaatctttcgttttcgaaaacaggcaccgcaaaggtaagaatagatttcctcatttttcctacattctctggacaaatgaatagaatgtataagagaaatatcattgcctaataaaccaaaaattttcaggtttggttaattggtgatggtctagattctgctgaacaattcagagcacagaaaggaactctgtttatcccatactcacaatttcctccaaagatggtacgcaaggacagctgcagctactcgacaactcctgcaatggctgtaccaaaaacgctgcagaatgtgcattcatgcgaggtagtagtaataacctgttgaaataatccagagattcagacgaacttcacatgatctaatcacaaaatttttgaa

SEQ ID NO: 26694 - DNA, 5126 bp, Oryza sativa
  unsure (1)..(5126): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactcccaccaacaccttgggagctcaccattgaatcggttatttgatagatccaaaaactgaagagatgacaatgtacaaaaggtcgaatcaaggttgccggatatgctgttaccgttgattgacagatatgtgaggttggtgcactgtccccagtcagacgatagccgaccggtgagcttgctcccggatatgtccaagtattccaagctggggtgtatgccgaaggcatctgagatgtcgccggtgaagtggttcccgtccagccgcacccggtataggcttgtgcagttcttcagacatggcggtagcgtgccgctgaagttgttgtggttcgccgtgaagcgctccagcgcgaagccgtcgcagatgtggcgcggcagctcaccggagaagctgttgttggtgaagctcacgtgctgcaaggctatgcccttgccgaggtccggcgggatggtgccactcatgtagttgttgaacacggagaggtactgaaggttcctgagggacgagatggtggcagggagctcgccttgcagacggttggtgttgacgtccaacctttgcaacgctgtcatgttgccaatctcaggtgggattacaccggtgagatcgttgaagaacaacgccaaagccgtaagctgcttgaggttgccgattgatctagggatcggtccggtcagcaagttgtttgacaaatccagctcttccagattctccaaatcgccgagttctgccgggatggacccgcaaaggttgttgctgaacaggtaaaggattttcagtttcctcgccatgccgacctcttttggaatcctgccagtgaagaagttgtactgtacttggaacgatatgagctcgggccagctcgtgaacaacaccgaagggatctcaccggtgagcccgttcatttcaagtccgaactcccgcattgcgcacatcccggcgaatgccgggggcaagccaccggagaggtggttcacggatatctctagaaaagtgagattcttaagatttcccagctccggcggcagagttgaaacaagcccagcgttctttatcttgagccgctgcagcatctggagctggccaagaaccggcgggatcgccccgccgagctggttgtcaccaagttcgagaatcctcaactgtgacatcgacccaaggaactctgggacgccgccggtgagattgttggcggcaatcagcaggtcctggagcttcgttaacctcctgagcgacgccggaatccggccagagaattcattgttggacaagttcaggtacatcagattcgggagcttctccggcagtgtgtccggcatcagcccgaacagagtattctgcgacaagtcgaggtaggtgatgttgccgctcttgaggatgaagtccgggaagctaccattgatggagttgtcgtagagcgacatgaatgtcacggtgggcatcggcgagaacttggcgaagtcctggtcggtcaggtagtttgctcccaggtcgaagtgggcaatcttggggagtcggctgagctggtgcgggatggcgccaacgaggttgttgttgtagaggcagaggtcgacgaggccggagaggtggccgatctgcggcgggatggagccgttgaacccgtttcttcgagtcgacgcagccaagccagctcagctggcacatcccgttggggatgtcaccggtgaaactgttcccgttcaattccagctcggtcagcgcccgggcctcggcggagtcgagctcgagtgtgtggcgtccgcttgctagtcccagtcccggattgctagcttagtcacgagccatctccttgtggtgtgcgagccccccttgcgacaggtgcagtccgtggaagaccgcgtccagccggacagcgcgaccgggtcagagaggctcgacttccatgccagtagcgtgtcggtctgctgggacgatgctgcggcattgactgatcctgggatggtagcgatcgccacgaggagggggaggaggaagaaagggtggacgacgggggccatgcggagtaaaacaccaacgcagtgatcctgcattgccgtcgtctccggctatgccttttcgggtccctctttcaaatatgaatatatgatggtgccaatagctaactatatataaatataagtgatttatttttttttagataatggaatataacattccggtctctactcagaacgagctacaaccaattattacaaagtagcactcaaagaaagagtgtagtttaaattaaaaagaacagaccaaacaaaagcagaggaaatatagccaaaataaggagaacacgtttattcaattctatttgtaaacatatttattcaagtttataagagtgatttattagttcgtaaatattttttggtgtgattatcctactgatgattacacactagaactagatccagtgatccaccggaatgcgcgcacacataccgcacgtaatgcctatagcataggcgcatatgggaacaaattttaacactaaagatctgagatttgaactgggtgttccaccacaggaaccttaaccaacttaactagcctttatttggtcgttgttggtaacgattctaattaacttccgatgatccaatagaatggtcacgatcaacccatttttgatcgggtgtaccgtgtacctatatcggttcacagggagtaggcttcaacgcggtagacgttttgttccgaatttttctatagcaaacctgatctaacgatacaatgaattttttctattcacgaagaaaaaatatttagaatcgcaatgctactattaggggtgaaaacggtacgaagatttccgagcttttcagctgccgtttccaatttgcactgtctgtttcagtcggtatcggtaaccaacggtgatagaaatggaaacggttatatctttcggaaatggtagcggaaatgggatggatgtttttccgaccgtttcatcggtaaccgtatttgtatggtaatttccgtcaaaattccgacagttcctcaacggctcaaccagcccaatctatctgaagcccataaatgaagaaagtctgataggcttgtcctataaaaatttcctaaatctaaggatagaatctaaagatagggaatagaataaaaaagctgttggtgatgctattagatgaataacttaaaatatataataacctcaagttagttgggtcactcaaccaaacaacccctaacaatatcaccagaatcccctatttgacttctgcttaattcgcagagcgggagtggctaaaacgtagcccgtgcggtggaggccaactattcaggccaccagcgagaaatgcccagaagttttctggctagcttcacaaggtggtgggctagaggatctggatttaaaggctcaccccttctaattatttgatattagattcttctctaatattcgagttttttttattcaggccaccagcggcaccgcacgacgtaacgaccccgcgtcgccgtcgtctccggcagtcgcatactcgcactggcgcactgctagtggactagtgtcgctgccaccagtggtgtgcagtcgttgctttgggtgctcgtcgtcagtgccttactcattacccccactgatccagttttgctatttaaaaaagatagattcttggggtgaatggccgggtgtaattttggtgcatgtatgtattaatttgtacgcttttcggcgtgcacatatattcattaggattcgctaaaattcatgcacttgtaaacggtggctgatgcaggatttctagcatgggtattcaaagttacaaagtagtattgtttaacacaactaaaaaaaatcagaatattgtacactaaactacacaataacataataatatttaagggacctatattggacgttgttctttcaagttctttttttgaataagttcacctgacgtccctcgactttatatcgagtttgtatcaggtcctcaatccccaataccagaaatctttatccttaaactattcaaaaccgtttaaagttaatcccaagactctataggccaaaaattcccctagttttgctgacgtggcatatgtcgggccccacatgtcagtgtgtcgtggcattacatgacgctacacgagtggttgtcaccgccggtcgccgcggcgaagaagcctaatgagatcgccgcaacaccgccacttgcggctgctccggtgacccggagcatgggaagggagcggcgcggaaaagaaggagaaggataagggctcggagaagaaagctacggtgttggagaagcaagccaaggcgccaccggccgcacccgtaccgtcgatgcccgttcggcgccagcgctgtcatcgccggagcaccctcacagggctactcgccgcatatttgagggcctgtcggtgctggtgcgggggcgccgctgtcgaggaacccccgacccggacttcacgctgttgcgggcggatcaagcggcccctcaccggctgtcgaccccgccgcctgatctgaaggatgagcgcgcggctgctggctccatctgtgctgcctggttcattgccaacaccgtcgttcggatcccggcgccgcccaggcttgccggccgcctccccctccccctcgaccatgctcatcgcactgtcctcgatgcccgcctccccacgccatgcctcgacctcgccggtcgtgccaaggttgtcaggtgcgggaagtggctacggtgacggtggtgcgcgtgagcgtcgttaggtgcggtggcagagctcagccggtctcaccggccgcctctaccccatctaccgccactggcctcccgtgaagagaag

SEQ ID NO: 26695 - DNA, 9837 bp, Oryza sativa
gaattcctgcagcccggagggatggtgaacttatttcttcttttttctggcccagtctggcccagagccaatccggccgaaattccctgccccctgcaggctgcagcctttgctcttgctttgctgcctactgggctgctggcccgctctgccttgttgatcgatcggctgctctccgtcgcctttgccgagtcacgcgccgcagcgcctgcgcatcgctcctcatcccctacacgcgacgaatctcccttttagcctctatttttcctggctagatcgccgccgtagctcgctcgccggagcgactcccggccaccgcaccccctctttgctcggttttagccgccgcccgcggccacacgccgctggcctccttccagcagtccccgttcaagcctaccttttctgaaccgttcacagctagtgatttgtaagatgcattgtcaagttaattccaagggcaatcttaggatagtataactggtgataataaatatataatgaaattattctgtaaactgaatcacaaaaatctatcgttcatccaacattgtattccttgtcgttactatccctgtggagtatttttatttttttcataggctaaataataaacttgtaaatgtaatcgccatataattccctcgtagaaaagcaatacttcttagggcaatagcagtgcgtctacggaaaatgccgatcctcaatacttcttagggcaatagcagtgcgtctacggaaaatgccgatcctcatgtgccacgtagactaggaaccctattagccacatactccacagtgcaggtcacatatcacagtattgtgggtcccacctttctctcctccccttttcatcttcccgttcgtctctctcctctcttcatccctcatcggcagaagaaacgaaccggcgacggcgacgagctgcgcggcggcggtggtcatggtctcaagcggcggcggcggcggcggcagcagttgtggtcgggagcagcgtcgagcggagcggcggcggtcgtagttgctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgctcgctcgctcgcctcgcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgtgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcagcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgctgcccataatctcaacagttgcgagaggcgccgagcggcggggcggcggcggtcgtggtcgcaagcagcacggccgcggcggtcgtggtcgggagcagcgccgagcgtccggcagcggtcgagcggagcagcggcggcgccctatcctccatccccaacaacggtggcggcggcctggatcgacctcgagcttccgtccccgcttcatcccttccggtcctcgtccgcggtggctagctgcatcgccgtcgccggcaccctctcctccacccccaacgacggtggcggcggcgtggcccaagcggcggcgcggatcaacctcgagctcccctcccccctcccccttcttcatccctccgattctcgtccgcggcgccggcccggtcctcgtccacggtggctgcgtcgccgtcaccggtccggtcctcgcccgcggtggctgcatcgccgtcgccgtcgacggccggtggtgtggatgctctcctccttcggtccttctctcttcccggatgggcacggcatggcacacgaaattgtgtgggcccagaactgtggttttgatgaggaatgagtagcacgttttggctccccgttcttggtgaaccatccaaaagtgctgaggtgaaggggaatatctgagttggctagttgaggctgaatgacaccttattgtattgtaaatggccttagaaataaactgtatatatattccagcagtcctctttcttcttctatgaatgtaactaagcatattctgagaaatcagaacggacgacagataaatgtgtgtgatactgtaaatgaacgggcagtgctcctgcactttgatacaaaaacgaaaagaaaaagttccattttactcccttgaactatttcacgggagtacttaatctcctaaactatttttaactcattttacacccccgaactatttaaaacagtccacttcatcccctaacactatttatcttctttagttctcactatataagtcatattttgcattgaaattttggtagaatatagatgcatccataacttaagtctcaacattcttctttgattttttttctcactgtttacataggttgaaagcacttcaaactgatttaaacatcagaattttaaagttcaagcaaacgtcatgaaaaatttcaaaatatttttgaactttagtaattgtatcatctatggctctaataaatttcagcttaaaatataacgtgtataaagagtaaaaaaaagaaatgttattaaggagtaaaacgacatttctagtagtttaggggataaaacgagaaaaaatagttcaggggttaagatatccattgaattagtttaggagagtaaaatggactttttttttcaaaagaaaataaattatatgatgcatgaaaaaatcccttcaaaatagaaaggttgcggtctgcagacatcagacaaccacaaccagataggcatcaagtacatcatggtagaacgtagctgttctttttttaaaacaacccgctagtgcgacatttctattgataaagaaggaataaaatataagtctatagtcctgagagactatagtaaaaaaaaagaaaatatataaccacaccacgcatctgcgtctgatcctactgctaaatactgaacaaacacacaatacccctaaggaataagtcttctaaacgatggctccaaggaggaaaatgacgccaaaagcaccaccgccgcccatcctagagaaccaggatgtggttttcacttgaagaacctcttgggaaacgatagaaaacgcaacaacgtcccaaggtgaaaacggtgcctgtaggcgtcgccgttgccggcccgaaggctaggccttcgctccttgttctactctcccgcgctaaagagtgcatgccagattcaacagaaccaccagctaatccccttcgacgtgcagccaccgcgccgacgtctcgctgttggctggccatcaaagaagagtctcatccttcatcgcgcttcaatccatccacgtggttgggttggaaagggagagaatgagagagaagaatggatcccctctcccccgtactagcctgtccagcgtgaccatcttacggcggccgccatcctggctagctgctcggttctctagcggcgcgcttcggtggcggtgaggggagggagaggaggagagaggggcggtggcggcggtgctaggttttcccctgagccacccgcgcgtgggcgacgcggtagcacagagttgataaatgtttatgttctccataaagatgatggccctgtttagatccactgacaaattttttcaccctgtcacatcgaacgtttaggcacatgcatgaagtattaaatatagaaaaaaaaactaattacacagtatgcgtgtaaattgcgagacgaatcttttaagcctaattactccatgatttgacaatgtggtgctacattaaatatttgctaatgatggataaattgggcttaataaattcgtttcacagtttataggcttattatgtaattagtttttttattagtctatatttaatattttaaattagtgtccgtatatatgttgtgacccgctaaaactttacaccactggatctaaacaccctgatatttatcttttagtaaagatgcatctaacataccaagtttttatttggatagatagaatcggagttatttgttgcaaaaatgaccaaaacaaacatccctataaactgacagtggtatattacttggttgctgatttgcatctagcatatccactgatgtgatcacttatttatcactaatcacttagaatttattttggggtaaaataaaaaagatgctctaacttcaaaattaaaatatactaactacaccttgatgtgatctcctcctggcctggtcctctcgctctctctctctctctctctctctctctctctctctctctctactgaattctgatccaaattcgctgtctcctctgcagctctgctcggccgctctccatcgccttgccgagccacgcaatagtagctctgcctctgcttcatcccaagctttgccgcgccaacaaaccaagccgacgacaagctcgacctccattccatgcgctcgagctatgccgccaacggcaaaagagaccgcctccgccccgtctacctccgcccgagagccgcccagggcttcgcctcctccatcgccgtcgccggacgcaaacgcggcgaaaaccctagctttcaccggctccaccaaatcccgaaaattctcccgcacccgagttccttcgtccgaaattgaggtgaccatcgtccttctacacgcgatgaatctcctttaccctctcttttactggcaagatcgccatggctcgctggagcgactccaggtcacccgttgcgccgtcgggaacggttgaatttcacagctaagatgcattgttagattaacgccaggggcaagcttaggatagtactctattactggtgatacatgtactgaaattattctgaagactatcaatcacaaaagttctgtccttcatcaactttgtattcctcgttgctacttgcttctatccctgtgtaatattattatttttcccattggctaagcaaacttgtaaatgcaagacagagaagataaatgaaaatcatgacattgacatataattctgtcgaggaaaagcaacaggggcatattatttggttgctgatttgcatctgaagaatacttagtgcatacatcttctgcaatttgcatagcttctttctatgtggtcaacagaatgaaaaacaaaaactcttaatggcttaagtaaaattagaactccaaaccaaagccaaaacccgaaaacaatgccaagaattaaagagtaaaataaacatatatcaagttctttatgatcttcatttttctcatccaatctagatgcctggcaggctattatcaaagggaagccacaaaggcccaaattgttgctataaattgagggatccacaaatgtctgaagttgtcttcctgtgggtatgcttccccataagtggttgtttgagagatttaacacactgaggcatgacagatttgaaatgcttgcggggataacacctgaaagctcattccatgacaagtcaagggactccaagatattcaaattgccaattctttctggaatactgcctgatagatcgttccatgacaagttcaaaaaccggaggccccgaaggtatgttagctcttttgggatttcaccgtaaagtgaattgcctgataaatcaatgcctgtcattaacatagctgttctttgaaaagtttcttcatgtcccttccattgtatgctaactctgtctctagactgatcaagaggggactgatttttgggttctcttctgcggtgaggcttgggaacctggggtacttctggctgaaaaggactgctttccgcgttaaaatattctgtcgctggcaaggtttttgcttgtgtcatggatgataagttgccaaaacttgttgggatgaatccagttaacacgttgctggccaagtcaagaagttgaagctcagaaagttgggataattctgtaggaatctctccactgaaattatttgatcgaaggataagaattcttaggagaggaagactaattccaatccaagagggaatatggccaaagaacttgttgttccccatatctagggtaacaagcgctccacatttgcgaacaatatttgggaaaactccagagaaactattgttagcgagatgcatcgattgtagaggaagttcaaggctttctgttgctggcaattcaccataaaagtcgttgccggagatgtccataaacagtaaagcttgcaactcccaccaacaacttgggagctcaccattgaatcggttattcgatagatccaaaaactgaagagatgacaatttacaaaaggtcgaatcaaggttgccggatatgctgttaccattgatagacagataggtgaggttggtgcactgtccccagtcagaggacagctcaccggtaagcttgttcccggagacgtccaaatattgcaggatgcggtggacgccgaaggcctccgagatgtcgccggtgaagtggttctcttccagccggacccggtatagcgccgtgcaattcttcaggcacaacggcagcgtgccggtgaagttgttgtagttcgccgtgagttggtccagcgcgaagccgtcgcagatgtggcgcggcagctcgccggagaagctgttgttggtgaagctcacgtgctgcaaggctatgcccttgccgaggtccggcggaatggtgccgctcatgtagttgttgaacacggagaggtactgaaggttcctgagggacgagatggtggcagggagctcaccttgcagacggttggtgttcacgtcgaagctttgcaacgctgtcatgttgccaatctcaggtgggatcgtaccggtgaggttgttgaagaacaacgccaacttagtgagttgcttgagcttgccgagcgagctggggatcggtccggtgagcgagttctccgacaaatctagctctaccaggttctccagctcgccgagctctaccgggatggaaccgctaaggttgttgctgaataggtaaaggaattccagtttccttgccttgctgagctccgatggaattttgccggtcaacgagttgttctgcacttggaacactatgagctccggccagctcgtgaacaacgccggcgggatctcaccggtgaggttgttcgtggaaatgccgaagtaccgcattgcccgcatcccggcgaactccggcggcaagccaccggagagccggttcaaggacagctcgaagaaaatgagattcttcagatttcccagctgcgacggcagagttgagacaaggccggagttcttgatgtcgagccgctgcagcatctggagccggccaagaaccggcgggatcgccccgccgagctggttgtcgccgagttcaagaatcctcaattgcggcatcgacccaaggaactccgggatgccgccggtgagattgttgccggccatccgcaggtcctgcagcttcatcaacttcccgagcgacgccggaatcgagccggagaacgcattgatggacaggttgaggtacctcagattcgggagcttctccggcagcgtgtccggtatcttcccgaacagagtattctgcgacaggtcgaggtaggtgatgttgccgctcctgaggacgaactccgggaagctgccattgaaggagttgaggtagagcgacatgaacgtgacggtgggcatcggcgagaacttgccgaagtcctggtcggtcaggtagtttgctcccaggtcaaaatggataatattggggagacggcttagctggtgcgggatggcgccgacgaggttgttgttgtagaggcggaggtcgacgaggccggagaggtcgccgaactgcggcgggatggagtcgctgaagccattattgccgaggtcgagcgaggtcagcgagcgcagccgcgtgatgctcgcggggatggcgccggtgaagttgttcccgttgaggtcgagctcggccagcgccgggagcgccgcgaagtcgagctcgtcgaggccgccgccgagccccagcccctggagccgcagcttcgcgacgcgggcgccggcggcggcggaggcgtcgcaggccacgccgcgccacgcgcacaccggcgcggcgcggctccacccggacagcgcggccgcgtcgtcctgcaggctggccttccacgccagcagcgcctccgcttccgtcggcgtcgccgcattggccagcgcagggatggcagcagccgccgccacgaggatgatcagcagagggaggacgaggcgtgccatgtgggattgtgggcagtcgacgccttcattggcgaactgttgtgatacgacgagtggctaaaacaccagcaaatgggttcgtcgcacctccaaagccacgtgcgcgtgaattcatacgagcgtcgccgtcgcttcccgccatattggactctggctaggtcaatcgttcaaaatgggaggatttcttccacacctgcgtagctatctctcttacagcaatgtgaaaatcgcaagaatcactctgtaaatgtcatttgagtttgagattttttttatataaactaatttattacaaatatccccttctaatttaccttggttattttgagattcttcctcagttgttgtcgctcgcaccttttttttctctctcctcaaactcaaggtaacatttaggatggttttttaataattttccaatatatctttaccaattcataagtaaaactcgatgcaggaaataaaaacaacatgtatttgttgttaaaaattcaaaatgtctctgcagtttttagtgtttaacacctttaaatattagacatatatttgatcatttatcttattaaaaaaaataaaaaataagtcatgctaaaagtatatttaataataaattaaatcacaacaaaaataaataataaatacatatatttttaaataagataaatgattaaacatacgtgacataaacattaaaaactagagggaatatcttttattggcttctatctagttttagagcacattgtggctatgttaggagatttattctaaaaaataaaaaccaaaatatatttaaccggaacttcctttttaaataaaaaataactagcacggtggcccgcgcagattgcgcggctaacatcattatattttctctcatataatagcatatatgttttctcaatgtatcattcaaatatattaaaataacaacataattttaaattttgtactaactttacgaaactactaatgtttaatatccata

SEQ ID NO: 26696 - DNA, 9971 bp, Oryza sativa
tatggtcaaacgacgctttggaccggggtgatacaataaaccaagtttagggacctcaatacacactttgcaaattcgtggacctagatgaaacctgcttacaagtttaaggaccgccagtgcaatttactctaattttattatgtttattccgaattttagttagttttacactcctatatggactctatactctacttctaatattccttatttttaattccgaatttctattatttcttaattgtatttctatatggaatctatactctacttctaatgttccttatttttaatttcaaatttctactatttcttaattgtatttctatatggactctatactcttcttctaatattctttattttttaattctgaatttcagttatttataaattgtatttctatatgggctctagtctccttttccaatattccttattttttaattccgaattttaactatttctaaattgtatttctatatggactctgttttttctttttttccgattaatatgagaatttctagaccgtgagaacgaatatggaggtttctttttctattcttttaataagttaatagattggacaatcaaatttgtctagtcatccatctgggtgagggaacaactataagggttttgttataaaaaaaacaggttctattgaacgcttctagcacagttcaaacgcttaggagccgggtgcatgtaagtaattattcagcgaagcttaagggcttgttgatttgatgtcattttcaacccttcagtgatattttatggtaattccagagctttccactctcaaatattctaccaaattttggtaagatgcacaaaccaaacactttcatccacaccttattaccttaccaaaaattggtcatggcaaaatttagtattatcaaattttggtaggtttattttcgattttgctatatctcactcgaaagattttttcttatctctcactcgattttctcacttaaatttacagtgcattttcttgtaagttacagtgtaatttatgaaacttacattgtaatttgtaagttacagtgtaatttttgaatcttcgcatgtaagttttgatatttgtattggatttggtctttttcttgaagatatggtaatttagtgtccattatgatatttcttagttgctttttgccttttactgtgtttatcagattttaattcaaagattaaaaatctgtatgatacgattataaaattttttcgaaagatacataggtactcccgtttattttagtgaagtaagcaagcactgaaatcctacgtcagccataccctgttgaccatagaatctcctatgctggtagtagataaatacattcacatacattttttcagtgatatttcgtacaaaaacaaatgttcttaacacaaaaatcaaacaaatggccctcaacaatagacaaaatgtgaaaataatttgtacaatattaggtgtgtaatcatcaatacagaagttacaataaaattttccttccaaaaacacaagaaggtaaccgggcattcacacggccttttttttttctcctttgtactttatactaagaaagtgagaattttacattattgacagtttaaaaaaaatatagtaattaataactatgtacacccacactaatacttcttccatgcttttaatatctcaatttattatttaaaaaatagaaataatagagttatatctgtgtttgagtctcaatttagcatattcatgatttgataatttcgaattttggaattaacaaaaaccgagctgtcctatgcttggtctgtcaatcatattttctataatttaggtcctatttggcagatctcacatgcacgctggagtagtagtttaaaattttgtatttcatctaaaactaaagcaaaatgattcatccaaatgtaatgaatatagtaattcgatttcagatgtaatgaatatccaagcatagcagcatttgttggtagtatataagatggacatgttccatataattttggatggatgcagtaacttcttacatcttagtcttgatacaaaggaagtttgttgggggtcctatgactcctgccaattacagaacactgacaaaactaaccatgctacatcttcagatggtacagaaagaaaacacacagctacaaatactgatcagtatttcctcttgaaagaaatttatcaacagaggagactttctgcataactttacattgcatgccatcaacaaaaccgaaaatggcatacctccaggttccgatggaaaggagcattccaaaccatagccaaaaaccgaaaaccactccagccattacacagtagtagaaatactggtcctcgcatgttctacagtctctctcatctgacgcaactgaagcatttgtgcatgaaatgttcaacggagggccacagagccctgaattatggctgtatattgatgggtcagtgaaggtttgaagttgattcccggtgggtatcttgcctgatagatgattatacgagagattaagagtgctaagggtagatataccagcaaggcttggaggaatggctcctgaaatttcatttgacgagaggtcaagggactcaagatttttcaaactacctatgttttcaggtatcccacacgatagattgttccttgacaagttcagaaatcgaaggccttggaggtttgttaactcatcggggatgcattcagacaatgagttacctgacaaatcaatacccgtcattaattgaagtgttttttggaaaattatctcctgccccttccagattatatcgattctatcctgataggtagacccatctaatgatcccgcactggatacaatttttggattcttcatggatgttaagttgccaaaagatgtgggaatcgaccctgtcaaactgttgttggtcatatctagcagttggagttgagaaagatgtgataactcagaaggaatttcaccggtgaagttgtttgatctaaggctaagaatcttcaaagatgaaaggcctttcccaatccaaggaggaatgccaccaaagaaattgttgttcccaatatctaaagtgaccagcgtctggcatccctttagcgctgatggaaaaacaccggtgaagccgttgccggcaagatgaaccgattcaagagaacaattgtagcttgtattgactgcagggatttcacctgagaagcggttgtgggagaggtccatgaactgcaggctctgcagattccaccagcagtcaggcagcttaccggtgagcttgttgtttgacaggtccaggatctggagagaaagcaacctgcaaaaggccgagccggagctgctgttggaggagttgccgttcaggacgttgtacttctccggcatgactgcgccgccgtcgtatagcctccgagccggcctgctggagaagtctacttcatcattgcggtagtagttttcgtcgtcgtcgccgtcgtatattctccgtaccggcctgccggagaagacgtcgtcgtcgtcatcatggtagtagttgtcatcgtcttcgtccccatcgtaatggtagtagtgatcgtccacatcggcatcgaggctcaagctcgtcacccgttgaggagatgataacagcaagagggagagggagatgcagaggaagagacagaggcgcagcacgagaggggccttggctgccatggctggatttggtagagtgcaaaggagcttgtggaactgaagtattgaactccacttgtaaagctgcaggagtatttctttctctctttcttggtatggctatggacagggggcgaggttgaccgtgaccatgggggtcgtcgggtgggggtgctgcggattaggaatttggagcgctcgccgtgtcgcggtcggcgcatgtttcacacggcacagcgacagcgatggaccagccggctccaccatgtgagatgacttggactgatgacccgagaaaggcacaatggcacagtatccagccagagtcaaggatggagccaatggcgagcagtgcgttttgcagtcaaaatttcagaacacacggtggagttgtcagagacgaatggtaccttgatcatgagaggctcgcccgatgatggcgctcccgcgcgagcgacgtcgcccgccgcgctcctgtcccctcctcgccgtcttcctcccgccccgagtccctcctcctcctcccaggcatttcctcgagcacatcatgcgcgcagcacgccggcgagaccgagacattcctcaaagcgccgccgcctgggcaaaacccaggctaggtgggggaccgagctctggccgccgcggatgctgcagcgcttctattggagccacgacggcggcggcggcgcgcgacggccgggaccctcgctccgccgcgtcggagacagaagccgacgccgacgcgagcgcaaagtagctcgctctgacgcggtttcgtgctcgattcacgagccccgcccacacaaaacgaaacgaagtccgcttccgtcatctatacggcccattattacatactccacacggtgcttttgttcatgggcttgatccatttagtacggcccagcacagtcctcgtctcgatggcccatcacctgtaatgggccgtacttctccacggtgctactagagatggcaatggggacccaaaacctgtgacccgacgggtttttactctattaggagctaattgtgttctaactcttatacccatgggtctactaatgggcaaaactcttacccattaggtacgtgggtatgggtccgttctttacccacccatacccaccaacccgtgggtgaaaaaacctattgattaagcctaaaactataagcaatataagtctcaacgactactaaatcataatatgaaactcctttcacatcttaagcattgttctattctagttatatgaaattattatttgatttcttgattatgtatgtggttgtataattttttttactcgcctttgtatgctaatgttaatatattattgctagagaaaatattgatggtttacaactctaatatgactaattatagtacaaaactataaatgctacaagtcaactatatgggtatgggtacccgttggatacccgttacccgcacgggtgtgggtatggggaagattttgtacccgcgatgggtgtgggtatttaagtgggaaaatttagacgttgcgggtgtgggtatgggataaggaaacctgatgggtatgcacccgttgccatctactgctacacgcgcgcctactaacgagcggagtcgtcaggatgatgaccagctgacgtcacgttggcttctacttactctctccgtcccataatataagggattttaagtttttgtttgcactttttatcactcgtcttattaaaaaaaatttggaattattatttattttttgtgtgacttgctttattatccaaagtactttaagcacaacttttcgttttttataattacacaactttttaataagacgagtgatcaaacagtctaacaaaaactcaaaatcctttatattatgggatggagggagtaacattttctgaacttcatcgggaaaagcaaaaaggtttattccgtaattccgtatgaaacaagtgaatagcgatattagacgaaggcagcgacataaaattgtactaggctcatagcaaggaattcatatcaagttcagttatacttgtaagaggaggtgcactaacatactgttagccagctataaacatatttgtcaaggagtaatcctctctagcgggagatcgtgagatcccctttttgtgagttcggccgagggaaaaggctcgcttggggagatcgcgtattcgccttgaacgctgctatatcatgtgtgagccccaagattatacaagttcgggccgctatcgagcgtaacaccctactcttgtgtgtgggattatggctgagtgttagaagggttcctaaactccggagagcgctcccgcttctcttctcctagagttcaggtttactgagagtcgtccccttttctcggtgggcaaggtcctccttttatagttcaaggggataccacatacaccgcctctacctactctttcatgggaggggcacccactctatcttgaccgggccacgatccgtgccttcgcccggaagctaagcagcagtccgtccttgagcgggacccagtgctgccccccgcctgacacgggggacagcctttcattccctcataaatgggtgaagacttgcggtggtcctcctccacggagggaactccaaatgacgcttcgatgggacaggacatacctatctccactccgccggagacagaaacgacgtgggggcacggccgcccgtcaatcggacgtgaccggcaacaggccggtcacagattggtcacgtccgactgacgtgggtcagtcaggcggcaccgcacgtctgcccttaccgcattaaacgcggtgagggatagttggggcgccgcgcattgatggctgttcagcccgggtcctctccccactcactccccccgccacatggcagctgggcgagagccttgaggtgaggcagcgcgaaggcccgaggggcacgacatggcaccccgaggcccctcggctgcttttgcgactcgcgaggtgcgggagtagggccaggctgtagagccacgcggcaggataggaaggtaacttcccctcactttgcatacccccgggcccatatctccgacagtagcccccagcaccacgtcggacattggtccctcgaggacagtctgacgtggcgcctcacgacttctcgtgccgtggttgtgggcccgacgggaaatccagacggttgccggcgagcggccaggttggcacattagccaaaatggcgatttgaccgccgttaaccgcgctgatgatgggggcgcctagggcgcgaaaatcagggggtcggctagaccacgcctagaatcgtcacccacgccgcctcgactccctcgccctttgtgagttcggcggggggcagcgggtgagatttgagggcttggtgggcaaagctgtgtgatcttgagggggttcaatcccccaaagacgatgagacaaaagggatttatacaggttcgggccgctaagaagcgtaataccctactcctgtgcttgattgattgagtgtagaacacaagtgcttggggttgcaagacccaagtgccagttcgctcggaagtcccccctccccccttctctcactaggactggacctccttttatacctcaaggggttaccacataggcccaacaacctaacttcctcgagaagtattacaatctttgcattaaatgcatgtcttgttccttaacttggaagccgcatacacgtcgcctcggtcgtagggcctaccaaaccatgccgcctgacacggggggcgcccatgtcattcaccatttaatgggtgaagacttctgggctcctttacaccgggaaaacgggagcctagctttaaccagagcgggaggaccgactctggctgggataagaggatgagaacctctcattatcattatttgatgggacatgtcaggctgcacgccgcctgacacacgagcagcgcacaggcgtactagccagtcccatcggtcattcgaccggtcacagaccggttgagtacactgacgccgcattaaatgcggcgtggcgcgaccgctcgagtcgccataaatgcgggtaggtgggcacctgtaggcggacacctaacccaccgtacgtggtgacctagagagggggtcgggggagcccaacccctagtcatgggagggggcggtcgccgcctgacctcgggcccgatcccccctcgggggagggccacgtggcgcctggggcagccttctctctctagtctcggccagggagtggccgccgccctacctcgggcccgaccctcctcgggagagggccacgtggtattggggggcagcctcctccgtccaatctctgggagggagtggccgccgccctaccttgggcccgatcccccctcgggggagggccacgtggcgcctagggcagccttctccctctagtctcggccagggagtggccgcagccctacctcgggcccgaccccccttgggggagggccacgtggcattggggggcagccttctccgtccaatctctgggagggagtggccgccgccctacctcgggccggactcccctcggggagggccacgtggcattggggggcagcctcctccgactagtctttgggaaggagtggccgccaccccacctcgggcctgactccccttgggggagggccacgtggcattggggggcagccttctccgtccaatctctgggagggagtggccgccgccctaccttgggccggactcccctcggggagggccacgtggcattggggggcagcctcctccgactagtctttgggaaggagtggccgccaccccacctcgggcctgactccccttgggggagggccacgtggcattgggggcagccttctccgtccaatctctgggagggagtggccgccgccctaccttgggccggactcccctcggggagggccacgtggcattgggggagggccacgtggcattggggggcagcctcctccctctaaacatgatacccccgggcctatatcaccgacaatattttaatgagataaaatatgagagagaagagcagcgggctacagatctgtagccagctgcagcacggatttcaagacgtagtgtgtgtatgataggtaggacaatatattaatagtatagtaagtaactactgtataaattggctattgtattggctatatgtgaattagagctagtagtgggctattctcctgaatttgctctaactgcaacgcacacgtggacccacaatccagagtcacacggatcgagcctacataaattctctgtatttattgtagaggataacatgtcataagtaaaataagagtgtgtttaattcacgttaaattggaatgatgtgatagaaaaatttaaagtttgtgtatacaaaaattttaatgtgatggaaaagttgaaaatctgaaggaaaagtttgaaactaaactcggcctaaatctcaatgccatagtgaattgccgtaaattgttgtatcgtcattagtgctagttacgacggcaacataagtaagtactcctaaatttgttgctgttgctggcttgctgccgcggcagctatacccagctggtgcaccatatatagacagtttttttctttactgttgcgattcgacgtactagtattatttgatccggagagtccacacaactgaacaaaatggctaaaattgatcctaattctgcccccatgttctttcttttctacgtttattagtacttcagaaaaaactaaccaacttcaaatattaaaagatggagggagtatatatcaacctgttgtattgagctttacattagctattaccgcaaattatcctctttttttcttaaacaacaagtacaatatagtatgacgtttctatcgatattaccggagattatcctcattatgcagaagcacgtgtctagcattagtatgacttttacgcgaacattcgtgtattagacgtaccctcgactcctaccgaaatgtggtgggaatgtgagatgatcaaagcagtagcttgacagtcttttttgctagccccctcaattatttcactccttcagcaaacttggacacaatacgtcaatatcttgttatgtttttatttcttttgatttttttttaaaaaaaactactcctgcatagttatcgtgttatgcatggtggtgatcgttcggttcaaagtttcaaacacacttgttcacattaatggaacccaccgcagttaatagcgctggagagggccatactcctgtgtgaggcagtacagtttgttgcgtgtcgtgtagccgtacgagctacca

SEQ ID NO: 26697 - DNA, 1481 bp, Oryza sativa
atttaaaattgctagagatcggaatcaatatctcataaataattatataaggagaaccaactagctaggttcattatggtgtaaccagcctaccctcgttcaagttttaaattttagacaggtgttcgtatttacagctaattattgtttcactgataaatgatgtacttattagtaatgaggtgcatggtagggtgtacagacgaccgtggtgaattcatcaagtttatagcatagttattaagaccggaccggtgaatgaaccggttgagctctcggttcactggtttagcggtcgagccagtggttttaccggtccaaccacggtctgattactattatagaatgaatgtttatgtgatggcacaagcagcaggatggtggcatggctagcgcgtgaacctgtcaatcccgtgaccagaggtcgaatcctcgtctccaccaatttttctcgggattttgcgcgcgcatgcacgggaggcaactagttgggccccccattagccggtctttcccggtttgaccagccaggttaatctccggtttatataaaaaccgcccgagttaaccggttttctccggtccgattatacgtgtatcttgaacgtctatgtttatacatttgtttttttataaaaaatttgaataattctatagatgtttacatactggagtactatttggacatctatctgtggctttgtttagttccaaactttttctttaaacttctaacttttccatcacatcaaactttcttacacatataaacttttaacttttccatcacatcgttccaatttcaatcaaactttcaattttagcgtgaaacgccaccctatctctcggggagtaataaatggctggacttgaagagtgtcgcagtactgtagcagggtcgacagcgaccgtcctgccaatagggaatcaatgcggcccccgtcttaagttcgcttctgccctgtcaggtttgcccagccactccccgcgcagcagctcagccgtcgctaccaccacctcaagctcccgcctcgcgtgcagctagctgagagcgagcgctcgccatggagaacggcgccggcgccggggacgacgagtacacgcgcgacggctccgtcgacctccgcggcaaccccgtcctccgctccaagcgcggcggctggaaggcctgctccttcatcgtcggtacgtgtaacgtgttcgtgtgtatagtcgtcgtcgccggcgagcttggtggtgatgtttgtgtggtggtggtggtggtggcagtgtacgagctgttcgagaggatggcgtactacgggatcgcgtcgaacctggtgatctacctgacggagaagctgcaccagggcaccgtggaggcggccaacaacgtcaccaactggtccggcaccgtcttcatcacgccgctcatcggcgccgtcgtcgccgacgcctggctcgggcgctactggaccttcgtcgccggctccgacgtctac

SEQ ID NO: 26698 - DNA, 3227 bp, Oryza sativa
ttacacattttaaaatttagaattcgggtcttttaaaactgtttaagcttgattcttttgttttcgtgtaatctcatctgcatatataatgtatgcagtggttaattattgacttctcatccaaatatgataatatatataattggaagaccctatcttgttttactcaactaatttctcaaatgtttgaaaggcatctaatatctccttatcataaatgatgttatattatattcaatataatttgtcgatatatgattagaagaggtaatgattaaagacctctcgtcagctaatagtaaaccggtcccttgtccctatccaaatttgcatagtagaccgtatcttcatgctacttcacccctgttaattaagaagctactactctctccgttttatattataagttattttgggtttgtattaactcggttctcttcaagttttaccaagtttataaaacggtcaaattagttttataaatgcatcattgaatatatttttatagtatatttattttgtgttgcaaatatcgtaaagtgaaatttactcttatatttttctgtaaagttttacttatgacagactcgaagttacgaagccgggtagtggtaatgaagcaatcggcaaaagaaaaccattctcccttttttttttaatcaagaaaaccagtcttgattggacaaaagaaatgtcataatactcacttcacttcatttgtcctgtttgcacccataatggggttcacttcacttcacaatgtcccttttaaaaaaggttttacaatgtcgacagtaaccgctttgttatcgtaaaccgtgttgcactcaccacacaatgttcataaaatttacctgtatacattattgatggtgtcaatatcattaacaatggggagagcaatatttcgacggaatcttcattttgaaggaaatgcctggatttggagataccttctgtacaatgaaagtgcaagaatgaatgccatgtgtgtgtggcatcccagtaggccggccgtacgtcattttgtatctttgcatttgtatcttcgaagacaataatctgtgtctttccaaactaaatccgacaaaaatgaaaccatcaggaaataataggtcaactaccatgaccccatgtgagatctggtcctgaaaaataggacaatggggtgtaagattgacaccaggttttgcttttgatataagcaagtaggggggtaatcctttccaaaatgtccaaaattagtacagaggattgatgtgttcatgttgtgacttcaagtccatttccactaaaaaattggagatttgggtaaacgtcacagctaattacgagagcatgctggaaaatgcatcttttgttttagcacactttgtactgttaataaaggttaagttctactccctccgtttcaggttaaaagacgttttgactttaattaaagtcaaattgctttaagtttgactaattttatagacaagtatagtaatatttataatactaaattagtttcatcaaatcaataattgaatatattttcataataaatttatcttgggttaaaaatgttactatttttttctacaaacttggtcatcaaaaatcaataattgaatatatttttataataaatttttcttgggttgaaaatattactattttttttacaaacttagtcaaatttaaaacagtttgactttaaccaaaatcaaaacttcttataacctaaaacggagggagtagttagtactaatatgcttttctaaagtagaatatcaacttcaccaatttttggtttggtgggaactcaggcttctaatttgggctttactggtgcaaactgcaaacccacacatgcttgacaggttaacctaacacaaaccttgttcatcacagtccaagtagaacttctagaaaccaaacccaagttcaatttcaagctgaacacatgagtttgaacattatttattcgttcaaattaaattcacctgaaatttggaaacacatggaagaattcctctctttcaaatttcttctgaatctgaaccatccaaattaacaaacgcagggcatgctgctgctcacactggccgtctccgtgccagcactgaagccgccgccgtgcgacggcggcggcggcgccgcctgcccgcgcgcgtcggcgctgcagctgggcgtctacttcggcgggctgtacaccatcgcgctcggccacggcggcacgaagccgaacatctccaccatcggcgccgaccagttcgacgacttccacccgccggagaagctgcataagctctccttcttcaactggtggatgttcaccatcttcctcggcatcctcttctccaccaccgtcctcgtctacctccaggacaacgtcagctggaccgtcggctacggcatccccaccctgggcctcatggtctccgtcgccgtcttcctctccggtacgccgctgtaccgccacaaggtgccccagggtagccccctcgccacgatggggagggtcgtcgccgccgccgtgtggaagtggcgcgtcccgctccccgccgactccaaggagctccacgagctcgagctcgagcactacaccacccgccgcgggttccgcatggacgcgacggtgtccatggcgttcctgaacaaggcggcggtgaagccgggcgaaggaggaggaggatcggtggcgcggtgcccgggtggacgctgtgcacggtgacgcaggtggaggagacgaagcagatcgtgaagctggtgccgctgctcgccacaatggtggtgccgtgcacgctggtggcgcaggcgggcacgctgttcgtcaagcagggcgtgacgctggaccgccgcatcgggaagttccacgtgccgccggcgagcctcggcgcgttcgtgacggcgacgatgctcatctgcatcgtgctctacgaccggttcctcgtccccgccgtgcgccggcggaccaagaacccgagggggatcacgctgctgcagcggatcagcctggggatgctgctccagatcgtgacgatggtggtgacgtcggtggtggagagccagaggctggggtacgcgaggaggcacgggctggtcgccaccggcgggcagctgccggtgacgatcttcatcctgctgccgcagttcgtgctgctgggcgtcgccgacgcgttcctggtggtggggcagatcgagttcttctacgaccaggcgccggagagcatgaagagcct

SEQ ID NO: 26699 - DNA, 16749 bp, Oryza sativa
ttcccgtctggattctgaagttgcaatgtaatgaagaaacggtgatgatacatattagcactttaaaaatgttaaatgaaaattttatttactcgttctgtaaaggaacggtaatacggacaatattcacagcttcacacaatcgcactagtagcaccatcgtttctcttatgcctatacttaagctaaaatgtgaattttaaagcttcactttagagttgattttgtgttttttttaaatatagtttattttacagtatttgctttcgaatcgataaggacacgtcgcataaattattttttaatttgttaataaacgattcgcatgaacgtaagtataagtaaaaggatggaaccataaatatctaggagtaatttggtgacaacgatggagatgcactattacagtcatgacgctagaggcaactaactccatccatcctaaaatatagcaatatagtacatgatgggacatgtatgtccatattcatagtactatgatatatcacatctcatattagattgttatattttgcgacggatgaagtatttgagagatactagctccgttttttaatagataacgccgttgactttttctcacatgtttgaccattcgtcttatttaaaaaatttacgtaattataatttattttgttatgagttgttttatcactcatagtattttaagtgtgatttatatcccatatatttgtataaaatttttgaataagacgaatagtcaaacatgcgagaaaaagtcaacggcgtcatctattaaaaaaacggagggagtatatcatatcggccgatgatgtaagctagtagctgatcctttcaaattatttatctttctaggtttggacttaagtcaagtatttccatctttttaccatcagatatatgttttaacaacatggaaattatgtaccaccagaaaacaaggcacgcttatatataacgtgttcatatgactaggtaacactctaactcaactggattgaccgtagtcagctcgccacctgagctgaaagcaggcacaatattgtcgatctcggatacttcgctactgtaaattgacgaacatgacatcaagacgagaaatctaaggaataagtccagtttgactcccttaactagtgaccgaatttgatctgtatccctaaaccacaataccggatatcttcgacccccaaactattgaaatcggtgcaatttgactcccttggcggttttggagggcagtttcacttatgtagggcccgctcacatatgggacccatatacgatcctccctttccttcccttattcctccttcctttctctctctcccccttaccttcccttcttcctcctccctttctctcccttaccgttggtgcaccagtagttcagcagcggtgccgggaccgggccgtcgtttgttgtttgttgggaggacgccaagtagggcgacgtcgaggagcgagacggtggcctctccccggaggtcctagtggcgtgggcgccgagccagccgcggaaggagacgcggatctaggtgttagagacggcggcgcggagaggaggagggcagaagggggaaggtggggccgggactccggcgagcggggcaatccccgttcacgtcgctcctctcgaccttcgttgcatgggatgctaccatcggttgcccactcatccgcgccaagctcgatgccatgggggccacatctaccaccagcggggcccaatgaggcacgcgggggcaaggacatgagggcgcgccacgttggggtgctcgtcaagatgtgctggtgtggacgtggatccctgacgcgcttgtttggatttctgcaggaagtcgaagctgtcccgccggcgccactccagcacctgcccgccaccactccaaaacatgctcctcgcacacgactgaagaaggggtagagagagggagagaggagggagacagagggaagagtaagaagggaaggagagagaggatgacatttgggtcccacatgtttgtgggtccacaatttttttttgaataacaagtgggtccacaatatatatatatatatatatatatataagttctaatgacatgtaagcgccacgtcaacgccacgttgtacgaacactaggtcaatactaccacgtaggcgctacgtcagcgaagctgccctccaaaaccgcaaatggagtcaaattgcgcccgttttaataggtgaggatcaatatatccggtattgtagttcaatgataggaatcagattcggtcactaattaagtgagtcaaagtgggcttattccgaaatctaaagtaagcttatttcataacaaaattcagctcagttactcttgggtcaataagctagcctaataaaccgggaagaaaagtcagaaaacaatctcgctagcttccacctctcatgctgcagcatgcttataaagcaaagacaaatctagggttgatttagccttcatactcaatggagttattcctatatgctccgctgagatatgttgtttgtttcactttcaatcggttaaacgttgactgaacagtcgtcatcatcacgatgtaatttctacctttcaatcggttaaacgttgactgaacagtcgtcatcatcacgatgtaatttctacctggaaaggaggcgtcgaaggagcttaatgaaacatatcaaatacaatgcaattagacaatatgagtgaactcttcatccaaataaatccttatccatgacccaaaaatcattctcttccattatctgaagaagattagctcaccaagttagtagaagtgttcatcatctatcctcgactagttcaaaagcagcaagaccaccttcccacggtgtgtaaatgaaccccaaaacagaaaaaaaactcccaaataacacgccacaaaaggtatggtaggtgtggcttgacaatattacattcactggttgttaggttaagcattaaacaatcacatgtctcagcatctgccactataaaagttcatttttaaggacagtcatatagaaactttaattttctgagtctaattattggtcttgataatgtatccaaacatttacaatcgttatttttcatgatccacacatactgactatgacctatatgaataatgagacgaccaatcaagaaaactgtagtaaagaataattaggcaatttgttttgttggtttgttgtgggatatgttatatgttaatcaagttagtccttcttattggagttgaagagatgacataaaaaatgtttctatgtgaacaaagtaacattaagaagataacccgttaaactctttttttcttatagtaaagcgttcaactttgtgttgcgactccaaagctttattatggcacaaaaactttacacaaggctctaattattcttttactataaatcttaatttgttatgatgatgatttttaaaactaacttttaacttttaatttgttgagttggacgacaagttcagttatgtaaagctccaaggtcactgatagaagtgagcaactgttagtattttcatatttacttttcaatgatttatatcctaaatggcaattgcggagttcattacatatatatcaatagctaaacttgttatatgtattacaggattgatcagttgcttaagcatcatctcttatcgcccttataggaaactatggctcaaaaataaaaacatttaaaggatattatttttttctaaataatatggttcattgcatgttgagttttttgttacaactatataagatatatagttcttattgatgcggcttaatacatgttgatttttatagtaatgactatattaagtgcgctataaatgcaaatgacatataaatgattatgattaaaacataagaaagattgaactattattattttctatattatggctcactgcatattgagcttttgattatatctactattataaaaattgaatatatttttgccgtcattcgtattttggtatgtcatccgtatttgagtcattttttaagttcgttcgcttttgaaaatgtagatccgtgtttgagtcagattttaagttcgtttgcttttaaaaatacaaaagaagtcatacaagaaatttctttaaaagaacttgcatgctaacttgggattaaagtcggactcctaactgcagctcatgtttttttaaaaaaaatatccaagcgaattcctgaatttcattctatctaaaccgtataacaataataagattaaaataacattcacccattgcaacgcacgggcatttttctagtaactatataaatatgatatatcaataatactctagcacatcatatcttcaaagcaggttgcggaggacggtcctatttatatttctataaaagtgtacggatgtttgacaagtggaaaatatccaaatcccccttaaaaatctctttagagtttttaatgctcatgagttatattcctatttaaatactttttatcctggtaaagggatttcttcttggacctctttaaggaatacctacctttttcccttttccatgtctagaatcatcgaagagaaattatattgacaattcaacgtatctttaaacctttccacaagcatgcatttcttgcttgccttactttgagtagtccgcgtgctctggactgtgttaacgaccaagtttggtaataccagcatcggagatggagatgggatcgaagcggaatcgaagatgatggttgttgcggaaacagagtaaaatcggctggagtccgggtcggctacgactgggatcggctaagtctgagttagactgggttaagtgatacagccgattccgacaatacgatctgtgtacgatgtcgggttcgagttgatgtgcttcaagatgattgccatgcatggatagagtcctgggaaggcaattgtatctattaattaggatattttatgtaaattccttagagatatgtttgggcaaaagtctgccgcaaagacttatggtatcttagagtttgttagaaatagtagtcgtgtccggtatgggcatatcttgtaattttcgggtataaataggccccgagccctatgtaatttttaacacacgcacgttcaatacaatttcggcgcatcgccaccttttgctttagttttatttcgacgagttcttactttcgggttgagctgcatcggtttcgatcttcgacaagaggtaaaacttgttgtgatgatttgctttctcgggattagtgcttccatctcatgatactctaatcttgtttatgtgattcgtcaagttatcatatatcttacgtaatctctggcaataccgttatctaacctacaattggccaacatctatcgaggaaggcagccgattaggttagatgtcgatgttgatttagattatataagatatctaccaccctatgaaatatccagcggcttgattgtctagatattgttcttcttttcatacttaatgctgcatcagttgagtttgatctattaagtcgtgcttagaatcataatctctagcctgcctttggttgccgatcagggtagtatcggagtttcagccgatcttatctgatttaactatatttgttttatatgcttaattgatatgttaagtctgccctttatatcaagatcttgtcgcatctaaatacgttaagcttctacttgagtattctacttgctttaatatcttaatataaagtggtatcggagtattagccggtacatactagatctatttgatcggctatgctataaacatatatagtcttgttattaatgtatattttgatctaagtgatttatattgtctcggtgtggtgaccgatctatcccaatcacttgatttaagtatacgtcgatataaagattatatattgttaatatctacagccgatcgagtagatttagtttcttgctacttattgatgatcgccgatcgattcacatacgacatcggctcggagataaatgatatgttatcggcacctagccgatcggctatcatttatagatttgaccacggtttctttgtctttgtttcttgttgattgcaggatcaaatcaactggcacgctcatacatccgaaggcgagctttggacctgcactggagttaagcagatctcccaggcctcgtgttttctgtcaacagactgttgaatagatcaaagtggaaagtggaaccatgcttcctctccttggtgagtttgccctccttcagttctagcaagatgatggtgacaatagagtcactaactcttccaggtgctagacatcgttactacataaattgacatatgtgacagtccaacatgacccatttgagatgatcttatctctaatagctatagagatccaaagtttggatccaaatttcagtccttttccatcacatcaacctgtcatacacacacaacttttaagtcacatcatctccaatttcaaccaaaatctaaactttggatccaactaaacacagcctaggttgaaaagtaccatgtttgagatatagctatagggaacgacctatcatagatgtgacctcacatctgtgcatgatgggtgacattgtatgaaccgtccaagatgagctctcactctaacagatctattatgagatgttacgtatgcacgggttttatctttaacctattagtcatcagagatgacttattcacttacaaacaacactaacctattatgagatgttacatacgcgctatggcgggtcttatattgaacccattagtcatcagagaagacttattcacttgtagacaacactaactcttgtaattcccgattctctcgtactctccacctcctagctactagcatcctcctctccacctcgagttgccctgcgttgacgacctcagtgctaatatagccaatgaagcagcaccccagtggcctttgcttatgctgccctacagcaggtattatactgccctgtaaattctaagttgaatatctaggaacagtattactgaatctggcagtgaaaccttcctgtgcttgtttctggtttgatgggatttggttgaagcaaacaaccatgactgctctgcttgtacaactcttgtccctctgctcagcttacttgaatgtgtactgattgtgtgcttcacccatctaactctttgaatttgcacttgagattgttttttctaggagctttctgttactgaatctgtagatgggcatctactgcatcatcgctttccatatggattgttgtgttcatgtctttcaagtttacatgactatatctcctaatcttaacatggatatgtatatcatataaaatttcaggcttcagaaatttttttgaacaaataatttcaagcatcagctatgcttcaagtcattgtatgaagtatgaaacttcagccatcatttaacagttaacattttggtgctaaacatattaactatattctttaaaagcttacaattattatgtctactactcttggtaaatattccctacctagcttctatattgtgttgctaagccacatataacattttggttgctaaacaacttctactactggatgttcttagaagacaaagaggtgcgtagagatgattttgtgcttgtggattgtaaaacgccaactgacacacatatgtatgtcctagcagacactacttctcgttcactgttatattgagtcagtatttcagatgggaagtttgtgtgccctgataaaattctgaaggtgcagtgccatgtggaccatcagaaagtagattatggcattcttgcgaatcactttgtgcgcataggatcaactttatacattatcccttcatctccaagcaaaaagatgggcacaattgagagcaggtgctattagccagctctaaacatattttaatgagataaacgatgagagagaagagaagcggactgcagatctgtagccagctgcaacacggactccaagacacaccgtgtgtatgacaggtgggaccatatattaatagtatagcaagcaactattgtataaattgactatttaattggctatagatgaattggagctagtagtgggctgtactattagacttgctctgatgatcaggctattacggtctgctttgttcgaacagaacgatctcctgtatctttcagttgatttcgtagttgaccatggtagcattgttggtctaggtgacactctgaagcatgtgtttatcctgcaaatggcgaaatggcaacacatggagacaatcctcgagttcatctctagatcgaactaggagcatcattgtttctgggttcgttagcctaggtgatacttctttcacagtgaccgatgccaagaccagtgacttcttctttccttgacttaatggatcaagaatggcgtgtcatcgggccacgagtaccctaaagcatctccaacagcctctccaattttgactctccaaatgtctatttggccaactctcaatctaatttggcaagtcaaactctttactccaacagcctctccatctatcatctccattacaagtcaatgataaatgaaacccatatgtcagcctcatcataccttcttccatctttttttccccacccatggccatactacatctcccttggcatgctgtttgggagatgtatattcattggaggatacatctacacaccatgggaaggtgaccttgctacattcaaatcagaggcacccccaatggcatgagagcacttccgaaattgtatcctgtctattcccgtctgaactctgaagttgctatgtaatgaagaaacggtgatgatacatattactgtagcactttagacatgtttaatgaaaaatttatttactctttatgtaaagaacagtaatacggacaatattcacagcttcacataatcacactagcagcaccatcatttctcttatgcctatacttaagctaaaatgtgaattttaaaacttcattttagagttgattttgtgttttttttttcaatatagtttattttacagcatttgctttcaaatcgataaggacacgtcccacaaactattttttaagttgttaataaatggttcgcataaacgtaagtataaacaaaacgatggaatcgtaaatatcgagaaaattgcatatctatcatcgtataagatgggattagctcaaataccattactcaaatgggcttcactgaaaaaacaatcctcaaccaagatatctttgctcaaataccatcccaggcgaaaatgccccttagcacttcttcttcctccctccctccttcgttgaataggttgacggtatagatggccataaggcccgcccggcacggcctagcccaggcactggctaggcacttcatgcccacgggctacacctcaggcccaggcacggcccaccagtagtcgggccgtttcgtgccggcctgagccctgaagacacgtgtggcccatcgtgccttctttaaaataagtttatttcccctccatcctttttgggttgtgacatatatatagctaaaataagtctattttacgtcccaactctttaggccatgccatataatatgtctattattcctccctattctttgtgccgtaccacacatagggttgaaataagtctgttttgcatccctgaacttcgtgccggcctagcgtgccgaggtagcagcccgggcacgacactgctgttgggccggccgggccaaatcactgggccttgggccatatggtcatctaccgtcgagggcaacgagtcagggtggggcggcaacgcgcgacggcggccagcgagtcggggcggggctaaagtgtgtgacaatgtccgagactacacgagcgacgacggtgaggcagtggagccggtggtggtcgccggtgaactattcagccactggagggagggagagaggaagaagaaaacctaaggggaatttccatccaggaaggtatttgagcaaaaacattttggttgaggatggtattctagcgtagcccatttaagtaatagtatttgagtgaatcccatcttatgcgatggtagatatgcaattttctcgtaaatatctaattagatgacaatgacagagatgcactattatagtcgtcgttgcgccaaaagcaactaactgatactacatccatcccaaaatatagtaacctagtacttcctccgttttacaatgtaagtcattctagcatttcccacattcataatctagatagatatatatgtctagattcattaacatcaatatgaatatgagaaatgctagaatgacttacattatgaaacggagggagtacattacatgatgggacatataggaataagttcacctgccgtccctcaactttacacagagtttttttgacatcccttatccacatactagaaatcttcacccctaaactatacaaaaccgtctaatttagatcccatggcagcattgatgcctagtttcgctgacgtggcatcctagtcagcacaaataaaataaaatgtggggcccacatgtcagtgagagaaaatgatgtgggccccacatctcctctttcttttcattttctcttctcttctctcgagcaagcgtggcgacagatgggggagaggcggtcagcggcggagcaggggcggtggccggcagagcgggcgcgacgggggcagagctggcccagcgggcgggcgagcgcacggagaagaagctaggcggcggccggcggagcgggctgtcgtaggctctccggaccttccattataattgagagatgaagtgaataattcaagtcatcaaacaagcataatgaaatatccgacgcctcgagagaggaatattggagatattgctaggcctttagcttgccagtcaacttcagcctgagatgtgcccgtcaaaccactcgaaggcggcgaccagatgtgttacacattcaggagacttgacaaaaatggctaaagttctacaacatctcaaatatttctaactcatactcatgtgaatctagttcccaggatgtgcactagattcacacttcatctcaagcatgattatacatagcaaacacaaataagatgaaagcatctactttagttacattggccgaccggccaaataaataatagaacagcggaagcttgtctacccaatccacaagcacaccgactaggggtttacccattatgttcaagtcctagaagaagcagtcgataacccgcatcactcaaagactaagtctaaatcctgcaagcaaaagttaattcaacagcaagagtcagtacattattagaaataatgtactggcaagcaccaagacaagcctaacaccctacttgcaaggtatataatcaaggaaggcatagtatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcatctcaaatctcatcacaatttgaaggtaaatttcagcatttaggagaataaacacaagtctatactcaatacatatccacacgccgctcatgaccgcgagcacgggtaatcgattagttttaactctgcagagtttgtacactttacccacatgatgcgaaataataatcatgcaagagcatggcacgcgatacataagtacccgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgatattgagtgaagtccttaggtcggtttgggcgcactctccccctatcggtacacaactaatcaccatatgtgcaccacttgaggcccaaacctaaaatccatgttttccaccattttatttatcaaaatcacaagtattaaagttttgtccagattaattaaaaatcaattttcatgtttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggaggtgggacttgccttgaatcaggaaaatgtcagcacctaaatcacttcttcaccgattaagcaatcatctatacaaagtatacgttatgcaattaaacaccgaaatatgcgaaaaatccaaaatgttctaaaatgcatgatttgtgcacagagatcaggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgttttctggggtgaagatatttgttttctaagactaacacatttggtttcataatttttagagttaatatgaattatttatgtattttacaagttttaacgtgttctaggcatatagtccctatgtgtacatggctttggagatttaggtccagaacttgctctaacttgctagtgttgtataaaatgagtattttagttaactaatctaatcttagtttataaaattttagtgttcaaattactttacttcacattttataagctaggggatgttctatgttagaaacttaagatatcaatctggagattattatatgagttaaggatactaagttttggtggaaggggatggatctatgccttcactggttcaacaagttttatttggatttatttggagctaccaagcatatatatactttttcatatgtattgtttaaccactactatgtgtttagtacctattctaccaaattaaggttcagagccatggtctgtaagagggtgctataattcactctactaggttgaagtatattacttactggttctatagaaaatttggttcacttcatttagactatagatgaattttctacaaatgttacaatttaaggtatgctccatgttgcttataacttacttaaatacttaggggttttcattatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaaagatcaatatacaaaaagatccctgaggtttctaagaatcaacccgcagacctagcctcatatgtcagtgagttgaaaagttgcacattaatccttatagttgtttaaattctcgaaacaaggtccctgacttcttttctcatgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcggggggtgatgcatgtgcttctacaatcatgtattggttaattgggtgcatacatgtatgttctacaggctgaaggatgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagagatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggttgaggcgaagacgctggcgcgacagcttggcccggcttggtccagataagcgggaacggcgatgatgtcactgcggcggtgcacagagcgcgctctagagcgaccatgacatggcggcgttcccgctgctgtagaagatgaaatggaatgggatcaaaaccaaagttgttcgtcatggtgagatgagaatggaacgagtatgagttagagatgaagagggctcgacgacggttggcgatgtccctcttcttggcggccggcgacgaaagagaggtggagagggagagctggagcttcctccctcggttggatcggtactgggatggtgggtgaagaatggtgacgcagatgggtggaggtgaagcctcggttcggcgctgccacgtcgaggccacgcgtcgtacacagccggcgccaatctctctctctcggctgtctctggtcggctgcaagatttgcacagggtgaggacgagccagagtggctgccaagtgggtccaggtcgtggcaaactaagctagggtgagagggttgggcagaaacgtgggtgaacaaaaggtttgaatgattttaaggattatttctctctcccactttagtatttcaattatttaatttgtgggtagaataatttagtgtggatttttctgaaggtagatgaagatacctagattccattttctttggttgcactcaaaaattatggatagattactcacagaaattagaggaatatgggttctttggaaactagttcgaatttttaggagacctaaacagagaagataaattctggaaaaattatttttattcatgataaattacctagcatttgaataaattattttacttatacacttttatgcagttaaattcacttttagacaaagtatggttttagccgattaagaactacagttaatctagtttttattagtttgactgatttatttgaggtaccaaatttagttattaaattataccaaaattacagtgagttgtatgtgttgattagagcctacatgaattttcccatgattttatcttgctcgcaggacttatgtcttatatgtgtttccctttcctaaatgcatgtaaatgtttataaaagttatatttggactctcattaacatgaggtgatgttgatatgttagaattacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcatgcaagagttggatcaactccacctaggtttaaaatggaaatttttggtttacaaaattgaagaacttccctttcaactagttttgatggaaattccttaatcctagaattcaggtatgttacacgggcgcggcgggcaggcaagcgcgcgggaaagaagctacgcggcgggtggcggcaggcaaagcgggcatggtggcaagcggagttggcgcggcgagcgggcgagcgcgtggggaagaatctatgcggggggcggaggccggctcccctcgtgacttcgtgggcgtccatacctccgccgccgatgtccctccaccatcgccgatgttgtgctcg

SEQ ID NO: 26700 - DNA, 5038 bp, Oryza sativa
cactccgattccgcgcgggcctaccactacgctcgcccgtgacccacccatcgccgctccgtatacctgccaccggcctccctcacttaagaagagaatagacaagagagaaaagaaaagacaagaagaagaaaagagaaggaaaaaaaaagtgcaactgacatgtgggccccacgtattttttttaaaagttttgctgactaggatgccacatcaacaaatccacccatatatactgccataggaccttgagtgcacggtttgtgtgagttcagaggtatacatttctgattttgtggttaagggacctcaaaaaatatggctgttaagttgagggacctctggtgaacttattccggacatatatgtccagatccatagtactataatatgtcacatcccgtactagtttgctatattttgtgatggatgatgtatttgagagatagatcatatcggccgatgatgtatgaacgccgatgggcaccatagtcccttttatggacgaagctagtagctgatactctccttttagattatttatcattctaggattggacttaagtcaagtatttccacgcgtatatataacgtgtttatatgactaggtcccaccctaactcagctggattgactgcagtcaactcgccacctgagctgaaaccaggcacaatactatcctggatctcgggtacttcgctattgtaaattgatgaacacgttatattagtattacagttcaaaaattaaagtacgcgattcaaacacgacatcaaggcaagaaatctaaagtaaccttatttcataacaaaatttggcccaattactcgcttggggcaataagctagaccaacaaactaggaagaagaaaatcagacaacagtattgcaaacagcttccaccacctcttatgctgtagcatgcttgtaaagtaaagacaaatctagggttgatccagccttcatgctctattaggatacaaatctacatgctccgctaagatatgttggttactttcatgtccgatcgcttaaacgttgtttttttttaccaaggcgccgaaggagcttcagaaaacatactaaatacaatgcaatcagagacctcatttgtgccaatcaaacaatacaagtgaactcttcatctaaataaatccttatccataaccaaaaatcatcttctttcatgatccaaagaagatgggcttaccaaggtagtgaagtattcatcatcctcgactaactcaaaaccttctcatagtgtgtaaatgaattccctaacgtagaaaaatctcccaaataacatgtcacaaaggtatggtaggtgtggcttaacaagggttaattagatttatgccattacaaatttcacgattaaaatataccatcactattcacatatttgtaaccatgcaatcacaatttcacagttatttgatacataccactacttaccctttcatcttatttttcaaaagttttagaccaaaatgcccatgtcttcttccttcatcccctcctctctctcctgttcatctcatctgttcagatctagcctagccttaaccgatgcgcatccttgccggcggcggagatagtttgggcggcgccctcaccgacgttaaggaccaccacagcaacgagcgccttcaacgcatgttctagcaggagttcgacacgcatgttgtggaagaatatacgctcttttgtttttttcatttttattcataacgttcttggttttcttcatcatcaattgagaaggttacgcaaaaaaaaaagagatacaaaattcatgtgtgcgcacgtgatgaataatttatgctatgtcattgttacatgcatgtttcggtaaaacatacaacaaataaattctcttttatttgaaagaactagtcggtcgggatattatttcagcttaagaaacacaacgttgtccctcaaattgtcgcacaagcaggatgaccgttgcttgtgctatctcggggtcagatctgagacaaggaagaatatgaacaggagagagaggagaaaaggtgatgagggaagaagaagggcaatttgatccaaaaattaaaaaaaaaatagatgaaagggtaagtagtggcatgtatcaactaactatgaaattgtgatggcatggatataaatatgtaaatagtaatggtatatttcaaaaccatgaaagttgcaatggcacgggtttaaatattacattcactagttgtaagttaagcatggaacagtcacatgtctcagcatctgccactaagaaagtttgtctcaacatctgccactatgaaagttcgttgttaaggacagtccatctataaactttaatttttcgaatttatgtatctaaacatttacaattcttcttattcttaatccatacatacggcagggtatgacctatacgaacaataagacgaccaatcaagaaaaccatagttaaaaactaattttttaacttttaatttgttgggttggacgacaagttcggttatataatgctgaattataaaattaaaattctaccattgaacattctaataggaaatgatgacaatgtcattaataaaagtgagcaaattcaatcatttttatatttgcttttcaatgagatatatcctaaatggcaatatcctaacattgcggagttcatcactctgatgcgcaagacacaacgtaagctcaaatgttatatatatttaataaatcacttttaaaatttaagaatgagagcctatgcatcgttggaaattctaccattaaacattcaaaggaaatgatgacaaggttgttcatagtagtgagcaaatgtaattatttttatatttgcttttcaatgagatgtatcctaaatggcaagatcctaaccttgcggagtttatcactctaatgcgcaagatataacataagttcaaatgttatatatatttaataaataactttttaatatttgagaatgagaccctatccgtcattgaaaggggtggtggcagtgaatgtctttcttttgaagtggtaaaagtttacatatacatatatcaatagctaaacgttttatatgtattgcaggattgatcagttgctttcatttctcttatcgcctctaaatatatatcttatagaaaattataactcaaacatatagaaaaggcatctaaaggatattattttttctagataatatagttcattgcatgttgcgtttttttgttacaactatataggatatatagttctagttgatgcggcttaatatatgttgagttttatagtaatgactatattaagtgcgttataaatgcaaatgacatatcaatgattatgatcaaaacataagaaagatctaaatattattattttctatattatgactcactgcatattgagctttcgattataactatataaataggatatatcgataatactcacaatagcacatcatatcttcaaagcaggttgtggagaacaatcctatttatatttctataaaagtgtacggatgtgtgccaagtggaaaatatccaaatcccccctcccccctccttaaaaaatctactttagagtttttaatgctcatgagttatatccctatttagatacttttttatcctggtaaagggatttcttctaggacctctttaaggaatacctaccttttttccttcaccatgtctagaatcatcctagagaaataatattgacaattcaacatatctctgaacctttcctcttgcttgccttactttgagactttgagtagtctgcatgctctggactattgaatagatcaatgtggaaagtggcgagacggggaagcggcggcggtgtggatacggggtcctgcggcggcggtgaggtggggaggtggcggcgaggtggatctggcgtcccacgcggagctgccatcgcgtggcagcctctgcaccagcgcagcagctgaggacagccagtggcggccatgagcagaggtggaccctcgtcgtcgtctgctcgtggtgtatggctcatggcagcaggtttgaggaggacggttggccatctcctttgatgctggccaggcaaccccctctctgtggacatccttccctcctcagtggggagctccataggtggatggaggtagtggcttgacgacatgggatggcttaggtcaccgaagcggcgtggcccaactccgggctctccttggccggattcgacaaggaggctggtgggtagcagagtggaggagacctaagacaacacatagggaagttggtggcggggtagagaatgctggcggcgggcagggacgtctcccttgatgtcggtcgggtgtcgtctcgacttgtggagcatctcccgttctctatgggatgttctataggtaggtgggggtaacggtatgtcaataggggaaggcttgggctgccgaagctacatcgtccattaccgggctttttgccggattcggagctgaggtcggtggatggcagagcgaaggaagctagctcagcgttgcgggggagtgacaactggtaaaaggcgctggcggtgaggcgaagtggccagtcttgatgtcggtcggcggtgaggagccggaccggtacggcggaggacacacgctaccgaataccaatgttgggctggtggtattagatctggcaggcgacagaccacagaaacggggtgaagaggatcccaggcgaaagcctagcctagcgcttgattgggctggcagtagctacgcctttggacgcggtaaccctcttgagggtgttgccgaggtaccctccttcctcgacgggggtctctaggtgaaaaccgtgtccaatttctttggacggatgatgactgcgtcttttggcatcgcaaccttcatgggggcgttgtttttttggactatcattctatggtgttgctgtaagcctggcggcgaccggcatgcatagcggtggtcggtccgtcgttcggccctcctctctatagcttgtgtttgtgcggttggcgtgtggtgtcagtgcgtgtgcttttgtgcactttct

SEQ ID NO: 26701 - DNA, 13973 bp, Oryza sativa
ctatctttataacatttggatgacttccttcactcaccccgacaaaaaaaacatggatatgtatatcctatagaatttctggcttcaggttttttttaacgaatttcaggcttcagccgtgctccaagtcatcgtatgaagtatgaaacttcagccatcatttaacagttaacatttttgtgccaaatattaactatatctctatctctactattataaaaattaaagatgtttttgccataattttgatacgttatctgtatttgaatcggttttaattttgtgtttcgactttaatctatatatagaaaaaaaataagtccgactcaaaaaaggttaaaaaaaagaaaggaaaaacgtccaaattaacgagcgataaaaaaaagcttccatctatctattatattatattattaaaacagccttgaaaggaggcaccacgttcgctgtgggggctagaaattcccacattaatcgaagaaaaagagaaaaatctacaccgttagatcgtagtggatctaaattataacggtatagattgatagctatatatatgtagtacaattgtagtttttaaattataataagttgtggatgaaatatagcaatctactactcatatttggaatcaggcatattagaatcggctttttttctttgatgaaaccgttaaggagtaggattaggattgcagccgcacgaattttttcttttctttaatgaaaccgttacggggtagaattgcagctgcccaggagccaagtgccgaccggcccttcatactctgtctggctgcacggctcttgtgcttagaattctagatttactgtgaaaagcataggctcatggtaaactgacacacgaaccccatatgagattaattaattttcagaaaaaaataaaatctgaaattagcaaaaaaaggaaaagaagagtttgagtagaaatacaatttaaaaataactaaaattcgaaattaaaattatgcaatattggaagaagagtctatataaaaacccaatacgaaaatattaaaattcagaataaaacaatagaaattataaaaaaaagaaaagaagagttcaagtaggaatacaatttaaaattaactgaaattcggaattaaatataagcaatattgaaataagagtacatataagaacccaataatactaattaagattcggaatgaaaaatagaataaaatccaaaattggacaaattaaaaagagagttcaagcaggaatacaatacgatattagttaaatttcgaaataaaaaataaaataaactctgaaattataaaaattaaaataagatttaaactaggatacaatttataaataattaaaattggtgataaaaaaataaagaccatctaaaacacatgacgggattaattgagtaacaggcctataaaatagtagagcggtggcggttgatgggatatctaaaatctattaataaaacactaaatagaatgataacgggcatgtcatgaagcaaccggtacaggcggttggtgggacttcggaaagtaaaaaaaaacaatgataaccatatttgatttttaaaatctcaatgataataaaaaggagaggcggcgggagggtcgtacaggagtacaatggcagagcggacgatggttggtgggacttctagaaagtaaaaaaatgaattccaacgataattatgttcgatttttagaatcccaatggtaataaagagtaggcagcggacgggtcgtagaggagtatagtggcagcgtttgacgagatttctaaaaattataaaaaatggaatccaacgagacaataaattataaaaactataaggtccaaatttaaaaggttcgggcttctgaaaagtaaaaaaaataatgataaaatctcagtgagagtaaagaagggaggcagcgggcgagccgtattggagtacagtgacaaagtcgctgacgttttggtggaacttccaaaaagtaaaaaaaaagaacctaaacgataattatgtttgatttttaaaataccaatgacaataaagagaagaggtagtggatgggccgtagaggagtataatggcaacgtttgatgggacttttacaaattataaaaacgaaacccggcgggacaataaactctaaaaactatatgatccaatttttaaatgttccaagaagaattaatagaaacagtggtagatcgaggaagcaaataaagaaagatatgacataattaaggggtatcaactggcgtgtgacttttaaaaactataaaattaaaaacacaatgatgataaggtttggtccaacgagataattatttaataaattttaagtaaaattatattaaaaatatataattttgtatgggtgctagccgcgcaattgcgcgggtcacccagctagttgtcagtaaaaaaaagaaaaaaacatctcgtcgtaaaaaaaatagtccgactccagtagagaaagggaaaaaaatctcccagtaaaataaacaaaaaaaagtcggtttggtttttttgcaccggtattttttccccttttttctttgcacgcaaaagagttttttatgcgcacacggtaagtcttttggttttttgtccggctttttttaatccgatctgttcatcgcgtgcctctcgggcacttttggttttttttcgtcaatcttttttgtcgctggttttttctcctgtgcactttttgtttttctcatccggttttttaatcccatctgtttgccgcacgcctccctaggtgaaccctagcgccgcgccgccgccatatcgatcatgcattttctcctccaatttgattacaaaatcgattccccactcctctctcatcatttctccatgattttccctttgattcagtgccagatttaatctctgttttaccgttgccgatgatgacggcaatcttccccggtcatttttatcccgagttttacgctctgatcttggggaagacagaaagagtagatcgagtggatcaaaaaccctcgaccaatttgactggtcgagaaagattctgccagatttgatggggatatttgctctggctaccgtacgggcacgggattatcttcgggaggttgaagatggtaatcatcttcccagacacgggactatctttgggaggttgaagatggtaatcatatttgggaggtgaaagatggtagtcatattcgggatgttgaagatggtagtcggctgtgtgagttgggtttacggctctacttatggctgggtcgaagagaagcagaccaaatggagagaggtagcggactagcctagggctgaaaaggaaggaaggctttcggacgaaaatccaggaaatattttcattaacttttttaattataatctacagcgatcccaatattaagatttttattaactttttcaattatagtgtatgttgatcataatatttcaatttattgctcagctcttaatatatcactgaaaaaacgtctttacccattgcaacgcacgggtattttttttattttttctagtcaattattatgtctactactcttggtaaataatccctatctaccttctattgtgttgctaagccacctataacattttggttgctaaacaacttctactacgggaggtttgggcctaggcccgttttccctttttttggtgggggcacttctttttcttgacaggcaatgtggaccttatggaccaaatgggtgttgcgttttttttaaaaaaaaaaacttgctttctaattcatcccaaattcatatgcataaaagcttcaaacaaatatatagttcatgggtaattttatcatctttgagaaagtactgaaaggtatcacattttctaatgtaaaatttggtacatctagatacaaaatatcttgatgcaccaaaaattttaatataaaatttaggtacctcgaggtatttttctcaagtactataaaattgctatgtttctatatcaatttttttatacggtaagtttctaggtagatagttcacgtagaaagtttctatgcctaggtgggtttgtctttcttttcttttattgaacttgccttttgaacttattttaaattaacgttcataaaattctctactgcggatatttctatgtagaaacttttgagtcaataagaaggaacacatcccgaagtggaaaaaaggaccttaaggccctggtcgattaatcccaaaggaaaagggatgagagaggatttattccacatatattatgatgtggaattattctcatttaatctcctccaaacaagatctagggactaaactttaattcatgtcacatcagatgtttgaacattaatttagactattaaacatagactatttacaaaactaattgcataaataagagcttatctacgaaacaaattttttaagcctaattaatccataataagggaatgcctactggcatcacatagactaatcatggattaattagattcaatatattcgtctcgtgaattagtccaaggttatggaataggttttgtcattattctacgtttaatatttctaattagtgtccaaacatccgatgtgacaggaaaaaaaaaatttttagccccatcaaaactcgcccaagagaaaacgaacgtggactcgatgcacgtgtggagtgaacctgtcggaatgcgtttttgcgtggactgaaaacgcacccacgctcacccgcaccattagacgcgcacccccaacaattcacatcatggctcgcttgtccatgcccatacacgttgaaagccaccagctcgtccaccgtggcaatatcctctaaaattgctcaacgtgaacttgccacaggtgaggtgagcatgcgcgcgccacggccgcggcggtggccggccgacggcgacacgttgtgctagatgaggtggtgcatgacatccacggcttcaacagttcaacttccggagttgaactgtgcaaaaaatccgactcaggaatgcaggattgtccaagcacacacaaacaatctccaaaaatccaaatgaatcggtcgcatttcaactaattaaggctgcgtctagttggatccaaagtttggattttgattaaaattggagatgacgtgactgaaaagttatgtgtgtatggcaggttgatgtgatggaaaatgactgaagtttagatccaaacacagcctaaactgttttgacttgaattttcgacgagtgtcctgcatgcacatgcgtgaacacctcagttggagttgggtcactccgattgaaccagcaattggggccaagtggccaacgttgattgcatcagtgggcacacgatgacttcgttgcttctactgtgcagcgagtgatatatatgcgcgtgatatatatgcgcgcgtgcggctgacttccttgcttctactgtgcagcgagtgaattagagcagctagaatagtagactatataagagcaggtacaatagcaggctataagccagctgcaaacatattttaagtagataaatgatgagagagaagggcagctggctacagatttgtagccagctgcagcacggattccaagacgcagtgtgtatgacaggtgggaccaactattaatagtgtagtatgtaactattgtatgaatgagctattagattggctacagataaattggagctagtagttggctatactattgaacttgctctaagccaactataaacacatatcgaggagagatgaaagaaaagaagaaaaacagcagctataagcacggactacaagaaataatgtgtgtatgacaggtgagaccatgtattaatagtgtagtatacgtttatggataactattgtacagattgctaattaagtcgactatagttgatttgaagctagtaattggctatactattaaacttgctcttaagctgcagctgagctttgtcactgtcgcgcatcttagccgcacgccggaattccaaacgagttgcagccacgcgcgtgcgacaatacattgcgatctcgtcgtcgccattgtcgatcgatcagccagagaggtggccgatagttggctgtgaaacagtgaaagttgcagcaattctggaagctagctgctgcagagagtcaatcggagagaagacgacagaatagtcgacggttgagaagaacgttcagaaaagttgcttccatctatcttttcctgcgaagaaatgaaaatctgatgtggaaattagttagcagctataatatcgtcacgtgcacatgagtggccagagtccatcgtttgtcctatatgaagtcaaccgttgtcaaattttgaatttcaaattttatttcgaagttaattaacttggtgtcctttttaccgttggtttttaatcactggaaatatatactccctccatttttgtaaagaaaatcattttggacagcgacacgatctccaaaatgcaactttgactccttctttctataaaaatattattgaaaagtgatatatgtatacttttatgaaaatatttttcaatacaaatctattcatataatttttacattttcaaactcaacaacttaagagttattcataatttatattcccaatgtttgacttaaacactgtcctaaacaatttcctttacgagtacggagggagtatattgtaaaagttttaactacaatttttttattgctaataaattgtttttgtttataatctcatcttatagccaacaaatgaggcccgaggatataagctgtcagctgtcatcacgatcttttctcttatatatgttgttaactgccgataagattgactcgtcacaccatggtgcatggtgatctacaggaaagaagttatcagggaaaacttgattgtcattttgtcagagttccagtcaaactcaaagctacgagcattctgccatttcgagtcttggaaaggcacaggttagtgtatctactcgcattttggaaagtggcaagaaaaatatttcaaagatctagaagagagttactccgtaccttcaaaagatgatctagaaacgagccagtgatcagtgttggaagaaagaaaaatgacatactataataatcttataattgaaaaagaaactcgaatgatgttcaatactaataaactaatgatatttttaatcaataaaacaacgaaatactattaacattattcactttaaaaaataatcaaaaacaaattccatccggttattgttttaccgatagtacgtgtgaacattttgttttctttttagaaaatagattaaaccggcctctattcaaaatagatatacacaacgaacgtgcgaacaatttagcgaatattcagtagtccttcagagagaattgtcagaggtacgaactgcttaatggtgatcgaatcgacaaataatggattaaagacaatcaataaagcgcgccattccctaaaaaagaaaagacgagaactagcatgtaagagcatgcccaacagctacccaagaaccctccagcgcgcgtgagacaaaaaccagatgattgggaatgaaatatcgcttcttggaagtggggatcgatatatacggagaagggaacgagatattttgggagcagtcatagtgaatctgttggattcaatttttgaccaaaaatcctaaaatttcaggatagggaatgaaaaagggaagctattggtaatgctctaagtacgttcaaatcagctatattaattcatatgatgtacaagggatatatactcaccaataacattttccacacgatatgtagtctagttaattattattaactctgtctcaaaatataagagatttggtccgtataattagttaagagatgaggttgtattttacagatagtacgcgtgaacattttgggagaaaatgttattattctaccgagagtacgtgtgaacattttttgggacaatttagtttcagagagaattttcataggtacgagttgtttgatggtgattgactcgatgaataatcgattaaagacaagaactagcagataagtacgtagcacaaatcagcgtacgcataaggtgttgtttcttatacacttgcacagctcgaatataaacgattaaatccatacatcttagcactctaattaattgctgatacgatgttccaaaaaagaaaaagaaattgcagatatgattatgtgtagctttcgtcgttgaataatcaacacaaactagtccaaaggcaatcttacgtacgtcacaggggttcatggtcagtggtcagagaagactatgtagctttgactaatttactccaattatgctgctccttgttctctgttctcactttgcttacatcggcaaaatgctaacccacacgtaattaacaatttaacatgcttgctgtgtcaatcaaaattttactacttgtgaaagccgtacaattagtgtgtcattctcctgtatatattatggccattgatgggttaggttagaacagaaatagattatatacaaattaaacactgcatttgtgtttgttttccaggtaaccattaattttctagaaattaacgttgtaaaatttatgtttttaatcagccatgagaaatactttcatagcatccatatattgtgaaaaaatatgaatttatagatactgacagtcaaaattaaaaatgtttgacgaaatacaaaactaaaattacaagcaatttataaagcggagagtcctttttctttctataatagtatcaaatcttacagtataaaatgtagttttcacggatttatgtattcctacctaaaaacatgaatgagatgaggattattggtgaggagcagtcaatgcaccaaatcagccgccacatagttaagtattaccactaccagttgtagtgctatatgtagctttccagttgcctgattttactggagaactaaaatatttttagaggcagtcttggactccgacaggatgcttaatcatcgagatcaagacatgatggaccggtacacaatgttagaactaattaatcatgcatttcgtgttaaattagtgcacatgggtcgatcaggatcagtattagccgccgtagattagtacactctttacctaccgtcttggaagtatgtccctgctactccctcttggaagtacgtttttatgtcaatataaaaataacaacattcatactaccaaaatattttcagtgtcagttttaatgaaatgatttggtattgtagatattaccaaatttttctataaatttaatcaaacttaagaattttttactatgagaaaacatcaaatcgtcaagcgagtagaagactattagctgagtggacaggggaatcgaacctctggtatgtccgacatcccggatagaacaaaaaagactattagctcatttctgatactaagcactaatttatttccattttccttttctttttgttggtttatggtattccggttggatttggatcagattcttcatctagaaacagcagtgttgagagatttgacttggagagtcttggtcaaacttagtgcgttgcaaagtcttcatcctccctaccaatccaaggatggctgcacatctggactttcaaagcatttccgtacacacacataatgcaagatcccgatccacctaatgtaagaggacagtacgtaagaggatccggttccgttacaaacagggcgtgaattcaaccgagaattatcactgctataatcgattacattatggatctgtttagttggtgaaataaaaatattttagtgtcacattggatgtttgaccggatgttggaaggagttttcgaacacgaatgaaaaaactaatttcataactcgcctggaaaccgtgaaacgaatattttgagcataattaagccgtcattagcatatgtaggttactgtagcacttatggctaatcatggactaattaggctcaaaagattcgtctcgtgatttacatgcaaactgtacaattagtttttctttttatctatatttaatgctccatgcatgtgtcaaaagattcaatgtgatgtttttatgaaaagtttttagggaactaatcaaggcctatatttacaaattactacctccgtcccaaaataagtgtagccgtggatatccgtgcccaacgtttgatcgtccgtcttatttaaaaattttttgaaaaatttgaaaatatttagtcacacataaagtattattcatgttttatcatctaatagcaataaaaatactaatcataaaaaatttttaaataaaacaaatggtcaaacgttaaacgtgaatattataaaactgcacttattttgagacggagggagtacatgtcctgatggcaggatggcaacatatggacgacgagcaacatcacgtatcagcgtcgcgtgtcaccgcgggcagagcatatatgcttgtgatgcccatcgacggatgattgacagactcatcaagatggacacagaaaccagaaaaagaaaaattccccccgaatcgcctgaattttacaggaaaacagttcgtttcctttttaaaaatcgtgaaaaaggaatactagtgaaaaaggagaactgcatatggcgcacacaacacgagggaatacgcttctgcaggagagaatacgctttccagtccagctctcccatcatcacgctgaacaagctaccggccgccggccggcggttggtcaggcggtggccgccgtcagtctggtccggccaagtgtccatgattctgcaacgcgagaatgcaagccagctgtggcgtcgcctcgcgacagacagacaggccgaccggccggagaattattccctggcgcctgaagcctccaacgcattcggacgataatctgttcttattgtttgtcttatgcttatacttatgcatataaaccaaaattttaattttagaattttaattttaaatttgatttttgtttttcatcgtattttattttacaatgtttttttctcttaaatattcttttatttatttgttaataagcgattcggataagtatatgaataagcgaaacaatggagcttctagatggcgtgactggtcgtgcatgtcttcttcaaaagttgtacagtgttccatccgtcctaaaatatagttaattctaaaattcaaattttaccacaaatataacaatctaagataaacaaaaatattttttcactaaactgcccacacaagcatactacctattggttttattatagtcttgatctacacctaacacctcaccatcccaaaaagacgaacaaatctctctatccgtctccttaatatatgtctaatgtcttcctttaaaattgctacattttaaaatgaaggtaataatacaacaacttgtaaatataaatttagataagtagttctctaaacatatagatgtagctatagaaatacttatattttgggatgaatggagtagcatataaactttgaattttgagagttgattttatgattcttttttcatcataggatattttctacttaattttcaattgataatgacacaaatataaacattttatccttatatcattttttatccgtttatgttgctatggctgggtcatagcaggcatgattgatttatattatagtatggattattattacagattatctacttaaatatagtgtcaattcaaaattataaaaaataaatttaaaaaataaatcaaaataaattatctaagcaatatcaagttcttttaaacatgaaacaaataattcaacttaataatatgtcgaataaactaaaaagaacatgaagttttggtcgctgataatggaaactattttaatcccgcgagctcgagggatgttctcattaattttaaaaatgtcgaaaaagttacgaaaatttctcaaaaagtttaacagcactcatacaacatatatattccaccctagaaaaatcttatgtccaaaatcgactcgcacatttagatataaaagaagacaaattcagtgtataaataatagtgtattattatttacgcgaagtgagtatagctcaactggttaggttccttgtggtggaaccaaaccacctaggttcaaatcctagatttcacacgggtgctcgcatttatggctaattattctttcagtggtaggcgacgtacccgtcgacagcgaggcgcttgtggtgacttcgtcaatctcaagatatgccggcctagtctttcagaggtgctcataggggtagggtgtgcgtgtgtgcgttcataggggtgagtgtgcgcacgttgtgagcgcttgtgtttgtactgtgtttcaaaaaaatagtgtattatttacacacgaatttgtatcttttttctcagtgtgttggtcgaatttgattttgattttttttaactgatagatgtcactatactctatttttctcgttattttttctaaatctttttagaactatttatattagattttaaaaaagatacacgataggacatcaactcggattggttatagaattccattcctcgctgacaggtcagccagagttgaggccatggccattgttgagcagcaggagaattttctgatggcttatttggtttagaggaatttgaactcataggaatggaaaaaagagagaaataggaagatatgcacatatcaatctatatgaatttttccaaaaggtttgagtcgatgaaaattcccctatgttatctttttacaacttggagggaaagaaattttattttgatttttctatacctcatccctacaaatctaatgacatttgtagaaattaattcttaggaatccaaattatttatttttcctttaaacccaataagccctgaatttgtacggagctgaactgagctcctgtgttccatcaatcgggtttatgctgtcgcaccggagtaccggacacgcacattcttcagatcaaagcctcctcaaactttccaagattcttcttgttttcccttaaaataaaaaacctttccaagattctcggtgacgaaagacggttcaatcttgataaagcttccgttcgaccatcacacacagcctaactgaaactgtaggtctgtagctaccgtcctgatgccctttcctttcctcgtatggtaagttttccacaagcttttcacgcattggattcataattccagtgtaatccggttttgttccgtgaaatccaaacttttcggaccaggtcgaaaacacgaatcactcggtttttttaggctaagttcaaaaaaaatcaaactagattttaaatctccaacggaatttttctgtattttatcggttttttcgacgggtttcgtaaaatccgatgatatcgctcgtgaacggatttcgatccggtatcaagaatgtgaacttcggcgtcatgatcggtccggcgttcagctcactggccaccgccgtcgacgcgactccatggccgcgccatgggcgatgatgctttcctcttctccctctctatttttaggctttggaaggcaaagtgtgtgcaaagttgaggttgatccgggcgtgacgtgcgtgccatggcatgaccaaaaaccacatccagtcacgtggctcaaaatgcacggttttttgcaggcagcatgtgagcgtgtctgccggcgctcttttgctgtgtccaaatcctaacgacacagccacccgcgctcgtgtgcaaacttagtttttgattcctccccaaagtttgttgccttagctacaataataaatatccagaaagcacgaattatgttctaccaataccattaccaatatctactacggatattggtaataacacccttgaatattaataagctacttttttcgtttcagattataagttgtttcgactttcatcaaagttaaattatttcaagtttgattaagtttatatttttaacccaaaacaaatatattataaaaatacattcaattattaatttaataaaattaattgttatgataaattattattatat

SEQ ID NO: 26702 - DNA, 8051 bp, Oryza sativa
ctccctccgtttcaaaatgtttgacaccattgactttttagtatgtgtttgaccattcgtcttattcaaaaaatttaagtaattatttattctttttatattatttgatttattgttaaatatactttcatgtacacatataattttacatatttaacaaatttttttaataagacgaacggtcaaatatgtgctaaaaagtcaacggtgtcaaatattttaaaacggagggagtattttttttagaagctagagtccaagcgtttaaggctctcgccgagcagtccatctcccacttgtgcggtgtgttgacgaaattcactgacaggggagcatggggtgtgtgcttatataaacacggacactcgatttagctaatagctagctggagctcgatcctgaagagcagtatcagtgctcagctcactgttcatcatcaccctcacctcttctctctccctcccttaccttcctccatagacgactgcagctagctcgatcggagatcgaggccatgtccatggcggcggagagggtggaggctgccggcggcggcgacgacgactacacgcaggacggcacggtggacctccatggcaacccggtgctccggtccaagcgcggtggctggaaggcatgcggcttcgtcgtcggtaaggattgaagacgatgaactctctctcgtgcatccggttggattcagcatatatgcatgcagtgatctaattaatcctttcagcttgattaatctgtcatgaacaattcatggcagggtttctcctttctttcatgggttggcatatggtttaattacttgcaaattgattgatattcttggttagaaactagacatatcgaggcttgtgtttgatttgtttatatgccacgagcgtttgaacattttcctcatctgctcacccctcaccgcatgcggcgggtgcaggatttgggagatttgttttgataggatcgatgattgtttgttattttgtccggccaatcgccatggttttcattagctgccattttgtactcctgccatagtctttggtactactatttttataatctccctacctcgtgtctcagacaaaatatcctccttggtattataacctctacggtatctctcaaggacgtaagagtagagtacttcgtcatgcctgataaccttttttcacgaatacgcaaaaggtttgtgtttctttgttccaagaaggtagagaccaccatgtgcaatactagttgttaactggtcgcttgatcgcatcgttttctgtgaagtcagagtcaacatatcacagtgtatctgctcaaagtctctcacatggatagtaacatgtgctacagtatttctgtacttgcgccactttcctgtagaaatggttcttcagtgattgtgtatacatgtactgtactgactaatcagtcagagcatacggttcaagtggtcaacgctgacaagaagcaggacaaaatcaaaaacactatagtacaaggttttccctacctccttttcttttttaagggcctattcggattggagaaatttcacgggatttttgaaggaactgaactgttgttacctgtgaaaatcttgtaaaatcgaaggagccctaagatttctcctacatcttctgaatttctgatagataacaatacaagtacatggtgtgccaatcactgaagactgaagatgatatgtatgggcagtgtgtagctagcacagtaggaaaatgtcaaaaagttcagtatgttcaggaccactgaatttatcctactaggaacaggcgtgcatgattttctgaatttctgatagatacaccagcggtggctatgaactgaagaagctggatagaaacttcactgttgcaatatgcagtgctaatttaatacagtactacttctaatcctcccaaactttggagtgatcttttcatagattaggaaaaggtgtagttaaccaacttgaacatggactgccgttttgtctgaagtgttggttcgattcagacccagctgaaaaacaatttaaggcaggagtgagttagtttggattcctacggttaattactagcagttgatccaataacagtttgcgtcatcagagatgcaatttagactgaatctgacagggaaaaagcctaagaaattgtttggtgatggctgccctgtcctgtctgcttggagcgacaaataggagttggaaattgacctttgtgttaatcaacggtttagggtagggacccagctgatccctactatatgattgcttggaaagaggcgttttgttccagcccggttggaatctgtatctcatcgcattatttgttcatgacaagaaagaatgattatgttagtggctgtcaccttccaatgatcacaacacttattagctcgttgtaaatgtgctatcttctctgtcatagaggattcttgttttactttgacaaataacaaaagaagtacatgttcattgaaactggtttgcatgaacaacttgtccaaactgcaaaatgttttttttctaaataaaagagaagagttaaaacataggatgctctgttgcatggttgtgtggtggttatggtttggttagaaatgcagagaccatgagtcctgtggctcatgagagagaatggtacctcggtaaaaaatggttggttgatctccatgcatatattttcccaaccatacataaatctggtccttaattagttaactaaggttgtgtttttccccttttccccccaacagcccaacttaccttcctcttttttcccacgcacgtttttcaaacggctaaacgatatattttttaaaaaagttttctataggaaagttgctttaaaaaaatcatattaacctatttttctaaaacaataactaatacttaattaattatacaccaataagtcattctgttctacgtgcacgagggattagtcccaacggccactgccaaacacagcctaagaattcatgtgttccaaacagaatgtactgttactactgtataccatgttttaaagtgaattattgttgtgctgataatgaaaaaaaatgcagtgtacgaggtgttcgagagaatggcgtactacgggatatcgtcgaacctggtgctgtacctgacgacgaagctgcaccaggggactgtgtcgtcggcgaacaacgtcaccaactgggttggcaccatctggatgaccccgatcctcggcgcctacatcgccgacgcgcaccttggccgctaccgcaccttcatgatcgcctccctcatctacctcatcgtaagtccctcacctactccatctccctccatctacagcagagcacgagaatcttggaacagatcaaatgaactataccctctgtgctaaaatataaacatttttagcatcgtggcaagtcatacatttctaactttgatgattattaatagcaaaaaattgatgattaatagcaaaaaaaatataaaaaatcaatcatgtaaaattgatcttaccattaaacaaactattataatatatgtaactatttttatttaaaacatcttacttttatatatattgttggtcaaatagcatctcggatactgtgacaggatctaaaattacttatattttttaggacgcggggagtagaaatcaaaagctagaaaataaattagaaaccagaacttaaaaaatctattggacttttagattttcaaaagttagttacccaccagctgcttggattgctctcgtgttgaaaaatgcagtccctgtctgaagactgtacgaccatctagctgctctagcccacaaaaatcaagatgggctttagctcgaagcccacaaagtccagtgaaaaaacaaattgcaagcccaaatccagcacgactaattcaaaccaaatctgtagatttttgttaccaaatttgatcgatagattccgaatttttgaacgtcgctcgtctcgtctcgtctcgtgcaggggatgagcctgctgacgctggcggtgtcggtgccgtcgctgaagccgcccaagtgcggcgccggcacggcggacccgggctgctcggagaaggcgtcgagcctccagctgggcgtcttcttcctcgcgctctacatcctcgccgtcggcaccggcggcaccaagcccaacatctccaccatcggcgccgaccagttcgacgaccaccacccgcgggagcgccgccataagctctccttcttcaactggtggatgttcagcatcttcttcggcaccctcttcgccaacaccgtcctcgtctacctccaggacaacgtcggctggaccgtcggctacgcgctccccaccctcggcctcgccgtctccatcgccatcttcaccgccggcacgccgttctaccgccacaagcccacctccggcagcagcttcgccaggatggccagggtcatcgtcgccgccatccgcaagctcgccgtcgcgctgcccgacgacgcgagggagctccacgagcttgatgatgagtactacgccaagaagaagaccacgccgctgccgtacacgccgtacctgaagatcctgagcaaggcggcggtgaagacgagcacgacgtcgaggtggtcgctgagcacggtgacgcaggtggaggagacgaagcagatactcaagatgctgcccgtgctggcggtcacgttcgtgccggcggcgatgatggcgcaggtgaacacgctgttcgtgaagcagggcacgacgctggaccgccgcgtcggcggcgggggcttcgagatcccgccggctagcctgcaggcgttcgtgaccatctcgatgttggtgtccgtcgtgctgtacgaccgcgtgttcatgccgctcatggcgcgggcgaccgggaacccgcggggcatcacgctgctgcagcggatgggcgtggggctcgtcatccacatcgccatcatggggatcgcctccgtgacggagcggcacaggctcgccgtggcgcgggagcacggcatcgcggacagcaagggcaccaccatcccgctcaccatcttcgtgctcctcccgcagttcgtgctcatgggcgtcgccgacgcgttcctggaggtggccaagatcgagttcttctacgaccaggcgcccgaggggatgaagagcctgggcacgtcgtacgccatgaccagcctcggcgtcggcaacttcctcagcagcctgctgctgtcgacggtggcgcacgtcacgcgccgccatggcggcggcggcgggtggatccagaacaacctcaacgcgtcgcggctcgaccactactacgccttcttcgccgtcctcaactgcgtcaacctcgtcttcttcttcctcgtctgccgcctctacgtctacaacgccgaggtgtcccgcgtcgtcgacgtcggcggcagaggcggcggcgaaggcggcgaggtgctcaggcccaaggaggtggccatggtggacacaaatctatagaaaatgtatcgatcgatgatcaaatataccatgaaattaatatcaccttcagaaatgctaacaacagcggcttcagcttattttcagaacagtgaacatatggatgcactctgaccagaaaaaaaaacgaaatttttgtgcaatttcaaggcgaattgtgcagatgtcgaacagagcatttgttcatggctccttattgcaacagaattgtcgaacacacaaggtttttcatggacatatatacaacagagaacgtctagaatataaccttcatcgttaattcattctaaactagcaaattacccatacaaaattccatgctttatatatatatatatatgaggcaaagctattgccctctttaaaaaaaacatacaaaatggaaccgctttgtcgtgttcttagcaggcaacagtttttctttctaacatgtgggaagcacgggacgaagaggaggaggacgactcttcttttattgtactcgctctgtttcatcatattataagtcgttaacgttgattttttttcctagtcaaatttaaagattaactaagattatagaaaaatataatagtattttcaacacaaaacaaatatactattaaaatatattcaatattagatttaataaaactaatataatattttagatgtagcaaaattttctataaacttggtcaaatttaataaagtttgaccaggaaaaaaatctaacgaattataatatgaaacgggatgagcagtagtagtagagataagagagaccaaacgtaagaaaggaacgagctttctcagaattttggttgtgactttgccagagttcaatcaatcgtaacgttaacagacaggacggcattattagatttcttgggtggttcaaagtaggtaaagattcatgcaaactcttgatctgcaaatcctctatttttatttcaggggatgatgaatggtgctaatacaaatcatacgcaactatatctattataaaaacatgactaaatctcctataccacataatacatggatttgttaacagattcgaaattgctaaacgccctgttgtcctcatttcagagtctcaacaatcgtattttcttgatttattaaatccaaaaattaaaatatactccctttataaaaaaaactaatctcaatgtccagattcaaatatagaattgagttttttttctttttcacagagggagtaacaaataaaaaaaatactgatatgtacatgttctctgtagtctcgattataacctaacaatgtcagtattgtaattatttagaacataatataatacacagattgatgtagtagtttgatttgaaaagaaccccaggatttggtttagagtttagacaggattttgatagagttcctagaattttttttatttttaattttttttattaaaagttttacaaaaataattttccattttgaaaattgacggaagtggtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaacgaaagagagagagaggggagggcagcagaaggggagtggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgatttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttcaacggtcgtggcccctcgttatatttgtgtcggtacaagagaaagatataaatgtttcaatgcaaccgaagatgtagagggtcctatcaatgcaggggatgttgttggaccatcgatgcaaaatgaagaaaatcaaccaagggaggagca

SEQ ID NO: 26703 - DNA, 21313 bp, Oryza sativa
gaccgagcacaagtgctacttacaaggggtggagaagtatcaccgaaacatcgcttcgacttttgtggcaagtgagatgtacaacagtgttgttggtaacattggctttgaaccaaaatcaattattaggcacatcgagaacaaattcaagtacaccataagctatgcaaaggcctagagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgatgcaaagagcctttttctcattgggtgcttgcataaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagttgtgcgtatgaggcccaacgtttgccttatacatgatcgtcatgcgggtatgttgcggactattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacgcaagcgtactttagggatcgatacaagaaaattggtctgtccatggccgataacaacatagtgtttggcaacgtagtgacaaagtacatggaagataaaatcaaaaaggcaaggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaaacaatctttcatacatggagtgaggagatatatgggttcgggatctcaggatcttacacaacgctgagtgcccaagttttttacattacagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgaacatttattacttatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccatccacgcacgtcgcgcgagtggttgcgtgtcgacctccgtcacgttccttggtacgcgtatgttcacatttcaactcaactttgctttgtgttgtactcatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgctggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcggttgggtgatgttcactagcacccacgggcacgttgtggacttccggctggtccactacgcacggtccatcgcggatgctcagccacaggacgtgccgcagtggagctggggttctgccgtgctagcagccacataccgtgccctctgtgaggcgtgcacgaagactgacgcgggagtgatcatcgctggctgccctatgttgcttcagctttgggcagccgagaagtttgccataggtcgaccagtggtggacagcgcaccctacggggttggtcgcagcgcgcagtggccagaggactgtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcagttgtttccgggcaacgtgcagccgaccgtcctccctgccgaccactcgtgagttcggattgttcatttctaaatttttatgataattactacatcgagccatataatttacctctcttcacaggttgactcgacggggacagctagcaggcgcactttgggctccacgtgtacagcagtacgttgatgactgggtgttagctacagaggaggtgatcaacgagctcttcccacacacggaggagaactaccatgactaccttcgctggtaccttcctcgcactcgtgcgcgtgtgaccttcactccagacgccccagagccgcacgttgccgttgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttatgtacgaaaacatcagcccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcaagctccgcaggggcgttcgccacctcttcgggcgcgttcgccagctcttcctctcacggagcgtcgatccctcgcccacacggtactttactttttattaatactattaaatacctgtatgaaactgatggtccttgtccagcagaatttgcagccgggatcttcggtactggggcctcttcgtctcacgccggtaagactggtcctactagccagttctacgacgacgacttgcacggtgcacaccaccacgacgtactaggctcctctcagcttggaggagctccagaggcgcacactcaggagcagccagaggtcacacctgtacaggcaagacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtcttgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatcttattgagttcacatatattgcagtgaaaacgacgctatataattgacaatctgaaggcaacctcttcatatcttctttcccactagcacacaacacacaaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccataatggatgtacataggaggatgtaaggaaatgtcaattcgtacaatggattgacacagtcagagttacttcaagtggcgggctgataacgcaacctgaaccgaccatacagttcattcatgtttggatggagtacgaacgttgggtggaaattgcaagcttagactggaggaccaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacatagtcagaaacacaagtagagtatcaacgattgaaggaccacgagaatgcaatgcattctgaccgacctagaaggtgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaatataaagcacagtataaattcgccctcccccagggcggcaagggggccgcctgcaaaattccaggccccccgccgcccatttgcaggcggccccccgcacagtacaaaatcgccctagcggagggcggcaagggggccgcctacaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattattttttgtaaaacttttaataaaaaaaattaaaaataaaaaaaattcgagttcctacaagctcgcaccaaattcggcccatagaaagaacaaaaaaaaaaaaccccaaaaaagaagcccacagagaagaacaaaaataacccgtctcccccacgtccccaccccccacacgacgcgccctaaaatatccccaaaccctccaaatctccgccccccacctcccctccccgacgccgaaatcccccaaattccacccccgcctcctcctcctcctcgcgtcgcgagagaatccgaggcgcgcgagcgagaggaaggagagaaggtgagagcagcggcggagggaggagatggagtcggatcaggggaagctgttcatcgccgggatctcgtgggagaccaccgaggagaagctccgcgaccatttccccgcgtacggcgacgtctctcaggccgccgtcatgcgggacaagctcaccggccgcccccgcggcttcggcttcgtcgtcttctccgacccttcctccgtcgacgccgccctcgtcgacccccacaccctagacggccgcacggtatcccctctcaaaccctagcgaatattcgcgttggattccctcctctcaaggttcggttcggttcggtttcgtaggttgatgtgaagcgggcgctctcgcgggaggagcagcaggccgcgaaggcggcgaaccctagcgcgggggggaggcacgcctccggtgggggcggtggtgggggaggcgccggtggtggtggtggtggcggcggtggtgacgccggcggtgcgcggacgaagaagatcttcgtcggcgggctgccctccaacctgacggaggacgagttccggcagtacttccagacctacggggtcgtcaccgacgtcgtcgtcatgtacgaccagaacacgcagcggccgagggggttcgggttcatcaccttcgacgcggaggacgccgttgaccgcgtgctgcacaagaccttccatgacctgagcgggaagatggtggaggtgaagcgcgccctgcccagggaggccaaccctggctccggcagtggtggccgttccatgggaggcggcggtgggggttaccagagtaacaatgggccgaactccaattctgggggctatgatagcagaggtgacgctagcaggtatggtcaggcgcagcagggtagtggtggttatcccggttatggtgctggaggatatggtgctggtacggttggttatgcatatgggcatgctaaccctggaactgcgtatgggaattatggggctggaggatttggaggtgttcctgctgggtatggtgggcattatggcaatccaaatgcgcctggttcaggttaccagggtggtcctccaggagcaaacagaggaccatggggtggtcaagctccgtctggttatggcactgggagttatggtggcaatgcaggctatgctgcttggaacaactcttctgctggaggtaatgcacccactagtcaggccgctggtgcaggcacaggctatgggagccagggctatggatatggtggatatggaggagatgcatcgtatggtaatcatggtggatatgggggttatggaggaaggggagatggtgctggcaatccagctgctggcggtggatctgggtatggtgctggctatggaagcgggaatggcggttctggttatccaaatgcttgggctgatccttcacaaggtggagggtttggggcttcagtcaatggagtgtctgaaggccaatcaaattatggcagtggttatggtggtgtgcaacctagggttgctcagtaaatgaggccattagagcatctatgagatgaaccagcaaaattgggcagtctatgtatgttgtgttaccctggcccctctgattgcttttggcctcttgaagatctcccatttgctggttaaatcagtatttctccgggttggaatgcttgaaccttttgcggcttactactagaatgtagtcaataactagcttctagctatactatggagtagctgtatcttgcgtaatgctttatttaagtttagccttatctgtcggtgtgctttgtcatgagtggaatttcagttgcttcgtctctagtttaaagctagagtagcttcactacttatggacaacaaactatctagttgtacctttattctacagaatcatatgtttgtggttgacagtagtatttatgctggattgtgctttacctgaatctgaaatgttctatctttggttgtttctctgtggtgtgctctagctcaccttgcagttaaggtgctgttgcgtattattccattaatattgattgtaacagatgacaatcctcaaacttctatgcagtgatagaggtgttttatactgtagctgcttctagcagtaagttcaggtgtagtgcaagtgcttttcatgtcattggaatgatatatcattaaagtatgtggtcgagctatgagtatgtttctgatatttggtatgtagatggataaacaagcatagtagaggcaaacaattagcccctacctgaagcaataagagcatattagcagcaagttggtagcgccaatttctaaggtagtatagatacagagaagtctgtgatactacttgatgaatgaaatacaggtagaaaccatagagtagaatactccaggcatttggcaagcaaaataatcatccttcctcgtacatttcctttctgtacaggttggatgcgatgccatttccttttagagcatgtccaagtggggccttttgaatcaactgcctggctgcctgagaaatggcagagacatcgactgattttgcttgatgggctgacgatttccaatcttgaagcatttgacacagaaagcaagcatcttgtttttaagcgcttcattttctgaaggatcttgtgctgtgcaacaagatggtggtatgtggaatcatgtttcactttcagttttatttggaaaagaaaagcattttcaccatggtacttgtaccaggaaagttgttcaagatgctatctgtcctcattttccgttcaatttagtaaatggtatattatagttgaaagaaagcattaccagctaccataggaagtattatgttttcattcaaaatcttgtcaattttggccagagttccatccccaatgtacagatcgacaatggtgaattactatcagtttagtaaataataataaattagaaggtttttcaaaagaataattccatgatctaatgtatgtttttacctttttagatacgcatatttgctagtaaaactagtgatgaaagttgtgtcatggagatctaggaaaagaacaacacttgtatacctagaggtgatgcattttttgaaaatctgttttactggcttaacaaatttagtcactaataaaactagtgatgaaagttgtgtcatggattagtgcacaagttttgcaaacagaatttggcttaaacaaacagtttggatgagtaattccttaactttttccccttatttactaaattgatgagcatgatttaagttgtacttacagtcttgcacactggcatgatgttttacaagtttttggaagtactggaaacctaggatccaatatcctagtttgagaaaacaacactcatattgcttgttcctgttaataagcctgggtagcatgttcatcgctcagctatgccttgctcggttgctattgttggatggatagaagtggaaaaaaggggggggagggaatcagtctatgattatatacttgtatggttcaatgtagattaaaatccaaggctttgacttaaggttcctacacttatgtacttcattgcaaatttaactgtgcatatagtacattactagccaaggtagtcaatactcaatagtattatatatttcttcatattgaataaggctcgcttcatagcttaacatatatgtaccacaattttattgtccactacattatatagtacataatcacaattgcttaccacttgctgtttcttgactattaaactatttagattaaaatgaccaatattttctaccttcttttgcaaatcagtttcattacagcacttctgttaaactaaaggtatactatagggtagatttaaggttatgtagttctgttttggcgttttgtttgaaccagttggattagtattatgaatccacatccttagtttattttattgcagaacacaaatagttgcatggcttatgcctgttggagttaataggtgttaaggtaaaacatgtaagtaaaaaaggttctccaggacttgcaatgatgcacctgtacactggatcaatctgatggaccagtatctgactttagaaatgacaataaccacactgatttaggagactcaagagtcaagatatttactgggtggagagagaaaacattagtgttagatttaacggctaagctttgtgtttgcatttaaccatttgtaaatgtgaaagcaatactatttttgacagaaaaatacaattttgattagtgtatctcgcacggttaacttgattaagatctaaaatactgcaacttcatttgtactaaccattagatgatttagttgctcagtgcctgtttgggacttcatgtgatataataacataatataaccagatcggcttatatattaaccttggagctcaatcactaagtcttcttctgtattatgacatggatatttggaaatgaccaagtgcaattcgatttacatgttctatttatgctatttcttggtgttgctttaaaacaaccatttaagtaatagctatgagaaataaattagtgccacttatttttcatgattttcaatatattttttgctttgttgctgtcaaatctcttagtaaacctgataaagatataaaattagaaatttgactgcagatgccatatatagtggatagctttattaccacactggtgccaagcaaaccaagtcatagtcagccaaacatctttgatatgtttttactcgagtatctgaaataaccaaacattttggagatatgttatcatcattctattgacctctttgcataccttgtttgcatggtatcaatgcaatggaatatgccttcgaggactttgctgaaagatcacctgcaagtacatcaaaaatcaagagatgattctggccgccatgtattatgaccacagtgactcgtgctcatccaatattcttcgtttctcgtatcttaatggaaaccctcacagtagcgttgccaccttatatcgaaggacaagttgtttgaagttggctaccaattggtgccctactttaccaattgtcagatggaagggttgagcgtacattaatctggagatgcttatcgagtttgttgcatgacaagtcaatatattctattgatgtggccaatatttgcacgatatgatttcttggcaagttttagtaacattttaactcattcttccagacaatagtgcaaatcgccgaactctctattttacttgttttgttgtcatggatgaaaggtttgcaagactttgttccagaggtgacgtttcctgtgagccttttacatagcattttctttttttacagaaccgtaattgacaaatttgcctaggttaccattgttcatgtacagcgattgaataggaagctcaccgttgtgttaattgaacaatccagtatctccagtttatcatgttaaatcatgtaatctctgcaattacatctatgcttagtaatacatatttcttcatacatacgctggcaatgttgaaactttataaactaacccagttagtgcaatatttgactgatggcattgaccataagctataaagtctgcccatctgtgaatgtatccacatttgcccttcatctacttcatgtttttctctggttattaaccatgttttgattacatatgaggatcaagccatcgttaactcataaataaattacaaattaatcggttagttagtacagtacttcatttgttttagattataattgtttcagattataagtcgttttgactttggtcaaagttaaactattttaagtttaactaagtttgtaaacaaacatagtactcattaaattatttatatttttataatatatttgttttgggttgaaaattttactttttttttttacaaacttgatcaaacttggatcagttttactttgatcaaagataaaacgaccaagggagcataagctagcctgataaaacacgagctggaattcaatggttgagctgcaagcccggcaccgaaatagttgagctccatttgggctcccctttttgggccgcttctgtcgtggtcgccgcgcgtctcctgcctcctcgacgtcgcccgctgcgcgcgcgctcgctccgtcgtcgccacggccgcccggaacggcggcgagatggggcgccaccagcgttcgggctccctctcggtgacctcctccgcgacgccctcgtccgacgccaccgagctcgacttcgccgccgccgccgacgtcggctgcccgttcggacgcgtcgacgcgctcggccccgtcgagctccgcgagaccgcctacgagatcttcttcatgtcctgccgctcctcctccggcgggaacaccgccggcgcagcagaggtgtcgtcgccggtggccgggccgaggggcggcggcggcagccgcgtcaagaaggcgctggggctcaaggcgaggcggctgtcgtcgtcgtcggcggcgatggtggcgcagccgatgatggtgcgcacgctgagccagacgtcggggccggcgtccccggggcgtgggcggcggccgatgacgtcggcggagatcatgcggcagcagatgcgcgtgaccgagcagagcgacgcgcggctgcggcggacgctgatgcgcgccgtcgtcgggcaggtcggcaggaggcccgacaccatcgtcctccccctcgagctcctccggcaactgaagccggcggagttcgccgacggcgaggagtaccaccagtggcagttccgccaggtgaagctcctcgaggccggcctcatcctccacccttccctccccctcgaccgcctcaactccgccgtgctccgcttccgcgaggtgatgcgtgccaccgagatccgcgccatcgacaccgccaagagctccgacgccatgcgcaccctcaccagcgccgtccacgccctcgcctggcgctccggcgtcggcagcggcggcggcgacgcctgccattgggccgacggctacccgctcaacgtcctcctctacgcctcgctcctccacgccatcttcgaccaccgcgactgcaccgtcgtgctcgacgaggtcgacgagctcctcgacctcatcaggaagacgtggccgacgctgggcgtcaccaggcccgtgcacaacgtgtgcctcgcgtgggcgttcttccagcagtacgtcgtcaccggccaggtcgagccggagctcgccgccgccgcgctcgccgtgctcgccgacgtcgcagccgacgccagggggacccgcgacgcggtgtacggcaaggcgctcctcggcgcgctcggcgccatgcaggagtggtccgagaagcggctgctggactaccacgacagctacgagaagggcatcggcggcgcccccaccgaggtcatggagatcctcctctccatctcgctcgccgccggcaagatcatcgccgaccgtgatgccgccgccgacgccgacgacgccgccaatttcgccggtgaccgcgtcgactactacatcaggtgttcgatgaagaacgccttcaccaaggtgaagttcttgggttcagaatcacaatttgtgttgcatcaattcatgttcgttttgattccagattctcgagagcggaatgggcgacggcgacggcgagccgggggtggtgctgacgcagctggcgagggacacggaggagctcgccgtcgtggagcggcggagcttcagcccggtgctgaggcggtggcacccggcgccggtggccgtcgcggcggtcaccctgcacggctgctacggcgtcgtgctgaggcagtacctcggcaaggtgaccatcctcacggaggagctcgtccgcgtgctccagtcggcgagcaggatggagaaggccatggcgcagatgacggcggaggacgccgccgactgccgcgacgaccgggccaaggccatcgtcggcgacatggagccctacgaggtggattccgtcgttatgggcttgctcaaggtgtggatggacgacaggttcaagatcaccatggactgcctcgccagagccaaagaaaccgaggtaatttcgtcgaacaccttgatgacgtccaacttgaaaaatcatttttcatacttaccattgatttgcaacaaaacgtgttagagctggataccaaaatccaaagatgaaccttttgccgggtcagcgatggagatgatgaagctggctaagtataccgtcgaagagttctccgagatcccggcgagcgcgaaagacgaggtggtgcaagacctcgtcgacggcctcgaggcgatcttccaagagtacatctccttcgtcgcctcgtgcggtgagacacatccactcacgtgacaagaagtcaacgataacagagtatcatatttgtagtgttcagatcaaacttacacgtctctgaatcataggggccaagcagaattacctcccaccgttgccaccattgacgaggtgcaaccaggactcgggcttcttcaagctgtggaggaagacggtgctgccgtcgtgccaagcgccggagggcggcccacgcggcgtcggcgttggcggcggctcgcaccacgtcccgcggccgtcgatcagccgcggcacgcagcgcctctacgtccgcctcaacacgctcgagtacgtcctcacgcacctccacgccatcgacaagtcgctcgtcgccgcgccgtcgccacgcttcgacggcgcgcgcgccgcggcgaagtcggcgatcgcccgcgtcgccgaggtggcggcgttccgcctcgtgttcctcgactcgcgccactccttctaccacggcctctacctccgcggcgtcgccgacacgcggatcaggccggcgctgcgcgcgctgaagcagaacctgacgttcctggtgtcggtgctcgccgacagggcgcagccagtggcggtgcgggaggtgatgagggcgtcgttcgaggcgttcctgatggtgctcctcgccggcggcggcgaccggagcttcgcgaggggggaccacgccatggtggaggaggacttccggagcctgaggcgcgcgttctgcacgtgcggcgaggggctcgtgccggaggaggtggtggcgcgcgaggccgaggcggcggagcgcgtcgtggagctcatggcgcggccgacggacgccctcatcgacgcgttcggcgtcgccacgtccgagtccatcgtcgccgccgtggggcgcggcggcgacgacggcgacggcggctacggcggcgtgacgccggtgccgccgacgtcgaggcggtgggacgccgccgacgcgaacacgatcctccgcgtgctctgccaccgcgacgacgaggccgccagccagtttctgaagcgcacgttccagctcgccaagcgacgatgatcatgcaaaaaaagcttcgcgtcgtcccgtctccaagctcagcaatggcgcagccgcgcagtgtatccatcggagttgaagaagacggtagctacacgccatacagctctagatttttgcgatctttgcagtcggaattaaacctcataatctctcgaacgaactgtaaacccaacacaaatacgaatatgtaaaattttctggcacggatctgaaagtttcaatattggtgtcattcctatgtagttacattcgaaagttttctagcgaaaaagcttacgataattttgttcagtcctccctccgtttctaaatatttgacgctattgacttttttaaatatgtttgaccgttcattttatttaaaaaatttaagtaattaataatttttttcctataatttgattcattgttaaatatacttatatgtatacatatagttttacatatttcacataagtttttgaataaggcgaacggtcaaacatgtgcttaaaaagtcaacgatgtcaaatatttagaaacggagagagtaatttcctacaacgcccactcgctccccatccacagtccccaccctcccactccacctcgctatgctctccgctgtatccgccctcgacgccgtcttcgctccacgcgccaccaccttcgcctaccacggctgccgtccgctacctccgctccatctccaatgcgtcctggttcttccacgtcgcgatcccacgccagccctttggcccttgccacgtccgccgcctcctcaccgccatctctcgtaaggttgtcgatggccgtccggaggcgaggaggcctttgaggggggacatggaggtcggcggcgagcgcgcatggagagggaggaggcaggctcgcccgctccgccccgccccacccagcagcgtgtagtgaggagaaatttttttaattattttctagcgtaactgaaatgtgggcctcatgttttttatcaaattgccaagtcaatgcctcatgggatgaataactattcaaaggagccacgtagatgccacatcagccaaaaactgtaactggcacgtgggccctcatgttttttattgaattggcacgttagcgccacgtcaacaccgcatatgacaaaaacctaatcaaaggagccatatatgcgtcacattagccaaaattggtgataataccacgaaaggatctcgtttgtactggttttataagtttgggatgtattgtatttggttttacagttaaatgacgattttgtaattcggtgttaaaagatgcgatagagagatctccggtgtactttctccattatcataagacgagatcttttgggacgctcatggcccagagttcttagcccgtgatgatgaagcctctgcctccggatgcttcgatcggcttctcggcccgccgcccctggtctcgtcgtcgtgccgctcgagacggactgcatgctccgccggccctagaattccctcctcctgaggtcgtcgccgcgccggcacggcgagccggcgagcgcggccacgggttcctaccggcgccgccgccgtccaccgtgagtttcttcactactgaaacaattccgtactagagtgtaaacaatgccgataaatttaggtatagatgtgtttgcaaattctgcattcgtcaaggcagctacaggattactgctactgaaaaaaactctgcattttggtattttattgcatgctatcttctttatggaattatggatatgtcacgtatatgagactgcataacaattactggtgggtttctttgttggcacagaatgctgccattcattaccagtgttttgataataggagatgagatgagatagttcagtaaatttttttagataatgggaatttataaaacctggcttctacaccaactggggtgtatacagccacagaatatccaagcaaacaagcttagttcatacacacaagttcacaaacaaaagaagcacaaaggctcaagcaccttacataaaactaaaagagcacaaagactccctacgcctttcaaagtgaaaagaccttccaaacaaactaaaaaccacattcctcctttaaccgctttctcatgttccatccatctttaccaaagaagtgcatgacagatgtctctaacagtttgcatccttccttcatcacatcgcgctcatcttctttaagcagcaaggaccattgtcgagcccaatacgtccccctgaaaataacctgcaagtaagagttaaaattggagccattgaagaccacatcatttctagaaatccacattgcccacaacaacgtcgcaatccctgtaaagatttggtactttagcctagactgtaaaccctttagccaaatcccaaacatattagcaacattgttaggcggatttatcccaaatgttataaaaagggtactccaaacaaatctagccacatgacaatcaaagaagagatgttgtatcgtttcattgtggttacaaaaacaacacttagtgctgcccttccaatttctttttgctagattgtccttcgtgagaatcactcccttctttaaataccagaggaagattttgtttttcaaaggaattctaagcttccaaattaaatccttcattggtactatattctcatacataatcattttatacatggaactaaccgaaaatatttcggttttgttaactttccaaataagcttgtctctatggtttgagagcctaacaagaaccactttagccactaggttaaaccatgcaaccaaattctcccccaccaaagcaactcaacatttaacggcactttatctataacatccgcaacaatagcattcttattccttacaagattgtataaattagggtacaacttttcgaaaggaaaatcaccaatccagcaatcctcccaaaatcttatttgagaaccatcccccaccttaaaggcaccgcctttaaaaaagacatccctcaccaccattagcccagcccagaaatgtgaatctccagggcatttctcgacttgtgtgatggtttttttttgtcaagtatttattcctaagaatgtcctgccaaaccccttcttcattgatgagtttgtacaaccatttgctaagcaagcatttgttttatatctctaagttctgtatacccaagccaccacattcctttggtttgcacaatacactccatcttactaacctatacttattatgttcatcacattgccagaaaaatctagatctataatagtctagctttttgagaatacccttagggatctcattaaggacagtaaatagctaagctgaaccatagcagatcaaactactctgatgctacatctgttcttggagattgaacatctgtttcttgtaccattacatggttccatggaacatatggcacatccctgaataacttattctgcattgacaggcaaccagagcatcaaacacgagcaacagggcagaaccaatgacgaattgcagtcgagcaccatgtctccgcattcgtgctcactccatccctccagcgcgtgaacgattccagcgatacgccatgcgctcatgaccctccttggtagccaattctgccaaataagctcaaaattctgtacttaagaccattctgtaaagctctttcagagtacgttgcagctcaacagtttattaattacctcacatgaatgcatgttgtgcagagttttaggaacaaccattgcaggagtcgtccagtaggtgcagcagttgttgcgtatcattctcggtggaaactgtgagtatgggatgaagtgtgctcctttctgtgtcctgaattgttccgtagcatcttagattttccccaattaaccaaacctgaagaaattttgagagcaacctgttatgccactggttgatcattaggcataagttctcttaatccgcatatggcactccctgttaatttatcaagagaaagtaagaattctgttgtccctgttttggaaaatgaaagattgttggccacattttctggcattttcgacttagtaaatgatagccctgcttgtttgtcattatgacctgcacacgaagggcggtttgtatcattttgacgtactgaaatttcaatcacatgcagaaaatggcaacaagtagtttttagctaagaaatttccatgtgccgaaaatgtttctgaatttcttgagtatagatgaatactgtgaattatactactatgtaaatactgttcgtagttacttttttttttactgcatgttaagaccaaacagcaagttcatatacactattgtaagtccttggtacttatggagttattgtacagt

SEQ ID NO: 26704 - DNA, 767 bp, Oryza sativa
aattcctgcagcccactggatctagttctagtgtgtaatcatcagtaggataatcacaccaaaaaatatttacgaactaagaaatcactcttataaacttgaataaatatgtttacaaatagaattgaataaacgtgttctccttattttggctatatttcctctgcttttgtttggtctgttctttttaatttaaactacactctttctttgagtgctactttgtaataattggttgtagctcgttctgagtagagaccggaatgttatattccattatctaaaaaaaaataaatcacttatatttatatatagttagctattggcaccatcatatattcatatttgaaagagggacccgaaaaggcatagccggagacgacggcaatgcaggatcactgcgttggtgttttactccgcatggcccccgtcgtccaccctttcttcctcctccccctcctcgtggcgatcgcttccatcccaggatcagtcaatgccgcagcatcgtcccagcagaccgacgcgctactggcatggaagtcgagcctcgctgacccggtcgcgctgtccggctggacgcgggcttcgccggtctgcacctggcgcggcgtgggctgcgacgccgccggcggcggccgcgtcacgaagctgcgcctccggggactgggactcggcggcggcctccacacgctcgagctcgacttcgccgcgttcccggcgctcaccgagctcgacctcaacgggaacagcttcgccggcgacatccc

SEQ ID NO: 26705 - DNA, 656 bp, Oryza sativa
ttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctg

SEQ ID NO: 26706 - DNA, 1409 bp, Oryza sativa
tacaaagttcgtggtagggaacttctttgagtcatcgtatttttctgttcatacgaaggaaatgaattgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggggtgcaggaat

SEQ ID NO: 26707 - DNA, 4522 bp, Oryza sativa
  unsure (1)..(4522): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactata

SEQ ID NO: 26708 - DNA, 5346 bp, Oryza sativa
  unsure (1)..(5346): unsure at all n locations
ccactataccgtttttcaagaccggagctatcaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnataggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaa

SEQ ID NO: 26709 - DNA, 7683 bp, Oryza sativa
tttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatc

SEQ ID NO: 26710 - DNA, 6058 bp, Oryza sativa
ctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttca

SEQ ID NO: 26711 - DNA, 1832 bp, Oryza sativa
gggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagag

SEQ ID NO: 26712 - DNA, 961 bp, Oryza sativa
attaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatg

SEQ ID NO: 26713 - DNA, 668 bp, Oryza sativa
atgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacct

SEQ ID NO: 26714 - DNA, 6437 bp, Oryza sativa
tagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcagggtgggagaaaagataaactgattattgatcaaatttaggggttgaaacttaggtaattaacttcttctgcgtaccccaagaagaaattggatcgatttttgagaaatcgaattcagttaagacaagggaaattaagatagcaatttctgagccgtatgaggtaggaaactctcaagtacgggtctaggggaaggaactacctattccgaccggggagaacaggccattctacagggtgattcaaaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaaggggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcggataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaaataacaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctatttttttcattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgcc

SEQ ID NO: 26715 - DNA, 766 bp, Oryza sativa
tattccttctttatgatatatgcatcatacatttgtatatgcatttgtttttctttcctaaaagagttttggtctaacagttttttctcttggtccgataaaaaatgaaaagaaagaagaaaatatgaaaaaagcgtccattgtctaatggataggacagaggtcttctaaacctttggtataggttcaaatcctattggacgcaatcttatttctatctattctttaaataactatactaaaaactaagaaaacttttttgcatgattcaaatgaaaaatctttctcaacgatttctcctctactacttctactaacaagagtagacgtgcaaaatttatgtttgttcctgaagggaaaaccgttcgagttgttcctgaatagcttccttcaaaaggatttccgcttcctcggtgaatgtcttgctagaagatataatttcttggaattgaggtttagtatcttttaggtgtttacgtaactcatccagaaatttctttacctgtccaatttctaaggaatcaagatatcctcttgttccgatataaatagtagctatctgctcttccactggaagaggatttgcttgggattgtttaagcaattctcgtaatcgtcggccccttgccaattgattctgacttgttttatcgagagcagaggcgaattgtgcaaaggcttgtaactccgcgaattgagctaattccaattttgatttgccagctacttgtttcatggctttaatttgagccgcggatcctactct

SEQ ID NO: 26716 - DNA, 1490 bp, Oryza sativa
acacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatgga

SEQ ID NO: 26717 - DNA, 1488 bp, Oryza sativa
attcctgcagcccctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattccca

SEQ ID NO: 26718 - DNA, 3778 bp, Oryza sativa
aattcctgcagcccccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgacgtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataact

SEQ ID NO: 26719 - DNA, 5794 bp, Oryza sativa
  unsure (1)..(5794): unsure at all n locations
agttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 26720 - DNA, 262 bp, Oryza sativa
aaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaa

SEQ ID NO: 26721 - DNA, 1116 bp, Oryza sativa
caatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaggaggatccact

SEQ ID NO: 26722 - DNA, 10218 bp, Oryza sativa
  unsure (1)..(10218): unsure at all n locations
cattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttattttctatcttatctcacgcaaaacgaggagaatgcaaggcaagggcgagaaccaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaag

SEQ ID NO: 26723 - DNA, 484 bp, Oryza sativa
agcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttc

SEQ ID NO: 26724 - DNA, 1044 bp, Oryza sativa
taaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagaaccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacacacaaattttcaacggatattagaaaaaaggttcaaaacttcatcagccactgggttgggtcgatttgccttgaagatatgaaataagaaaaatccagaatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttcttcgaataagaaccgcttgatgatcatttattgaatcggtgtaatgactcgacaaaatcgagagaaaaaaagttgttt

SEQ ID NO: 26725 - DNA, 4180 bp, Oryza sativa
ttaaattatttcactgttttagtcggaaccttaggtggctctcggaagaagatagcgaaaaaaattatccctaaagtcgaaactaaaaggaacgtataaaccaatgcttccatagattcgatcgtggtttatttacaattataacttccacacctattcatttgtcatttgggatcatttcccgtataaaaaaggaaaaagagtcaaagaagggatgggagatgtttcccatgtcaaatcaaaaaagagaggtgaaagataccaaagcaatgcggcctcagactggctgtctcctcgtagttggatctccgactttttggaatgttccaaattccacttgagcatccaagtctggatcaataccagcaaaaacatctcggaacaaggttctagccccatgccaaatgtgtccgaaaaagaagagcaaagcaaaggtagcatgaccaaaagtgaaccaaccccttggactgctgcgaaaaacaccatctgatttcaaagtagcccgatctaattcaaaaatttcccctaattgggaacgcctcgcatatttttttacagtagcaggatcagaataacttactccattaagttcgccaccatagaactccaccgttacgcctacttgttcaacactatatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgctgaaagtatccctgatcccactgataacgagtaggcccaaacaattcaattggggtagttgctgacccataccacatagttccggcaactacgaaagctgcaaaaaaaacagcagcgatactactggaaagtacagtttcaatattgcccatacgtaatcctttgtatagacgttgaggtggacggacactaagatggaataggcccgctaatatgcccaatgtacccgcagcaatatgatgagaagctattccccccggaacaaaaggatcaaaaccttctgcaccccacgccggatttacagcttgtacttttccagttagtccataaggatcagacacccatatcccaggaccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaaccgctaattcgtataaagccatcgagccagcccaaccagaaactagagctgtgtgcattatatgcaccgaaagcaatcgacccggatcattcaatacgacagtatgaacacgataccaaggcaaacccatggaaatacccctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgtttagtattcgaatcacccattcttttttctttattcaatctgtcttatcctacttatatgtataatctttcaatctatgtattatttcaatctacgtattaatagaatctatagtattcatatagaataagaaaaaaagtgaaaacaataaactgcggattctttctttctcttccattcttacgtttccatattaaagtgtagttttcttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgaggtcacgaatcatattacaggtctcatggtatatctcagtatagaagatggaattagcgatatttttttgtttataaactcccccggcgggtggttaatctcaggaatggcgatttttgatacgatgcaaacggtgacaccagatatatatacaatatgcctcggaatagccgcgtccatggcgtccttcattctgcttggaggagaacccaccaagcgtatagcattcccccacgcgaggattatgcttcaccaacctgctagtgcttattatcgggcaagaacaccagaatttttactagaagtggaagagttacacaaagttcgcgaaatgatcacaagggtttatgcactaagaacaggcaagcctttttgggttgtatccgaagacatggaaagggatgtttttatgtcagcagacgaagccaaagcttatggacttgtcgatattgtaggggatgaaatgcttgacgagcactgcgatactgatccagtgtggtttccagaaatgtttaaggattggtagtggccagatttcttgtaaatttatttcaaccctaaattcgggttttatgcaatttaatggaaatacttcataatgatcaatcattcaggttaagatcgatctaaaccaatccattttttctatatacatacgacatgccaacggttaaacaacttattagaaacgcaagacagccaatacgaaatgctagaaaatcggccgcgcttaagggatgtcctcagcgtcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaactttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgtttaaaagggaaccatagaaacgatggaacccactattttttagtatcgtgcgaaataactgaagggagtagaagagaaaattgtggttgggaaggttatagtagcaaaagccattggaactaatattttatatatgggaataattcgttttgttattaatgggaaaaaggatggctaaaagaagagaaatcattagttattcataaggttaatttgattcaatgaccagagttccgcgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcggataaacgcagcaacgcggatacataaagtattcgataattatagtaaattaatacacaatctttacaagaaagaattgatttttaatcgtaaaatccttgc

SEQ ID NO: 26726 - DNA, 1520 bp, Oryza sativa
agaggtaactccgggaagatacaataaattaagattaagtggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattgttgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttcttaattctaattgtccgggtgtattgtggcgattcttttgagtactatatctagaaatccctgccgactcctcattggccccttttcgaacacaactcacacattgcaaaataactctgattctaacatctttccccttggccatgaacctcctttcctttttggattgacttaacttaattcttctacttattcttttattcctctattttgaaaccgaagaggaagaagaaaatccattagaataaaaatttttggaaatttttcaattaagtaataaaaaatagagaaataattaaggaatacaatccttgtcaaattagcaaggattttgaagcaaaatcctttcattttagtagccaacccagcctctttctatgctctgatttctgaggcctgacttagcttggatactgcttttaattgaatttcttttttcaaaaatgagatttaccaaatttttcatgactctaaggtccaacccaatctatcttttctttctttttctttcctatactaaaaagggattgaaaagtgggaattttttatcatgtc

SEQ ID NO: 26727 - DNA, 1709 bp, Oryza sativa
aaagaagaaatgacacgaggattctctatagatagaaaaagacaaggaaattaggatgtggaaaacaagataggaattgtgtacaatgacattgtacaacaatttggaaaagggatgtagcgcagcttggtagcgcgtttgttttgggtacaaaatgtcacaggttcaaatcctgtcatccctacctattacttctttcttctttataggcagtagtgaggaggtcgattaaagcgggtataacttgaatttgtggatactatacgtacgtgagacacattaggagtagaaaaggatttgatttttgaaagcgctcttagttcagttcggtagaacgcgggtctccaaaacccgatgtcgtaggttcaaatcctacagagcgtgattccatctatcttatgtcgaagcagggcaaaataacttaacaaaacaaattgcaattccaatttgacctcctccagaccagagaggagggcaatcaaaaaagaaatattactcaatcaaagatccaactgatccccacgtctgtattgcaaatacgcagtcacgaataatcccgctaaagtaataggaattaggcctaagacgattccaaatagaaaaacttcaatcatttcgatttgttcgaggggataaaaaaaagaggtacgatttatccctaaatagtagtctaaattatccacgaatctcaatgaccaagaaaaaaagaattggtaattagtgcgtagaataccaggaatccaaaagagagattttttcttttctgccttattcattcaattcatttcaaataagacgtatcttgttcaagccaataaatagagctagggttagagttaaagcagccaatagaaaaccgaaataactagttatagtaagcatgaaagggttaaattccattttttttactacactacatatgttggtaaagcacttacctaagttatggaaaattcataattcatcggttattttagataatactaaaaaacaagatagagtgagatacagaagtgtaaaagaaaatggattcatcagatggggcatgagtccctaattccgaatcaagagatttgctgtgtaatctgtcaattgagtaaagtaaaaatattaagaactagatcagctaaccccagtgaaaaataaagaattgaatttgaaaaagttctttctattttggtctttttcaataggatgatttaaccttctttttggagcgaacagtcgaatattcccctattccttcttattttaattgattgtattccatatggaataagaggagaagaaaagcattccacgacccctcgagggtctcctaaaaaaaggaaatctttcctgaatttacttttttttaattcctttttcgaaccccaatcaaagtcgattcgaagcacttctttttccattacactatttcggaaacctaagaactggcaaagttccacgcttgcagtttggtcaagaaagttagtaaacaaggcaagggttgattacgaatcttgattcttcaaagaatgttttctctctttcataacagattatctactatttgattttctatttattagatattatattatgctaaccaattaaattctttaaggggaaaggttggattcgaagggatagctttcgcatctacttctctttgtattgtgtcagtataagaatatctttcctaaattctttatcgggctgcaggaatt

SEQ ID NO: 26728 - DNA, 710 bp, Oryza sativa
attcctgcagcccgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggt

SEQ ID NO: 26729 - DNA, 12717 bp, Oryza sativa
attgtggctacaagcaatttagccctggcctaacaagatagacttctgttttcggtgagccatttgcctttgattattttgatcattatttttcattggagatgatagctttcggttagtatatacaattgaatcatgcttgcatgatcgatcggtactaattaataaacacgcacctggggaagcattatatatatttggatgtatgctttggctgtcatggagttggaaagactctagatctgataatttatgtagtctatataaacaagtatataggcggttgagtctagaaataattcataaatatatgtatataccctctacgtaaaaaaaaactaatcctaactacgaatctagacatatgtgtatccaaattcgtagctagaatttattattattatttaagacatagtagtgctcgtatatgtgagcatgcgagatgaatgatagactaaattaattaatggataaaatttggctagctagctgggttcgcagagaatggacggatacagttatcacataggcacatatcattctattactctaatctatcgctaataattaattaaacagcttacattgtggtccaaaagggccaatttgtaatttaatcatgttttacataataaaaagcatctcttgaaagctacttttaatatttatatttgcactgcacgagctgcagtacgtaggggacaaattgacttccttttaaaaatctagtcgatcgatgatctagatctatgggaaaacggcttaattagtaattaatatttcttcaaaaatcgtctcacaaggtacagttaaattaaacatgcatgtggcaaatccatacatctcgtgaagcaataaactcgaaattggggatcacgtaccattagtcaacgtgcatatatcttgccctaactaatcttaattaatttaaaaatcacaggaatatattgaaaagctgaaagatatatatatgatttcttaacttgtttttgaaaatgaacgactcaattattcaaaacctaaaaaaacggttcgaaggacggttcttttcacaatataatatatcaaacgtaaaaataatattatcaaggagaccacaaattaataggatgtgatctggacgaattaatggagcagtatattttagttcgtgtgtaggagcacaatatagtacagctgcttagacaaatatctttcctgccttgaaaatacacatcaaccaacaaagttcttagcctgttatacaatattgtaacttgttcaaaaaaaatattgtaattaacatgcaaatgcacctgcagttttagttggtacctactacaattattttttcacttgacttttagggcattaaattaaggattgtatgtttgcaaaaacacttggaacataataatatagcatcatgagcctatatagtcttaaaaattgacttttggatcgaattaattgatgtgagatgcatatatatataaatctttcaatctcattgttcagcaaatatgctgagacaacttgcacagattaaagagacaccaccatttaatcttttgttagattgtactttgaatgccttgtgccaaaattaactgaaaaattagtctctgtcagaccattgatgcatgcaacacaccacacatggatataaccaagtaccatttcgacaagtggcactagctagcccctcgtgagtcggtacgtgtgattttctttgtttattatataagcgcaatgtcaacttaattgccattcgctgcaactcataagcacatgcttaggaggtaagaccaattcattgagatctgcaaaagaaattgctggatgataaaaaaagagaaacgaacgaacaaacaaacaaatttccttctattgaaaatcatgccatttgtatattattttgatgcttggatgagttgtgactcacacaattaatgtaactataataccctattatatttttcttatttaccacacatgtgctacattgtagataactacgtaccctccatctgaaaataagtacatttttatacactgacctaattcatgtataaaagtaaacttatgttgggatgggagaggtgtagataaagtaagggattgttcgtttgagctaacgatgggttatcgcgagcacgcttttcaagtttctacacggtattatctttgtaagaattttctttgtcatcatttctcgaataacttttttaaatcaaccttttaactttctaatatttaattcatccgtttgcacccttgactaattgtcatatactcagatttattcatgatccatcatccatcggcactttagaaataggctggcagagcataaatgaaaggagaagaaaacaaataaataatgtatctacggagcataaataaaaggagaaaagaagaaacaaatactagctggacaggtatggggagagtgatgatgtttcatactgatctatctatatatgcactgattgagtatggatttgatgttctaggcctagccatatgataataacttgacagctctatgtatatcaattgtgtgttcttgtctcatttgattctgtataaattaaggaatataatgaacagtgcagctagctagaaaacaatttgtaaatatcataatcaaatgatgttaattatatacagtgactgacgacccttcatgtgccgtggcacccacatttttgtcatagcaggaattaattaagatgttcaattagtcaaggataagagaaaagtaatatagcttgtgcaaattaaccagcgtgtgagagctagctgcagcaatactgaaatctctagcctttgtttggttcagtctggtttaattagcttgttttattgtgaagtttgtcagtaccggggagcaggaggtggtggtgttaactgttaagccttctgttagtcttagttaattcattttttttgaatgattgaccctgtccaacaaacatgaccatatatgctagctattgttccaaaaaaaaaaaacatgactagatgcatggcacactagctggaaaagatgcttgatctagaattaaaaaccaaatgcatggatctacattaatttagcatcatactgtgttcatgttgatgcccatcttttgcttgttatcctatatatttccgtaatgtctttttttaaaggattccgtaatgtctttatcaaataaacattataaggcatgtatgtatgatgggcgtatatatacttttttgcgagatgtctctttcatagagtggcattggatattttggcctaaaaggatttgtatataacaagaatgcactattacagaattgagtttcatgtacgagatctcctccaacttctaggtggactgtaatagcgtctgcatgtgataatcggttcctgggatgggttaagggctgcttgcaaaaatgtattttcgcaagtaggtccttagcaggcccggctgcgacaatggcaagcggacctcttaaagagacgcaggcatacaacaaagtggcgaatgcatcctcggtcccacccctaccctagcgcaccacccatccttatactctcctcactcactccgcaccattttctcttctctccaaccagcaggcctcatctctctctctctctccaccgtctcatcgcccagagttgagtgcgcggaagcggagcgcctccgcctccgtaccgttccagccatgtacccgcgcccaggcctcccagaggtgcggctccacctagcgtagtgcacggggagcccgtgtgaggcgagcaacatggagaggtggggaggcttgatccggctgtgggaaagccgcaggatcaagcagtggggaggctgaatctagtgacggggaagtcggatcgagtggtgggaaggtcgtaaatcgtggctaggaggctagaccaacccccataaggcagcgtgcggcggaaaggcttcccctgtcccccttcttcacgccggtggacatgggaggatcggctccagcttgggcaacctcgagagagttggatctggcacctcctctcctctgcctcttcattgtcgccgcgcgcttgggtctgcaccgccggcctcctctcctctgcctcttcgtcgtcaccgcgcgcactggatctacgccgtcggcctcctctcctctgcctcttcgtctccttcgtgcggcctcctcttctccatgcgaagagcttggcggagtggcgtatcctgcatggggaacctcggcggcagtggatccggcgctgggaccacaatgacaggatggatctggcggcgtggatgacctcagcgatggcggatctggcatgggagctacgacaatgtcggtggcagctgtgatgataacgttctcttggggagctagggtttccaccatccccgactctggtatataggggcagatccgtcgccccctgctccgggaggggcgttgattgctgcagcgaactcactgcggccataacgactaggttttggttttggggatttttattttttttgtgatttttcttttttgggtgggtagcattactgaccggccgcaaaaaattgagttttgcatgcgggtgtgccacccgcaagcaaaaatatcaatttttgcaagcatctccgagtagacgtgcaacccaaccgtatgggaaaatgagttttgacaacatggaaagaatttctatagtagggatcagataataaattagcaaatagacgaacaatagaatgagtgttttcaataaaaccttgttccgtttggattgataattaggaacatttaaggagatgtggaagaaaacagtaagcaaagattatttcaaggtggttctccagccagccattacctccttttacaaggaaattcaaaccaaattaaagatctctaggtattcaaacaacctaatatatatattacacacatgtttatccaaacaaattcactgcgattcctcgaacatatatgcaatgttgtatttgaaccacattttctccctatatagaagatatatacgaacacacatattacacctttaattaaaatgtatttttttagaaacaactaaaaataaacttattatatacacttaaatatttatttttatttatcacgaatcttgaggcaatatgacaggcatccggaccatacccccaaggtggtgtccggcgcactacaagatagtttcttttttctttttagaacttacaagagagtgttgatctgcagtctgcatgcacaggtagtgggagattgacgaagaaaaagtgtcatcttccttgtacaatggggccttcatttaatcactcgataattagtggagcattaactaattaaagaacagtgtggtggattgagatgaagtagctcttaattaatttgcagacaggtagcaagctaattaatttccacgatcgatcttatcgtggctccattaaattttgatcggaaagaggagctttttccaagctaagtgcctcaaagagaccgatgcatatggcaatcagttgccagtacatcatgatacatataatcatttgtttttgcaagcaataatatatcaatctatccaaattgtgttctgtccatcttgtacgatcaagtcatatatatgtattgtgcttaattactccctaataataatggacttatatgtactataggaaaatggcatttgtttctagatcaacatatatatagatattaaattatgacggacgtttttttattcaaaaatatgacatgcactatttatcatgtgatttcatataggagtgccaatcaattaacagcgttctttggttggacgattgatgtcatggccgtacgtaacggttagaagaattttagtcagaagtttatattgcaaaaaatatacacacactccataaagtgagaaggtcgatatcgggaagataagaccagggaaaccgaattaataagagaaaaaaatgtttctcgccttaaggttgatgccaaaaaaaaaagtcgctagcttatctgaaagcacgactgattcataataaagaagggtctaggtacatcctaatcctagtaaatcactaatcaacaactacaaaactagacataaccaacaataacatcctataatatgttttaccttttgatgaacaatttttttaacaatttttttaattttttttaacaataacatcatacaatcacttttgtcagttttttcaataaaatgacaaaactaccctcgtgtgttcttccattgcttctgttcagctatcatcaacatacacacacttacgcatgatggttccaccttgcagttgatttatcatttttgctaatccatccagaggatgtccccttgttcttaccgtcattaaaatagttatgaatttttaaaaaataaataacaagatagattaatattttatatatcggtacaaaaatttaaattcaaatttgatcttcacaaattgtaataaaaataacaaatttaattgaaattagtatacatctgctcatagacaaatgtgattttttttagaaaagaaaacttgtaaaagtgaaatttaaacttgcatatttgtggaatgatgcatcacacattattctatcttattaaaatttttattttttataattatttgcataacatggaaagaaataagtggacatcctttcaaggtattaatatgcaatgatatatcacacgttattctatcttattaaaatttttattttttataattatttggataacatggaaagaaataagtggacatcctctcaaggtattaaaatagtaatattatacttttgcatccctattacacaagatgatgatgtggatggcatataggggaagaaaaacatcaagcagtggcatataaaggattagcaacttttcgatggaatataaggaaactcgtgaattttgagtggcaaataagaaattctctattaattaggaacatataaaaagaagactcggttctcgctaaggaaaaaaaatgttatttcaggccaaacagtgcatacatcctgtaaacggagttgcagctagcatctgcacctataagcaaagccaaacaaatcgaagttgtctcaccaaagtgcatgcatgcatgtgatagctaatctaaccaagacacttttgcaaaagactaattagtaaagctactccagcatcatatacacacaagaaaaagaagatgcaaattgaaccaaacaaacaaataaataaatgtgaactcgttggttttctccacaaccctcaaagcaaaattaaaagctaggcagatcgtgacacagacccatatatattcttcccatgctaatctgtaccgtcttctctctctgctcttccttgtctgatcttcaaatggccaacaatgggcagacagacaagtgactagattgattgacaaacattagtacaataattaagggtgtggtatagtgctttacctgatcaccctttaatattgcatgtgtttttccatagatgcagcccaaagaggtcattgtcgattttgtcgccgtgatggctttcagaccaagcaagatttcgcaagttgtgatgtgaaagccggtaggccacaagtgatgatggtctagctcatctatgccggggagccacgctagtgatcagattctaatatctccggaaagttttatacgacataaggaggatcggaggtaactagttatagttctgcaggaaatattgccaatgcatttttggcaaaattgaagaaccaagaaccaaattaaatgtgtggtagtggagttacagtataggtaaattccagtgatcataaatattactcgcatttattaggtgtgtttcaatagaaatttggtaagcttaaatatttgttgtcgacttctctttgaccgtgttgtaaggaggtacacatggttgtgtgcatgtccatctactatgtaatcgtaaaaagaatggctcgcagtaaattgctcaggttttgctattatttgttttgcatattcgttcttaggcatgctttcatctttaatttatctacaccgcaaagtatgtaggaccggcttcataagatgtatggttgtggttaagatcaactagctagggcttgactggagagagagctagtgggtggtatagtggatttgtgccactggatggaagcatactcatacttgcctgtgtcctgtctagatgctctgaatgcacatgcaaagcaaagtgtaataccccgtatattaaaatattaaaagatatttaggttgttttagtttggattgatttgttaaaataaagatgttaaccgaaataaataaaaaaaatatctttagaagtgggccaacatgagaaggcccataaacccagcccattagttctcccctaaaacctagagagaggggaaccgaatcccacttcccctcatagtgccgccacccctctccctggccggcacctccttccttcccttctgctgtgttcgcatctctcccttctacagcaaattgctctctctatatctccgccttcatagcttggatcaagaagcaaagtagaaaaacgaaacgaggaggaggagagaagtaaaaggaggggttagatcggagtctcccctattgtctccttacaagttctctaaagaaaccctaggtgaggcttattcttttgttgtatcagttgttctagcatggctttagtgctttaattcgtggtcagggaaggctagagaaggagtttgggtagttgcggttcggtttgttgcagttctgcatgtgggcagatttacagtgcttcagttttttgatattttggggctctaaatgttattttctgcaaacgtgtataactaggaagttgtagataatgtttggatctatcttctaaccaaagggcgcgattttatctcaagtggtttaggagatataattttttttagtatgactgttgtttttatgtcataatctggatagtagtagattgaactgtttttggacgggttaaacagtacaatcagccaggtcacctatagacaaagttgtagaggtttttcttagctttccatattggtaaagtacaccctgattgggcgagtagaactctagttatagttgttttagtgcggaatctgaaattctggacagattctgaagcctgctttcaagcgcaaattagaccatttaaatggcagaataaaaatacgatttccacataagagttgtaggccttgttctgtagatttccaaaatgtatttattttcactcatagccttttcatatttcaagatataaaggtttgaagcagtagtcttgtgtatagtccaagcggtgttccttgttattgagttttgatgggatggggcagtaggttcacctttttcattgttttatatgcatgtttgaatgtgttttctgaggttttgtttataattaggtggtggtccatcagatcgtgcatgataccaatccttcgttggaggcaagtgcatgacgaactaattgtgtgattcatggattgtttactctatctatttatttctgatatatttctacgtgataagtaactgcttatgttcatattattgttcacgccatttagatttcaagttgatcttatgtgtacgatgttattcttgttttaatattctggattctggttctgcttaaataattcaagttccctgcttgtcatggatgtgcaatatggtttcaatttggttctttgattccggtttcaattattcaagtaccatgcgtagtcatgggagtgcaatttggttctttattcaagtttctgtgggtaagcgctgatcacgcttactcggctttgccggcaaatgctaggatatattcactattgtccgggatggaaactactattacaattcatgcctgcacgggatgggaactactatcttctttaacttggtgtttggaaatgtgtttcctatcaaagaaagaaagccttatgttcatgctttattgtcaatgatgtatatatgtattttctagttccatattgtacttgctgagtatttttatactcactcttgtattttatttggttttaggtacgtattgagaccgacatgcatgggcgggaagtagcacctttatatacacatttatctgcacactatcaaactatattgcctaggtccataatgatacttaaactatatcatgattcggtcttgtaataatcttttagatttctaatagtttcttccccatggattataaggatggatcgcactgtaggaatgatattattattagttcaatttataactgtttgtcgtgaatgtccatatttacaggggagactctgccgaaatttctaataattttgggagttagtggttttgagtgtattttagtgtggcactccaggtacgtggctacctggggcgttacacaaagtgatcttaagctcatcgtataagcatatatattcacgctataggaagaacccactcaacaatcttctgaaaaatggcccatatcagatttgttttttcaaccatatggaatcaaacccacataacttcaagagaggtaagtatgtactccacggtgactagacctatgagactgtttgctagaaatacatataactatttgaagtcgtaaggacatatacaatgggtacacggcttcatgctttactaaaggtaaaaggtcaaatgagcttggtgaactgacgcgaataaactagcaagttaagcctacaaacggtctaacgtagcgaaaataagtttttgatatgtttttcaaggataataatggtagcaggtattgaggtgtaagaggttagtggcaccaattttaaccttgatgctagctacagaaaataggaaactagtactgaggacttatccttgctagagtcgacactaagttgagcgctgctgatgaaacgatgggtttatgagagtttttttagctatattgaataagagggatgtttgaattaaaaggtagaattaatatgatatcaaagttatttataggaagaattaaattcttaatttcctttgtgctatcatagatcacgttgttttagtttttcttttattcgtagggaactcttcgttggattttccctttgccctcatcacctcatggggtataagaccgaacatctcatttcaatgtaattcaacaacatttggcatgaatgccataatcaacatatgatggctggaatttaacattagccgatccctatctacaaccttgacaactctcatggacataatcaacatatgatagttatgaactcactcatatctcctcaaggtttaattaagtctcacattctttcaacgcgtatgggagagaataagtctttatctctcaccctccacatttttttactatgtcgttaatgtagtgaaaagaaattcgaaaactgtatacttgactcaccactaaaaaaaccttgtatagaccagccttataggtgccggttcaggccttttcccatatccaggtgatgaaaaagatataaaaccaacacctttaaggacaataggtgtcggttctaaagaaaaaccggtaccaatacgatataggtgccggttttttaatagaaccgacacctatacttatattgtaggtgtcggttctaaaggaaaaactgacacctatagtataggtgctggttttttaatagaacagacacctataaaacgagccgagccgattgaatgtggcgccaccgacgaaaatatctgcgccaccgacgaaaataagtgtgcatcgcttctagtctcttctcccatcttctttcgtctctctcccatccttttctctcccgtgtccttttctctcccccattatcttctcttttcttctggatctggatctagtgacacggcgcatcctcccaacggtggcgcgcggaggatggcgggcggccggtcggcggatggcgcgtggaggacggtgggtggcctctccacggcggcgtgcggaggatgacgagcagccacgtcgaggggctcatgggtggccattcaacgggcgacctccccacggtggtgcacgaaggatggcgagtggccgtgtcgaggggctcaggggcggccggtcgtcgggcagcctcccgacggtggcgcgcggaggacggcgggcggcctccctatggtggcgtgtgaagaacggcgagtggccgcgtcgaggggcttaggggtggccgctcaataggcggccttcccacggtggcgcggaggactgcgagcagctgagtcgaggggctcaggggcagccggtcgatgtgcggtcgtatcgaggggtacggactccccacgacggcgtgcgccggtggactccccgtggcggcgctcggtgggaggcgagcggccgatcaacgggtggcctctcccgcgtctgtttgtgcttctctcccttcctccctctgtccgtgcttctctcccttcctccctctcggatccttcaagatttgttctttgatgttcttgaatctcaggtgtctatatgttgttgtttagatgatgaatgtgttcttgagatgctaccagggatgatggggagcggctgcatcgagctgaattttttttttttgattgtgggatgttataggtgccgatttctaaaccggcacctatcacttatcttcataggtgccgacctataggtgccagttggaaaaactggcatgtatggggggttttccaaccagcacctatagcattttctgtagcagtgacttctatgcggatatccttaaatttcac

SEQ ID NO: 26730 - DNA, 3667 bp, Oryza sativa
attcacgtgcatatgcatagccaacagacagctaaccgttcgtcaggtttgacaggcatgtgtccgaagaattctggacgagaggccaaggcacagagagagtgctgtgccactgtggcgtgggccccactccttgtatgggcccactgtcatcgtcctcctgatcgacctgataatatcgctgcttccacgtgatgcattgcacggtgggtgccctcatccaatcattctcgcattgtttcctacacgtttctctctgccctaatccaattatatgccagcttcttgttattaccttctcctccatattaaaaaagaaaataaatggataacaaaaggaaggggaaaaaagaaaaaaatatttgatgggcaattgggcattgcgtacagaaactgaagaatgattgattgatgagattgatatttacaaactaccaataattagaatttagtaggagtagttgcgtttatgtatattatgaccagattattgccgtggattatttgcttcatgcttctcaaaatacatttttttatataaaagaaatcttctatactgtattgtttagatcccaagctagtttggcgagcttattaatttttaatctacccctatataaacgagtttgaatcatccatttcattttgtacccgttcatcgctttagaacggatccgtcttgttccgaagaaaaatatgcaaaagtactgaaacaagagtgcaccttgtgaaagtgtcggtccagcactggagctcactataggtaggtagtgaagtggtacaataaaattgaaaggtactaatctatatataattcgagtcaaagataagcattctcttccatgcatttatttatctatcctacttgaaagccgccaccacagccatggcaaattgcattggcaataaacaaagatctgcagctacactagcttatcaacctgtagcagttgaaaggcagtacgtatgcgtgtgtgactgtgaactgtatgatgggcaagactcgtgcaaatttattactcctccttttttaaaaaaataaatatatgaaaccgttaaattttaaatacttcccccgtgccataatataagggattttgactttttattacactgtttgaccattcatcttattcaaaaaattttggatttattatttactttatttgtgacttactttattatccaaagtactttaaacacaattttttgttttttatatttgcacaatttttttataagacgagtggtcaaacagtgcaagtaaaaaatcgaaatccttatattatgagacggagggagttacatttttaaccattcgtcttatttaaaaaattaatgtaaatatataagatataaatcatgcttaaagtacgttgagtgataaaacaactcatgaaaaataaattatagttacgtaaatttttttaagtaacaaaatagaggtagtactcatactaaacagtcggccttaagcaccatactttagcctaatcttgctatgctctcttttgcaaaagcaagcgtgaacaataacatacacgcacacgcacctgctatcactatcagcaatatatatttcagacaagttcacataccattctgtgataagtgataacctagctgagcatggatgaatcagctgggatggaagaacaatatataatgagcatgcttatcctcccaaggcagcaagaaagtataagaccatgttgagagcaagtttaatttcatagctaactgttgacttcaaatcatttataatcaatttaatagccaatttatacaatacttacctataaacatatattacacaattaatatttggtctcacctatcatacacacatgcatcttggagatcgtactgcagctgggtataaatctgtagcccgctgctcctctctctcatgttttattcctcgaaatgtgtttatagctggcttatagtttgctactatacctactcttagcgagcttaaacttccaagaaagtaagaaattagtagtaaaaatttaaaaaggctattttttttcagcttctgtccttctgacttgtggtgtatgttttggattttacaaccaccgcttttcaaaatctaagtgaaaattctagattgcttagagaagctaagggttacgagagaaactatggctggcagaagcactttaaagtttaaacaaagcctaagtagcataaaaagagcagaagctaagctagtagctagcttaatctctcctgcaagacaggcacaagacactagttcaatcttcatcagaagaagaaaaaaaagaagcaaaaggcgggaggagcaaaagacatgcaggtacatgggtcaaaagcttcaggctgccagcactactacctcagaatactttgattgcacggattgatttgatctttacaatagacaatcataccatcacctgtacccagatccacaaggaacatgcctgaacaggaatgcagaagaaagaaagaaagcagcttgtgtgcaatgcaaatccaaagctgcttggatcgatcgatcgatcgcaccatgtatgtgaccatttcactctcatgcatatatgctactacagtagtactagcaaacaaagaactcgagagaaaatgaaatgtgatcctcctgctaaacccaattcatcccaatctctaaccaccacagtaatccttgtctgtgcaggtttcagacattcagtcacatgttggatcgatcagcagtgaaacaggtgtattgtagtaccactgatggtgaatgcagaacggcagaggtgcagaggtttttttcttgcctctttcagacgtagttgtcaggcaattgtcgagctgcagggcaaagataataagcaatcaatcggatctaatctcttcggaatggtgcagctgagctattgaattcagacaaactgaatcgcacagggggggtttaagattgttcaaactgaattgtgaagatagcactatcgaagagcccaatttccgaagcaagacagctaaaaagcagacgatgtgtactatataactgcagagcgacacaagtttggtgagcgctccaagcagaaactggcaaatgttgaacgaatatcaaacaataattaactgcaaacttggtattctgggaaattgcaatgatagagtattcacatagaaaaaggttccaagtcccaaaccagaccagaattcctgccatgtcctgatagcagactgtagacactatgttctagtatgatccagagttgaaatgccgagcacacgcatccttagataatagaaatgttttacatttcgggcctctgccttcaggtaccgggtcaggattgattgagcacacctacaaaagaagcatgattaatgagtaataccatatatgttcaacattccagtacttgtaatttggaatgtgtggtatgtagtatctctgaccattctaggtagagctgagtggactagaagttcaggaaaaaaatataaccttaaacaccaataaaaacatggagcaaaggtaaagatggttgtacataaactgctttggtgagctgcaagggtcgttctgatactctgatgtgtttcaaacatgaaacaaaagataatgtaatgaatcgtctgagattacagattccagggatcagaagggaaggcttcaccacactaagtagggcaaaaa

SEQ ID NO: 26731 - DNA, 1718 bp, Oryza sativa
ctctgagcatagggaatctaaaattcctgttgaacatatgaattgtcatgatcatgattcattccatgcaactgaatcatgcaaaggtcataaaatatttccatgttcattggatcatgacattagaacttcagatatggtgatgcaatatcagtatttgaatgactcgacacaacttcccataaatgatgaccgtcaaggcatggtttcaggaaagaaatttcaagaggtagaccactatggtcccaaaccacatgatgattatttgatgggagatgcagatggcccgaatgagctttctggtgaatattttcctgctactgacaaccatcagagcatcttagtttccctttcaagcacttgtatccccaaaagcatgctatgcgagcgttctcagctcttccgcatcaagttttatggtagctttgataagccacttgggaggtacctcagggaagacttatttgatcaggtatttcctgtacaatccgtatgtgcactatcatatggccttcttatcattatcataatttttggaaatgttttttttcatgcaaaggcatattgctgcccgtcatgcaaagagtcatcagaatcacatgtcaggtgctatactcatcagcatgggagtttaacaattagtgttcggcggcttctgtctcaaaagttaccaggtgaacgtgatggtaggatatggatgtggcatagatgcctcaagtgcgaacctaaggatggtgtaccacctgccacacggagggtaattatgtcagatgcagcttggggtctgtcgtttgggaagttcttggagctaagcttttcaaaccatactactgctaaccgagttgcaagttgtggacattctctccagagagactgccttcgtttctatgggtatgtatctgctgtatccttcaccaattaacattgctcaatccttcaatgtgatttcaatttatctgctaaatatccaggtacggaaacatggttgctttcttcagatattctcctgttgatattctctcagttaacctacccccctcagtactggatttcaattgccgcagtcgacaagattggatgagaaggatggcagttgaggtatgcaatttttctaagttatgatgaccatgttcatagactgcatcatatagttttgctgtgaacttactaataatatgatactcatatacttgacttttggcttttgcagatatatagcaaaatggagaccttacattcagaggtatatgattttcttcatcataatgaaaatagtgttacatcagaggatgagccggtgaaagcaggtgttcaaaggcagatcatagagatgaaagatttgcttaaaatggaaagaaatggatatgaggtagtgcaacgagattttcctggttgtatgcgttcaggttaaacaaaaggttatgttatcttaatattgaccccctgtctctttctttgtttgttttgcagatcctgctgttgccagttattacagatagcaatcattctgtgcaggtctctattgatgttcttgagctcaaccgcttgagacgcggtcttctccttgatgcttacatttgggatcgaaggctttgttacatagattcactccttaaaaaagacagtcatgtttcaaatcctgatattttcttagatgtcagactgaaagagtggaaagctgacctgcttgtgggggatacaaaaataggaaaatccac

SEQ ID NO: 26732 - DNA, 6397 bp, Oryza sativa
caaggttttccgcagattcaatggagagacagagcagccagttactacagctacaatgggtaaggagcctgttgaaaggttaccctcacttgcatctattttttcagataagattgatttggcatggactggatctagtgagatacaagatgaccttctacaaggttttaccaaaattgatgagtatggatcgtttaatttcccagacaatccaagctatgggaattctgtaacccctgtcagaattcattcatttgattctaaatttgctatacaccagcgagaacgcaatggattggctcctacttcattgcatctgtcgtcattcagatctgctgaatactttggggattttactagtatcctgaaagatccaatgccaaacatacggagggcttgttctcaaaggtctcctggtgcagtagagaaattaaatgttgttcttacccgtacacttacatatatctcatctgcttcacatatgatcgatgatggggcacggctgctgttgcctcagattgggtatgaagatgatgctgtcattgcagtctatgatgatgagcctaccagtatcgtgtcctatgcaatgacttcacaagaatatgtgcagcaagtcacacgcaaactgaattcaagtttgagtttcttacacctaccaaatgccattgacagcagccatggacttgacgggaccttgctctcacaagaagaccatttggattctaagggaactcactttaagttttcttttgatgatgaatcgccactttctgaagataaagcaaagttttccattacttgttatttcgcaaagcattttgccgcacttaggaagaaatgctgcccaaaggatattgatttcatccgttcacttagccgctgcaagagatggaatgcgcaaggtggaaaaagcaatgtttactttgcaaagactcttgatgagagattcataatcaaacaagtcaccaggacagagcttgaatcgtttgtagagtttgctcctcagtacttcagatatttgatggaatccctgacttcaggtagtccaacttgcctggccaaaatcgtaggagtatatcaggtttgttttcttcttgttgcatgatttatctgatgatgaatgaagtgtatagagtattcccctggttctaacttctgctgccttttcttgagttcaggttaatatcaagggcttaaaaggtggtagggaagtaaagatggacctcatggtgatggagaatcttttctttgaaaggaagatatctagagtctatgatctaaagggttcattgcgctcacgctatacatccagtgagagtaaagtcctcttggattcaaacctcctagaggcattgcatacaaagccaatatttttagggagcaaggcaaaacgaagattggaaagagccgtttggaatgacacttcttttcttgcggtatgttgttatggaaattaatcttgataattcatctcatatatatattcttatttcagacaagggattgcacaaaatacttatttcttgtaaaactgcacaacttcatgaattggtgcattttatattactgaaaatgactgttaatcatttgaaatactttgcagacagcggatgtcatggattactcactacttgttggaatcgacgaggagaagaaagagcttgtcattggcattattgactacttgcgccagtacacctgggacaagcagctcgagacctgggtgaaagcttcaggcatcctgggaggccccaagaacgagtccccgaccgtcatatctccgatgcagtacaagaagaggttcaggaaagccatgtcaaagtacttcctcaccgtccccgatcagtggtcctcttgacaggcagcagctaaccttgttgatttttttcaatgtaaccaccagcgatcagaattcagaagcatcgccaccacaatagttttcaagtaaagattcataacccattttttctctgtccctatcacgaggttagtcgtcgattcattttgtacccaacttgtatcaggttgtagtcagtcaatagtagataggaaggataacctctcccccatggacaccaagcatggttatttgcagtgtccagccacagacaaggagaggcctgatccatgtacattatgacccacatagttaacatgaaaaatctgtcagaaagattgattcttttgaagctatctggcctgtataatgatgctactcctaccttgtaaaggacacttcaactctgcaaattgaggttactatattattatatacattaattctttctttggtgactgcatcgtaagggcattagcaatgcattgcaaatatacaactcagctcaagaacacctaggaacattgttagctacatgttccacagtgcatatacctaccctcactttttctctcctctctctctctgctctatcccttctccaccggccgaacaaagcgaggcggcgaccggagcggcggcagagcggtggtgtccgacgctcctctcccctctccggcgctcctctctccgaggacgaggaagagcgacggtggagaggaggacgatgagctcggcggcgcagacagcgacgagctcggcggtgcggagaggacggcgacaagctcggcggtgcggcgaggaggatggcgacggcgccagcggagcgggcagttttcacactctcccccctcttccctgtcactgcgccagcattttcaggcttttagtgggaagaacgggtgaccaaaatttgctacgcgttcctaataaggctccgaacgcgatcgacgtggtatagaatatgctgtttctcaagctgaggctgaacgccacggaggcgtattgtgaatggcctaagtatcctgaagaggcttactactattagtgtctgtcatatcaggagaaaggtcactttaactaccctatgaactgtggtactgaaacatcatatggttagatgaacaggtgctttgaattgccggtccgggggcatgtcatacctacttcaactttgagactgatggcaaagcggcagcaaacacaaacctacccatttcctgcatggaaagcttggtacagaccaggggttggtttgcccattcttgtgtcagctactccctcagtccctctgtttcagaagttctagtatgtaaggtggtttacaagttccagaatgtaaggtggttttagttttgtcgtaggtcaaacttctctaactttaacaaagttttagaaagatagttaacatctgcgattccaaataaatatactacgaagacgtcagcttgctgttctgtggcaattcacttgcgcatagtcaccggaatttattgaacgatgcagacaaatctgattccatacaaacaccaacccttgtttctgtttgataagcagttccactaagccccattttgcaacgtacttaaggaattcgacaaagattttggtgagaatctcatgtggaatcttcctggctattcatacagtgatcctataaatttcctgttcctgatggggccttaattaattgaggtttagctcgctaaaaattgtgggctggattaattgaagctagcatatttaataatcttcgcgattaagatcatgttgtgttgaagtatgtcatacacatctttcttcatcaactaagattcaattgattgctacgtatagaactcaatgtgtttccgaaggtaagaagttgctttataatcccttaattagcttaagatttagcttaagcttcaactatagcttaacatttcggttggactgataaaaatcccataaagggtttttaagcaaatttcatatgcatataccacatgcacgccctcacactcatatagatgtaccctaacaaatttatacaggattggagatcaaatctcacatagcatgtctatcccattacatagctaaataatattagttggggcctaaccttatgtaaactaggcatgcatattggtcatgaagaaattggggataggcaggaaagtacttctcttcccgtctagccttaaggtgaagtgaaatcaagatgtgtcaataaaacacttgtcgtcattgtaccagtaaaaatgtattttagttcgctaggattgggtcagcttatatagccttaggaggtacacatgaagttacaataatgcccttcaaaagcttagaaccctaagggtgtatccatacgttcggacgattcctaggaccactagcgccaacttgcaagtgaagttggagtgatatcccgacatctttttgtgcgaatattcctgcttggtagcataaaagcttatgtttttacctgccaaaagcttggtaacagtgcttgaaaagcttctgtttcattctccttgtaccatttacctcccgtagcacgctcgaatactactcatccaaccaatgtgttcttgctcggatagttcgatcttcttctagttacatgttaggaactcaagaagtatttacctccatttaaaacatgctttaggaaaatactagaggtggcgtattggttgaataagagatatgacacttagtccttgctataaatcgggatacaataacaagtataatgcaagcatccatgccaggtttaggacccaaatctaaataactatgcatgtttcaccacaagaatcctagtcaataccacagttcctcctataaaattattaaagaaaagcaaaacacaaaactaaagaacacctatataaaaaaaacctacaatgaagccaagtaaatatatcaagccaagcaagtttttgttataccaaacagaaaggttggatgacatgcttgtagaggttactcaatctactgcaagaaaggattgctatgcgtgcctatgagaggtggggtcaggctgtcagtgactagatgaggggtttggtacatgttgttgcatgggtgcagcgtgatcacgtgctccggaggttggtttagctagctagctgcatccacaagtcaaagcctctctcaccttcgatcggctgctccaaacgaagagaaaatatcacggtagtgtcggtacaaaaaaaaaccacaacccctaaacctagaccttcccattccttctataaaaatccaccatccatctatccaccgagtgcacaacaacaaccaatatatagagagctagcatacatatataacaacaattaaactatatgaatttcatgtggtatttttgtgttgtctttgtaagtgtcattgtctcctctccccaacatcattttggctgaatctatgaatttcataaacaaggtgggtagtctcttagtttggttgattgtgtcacaatgagatctatatcgagcaaatgtttgtgtaacaattaatatttgttttttttaggctaacagtatatagattgacatgtgggatccaccatcagattagagagattactggagtgaaaaagacaaatttagctctctaatttgtttggcaagctgactaaatagatactcagagagtcagatttagaaagattgttggatataggggtgtttagatttatgggtgtaaagttttggcgtgtcacatcggatatacggacacacatattttaagtattaaacgcaaaataataaaaaaataaattacagattccgcctgtaaactgcgagatgaatttattaagcctaattaatctatcattagcaaatgtttactatagcaccacattgtcgaatcatggagcaattaggtttaaaaaaattcatctcgcaatttacacgcaatctgtgtaattagttatttttttcgtttatatttaatactctacgtatgtgtccaaatattcgatgtgagagcaagtataatagtaggctataagcaggctaaatgttgaggtggaggagaaaagagagaagagagaggagaagcgggctataaacttacagccggcttgcacacaagaaccaagaaactctgtgagagagacaagtgggccctatattaattgtaaagagctaactattatatgggtagactaagagaaggctataaataaccttatagccaacagattggctgtattattagccttgctctgtcagggtgaagaattttaccgaggatctaaactggtccatactctcatgcataatgcctttttggttgtaggcttggaatttttaataatttcatttaatgagctcgttttggaactgtgactgtcaacttgaaattggtccaacacatagccagaataaattggaccttttgctttcaaattattttgttaacctggacgttgcactttctagtggccagttttgtgcagcccataaaggaaaagttgaacaagtgcggttggatgcctttgcataattggcttttcttgtggatgagcctacaaaataggtctttaggaggacaagggatgct

SEQ ID NO: 26733 - DNA, 9939 bp, Oryza sativa
  unsure (1)..(9939): unsure at all n locations
acatactttcgatttgtataagcattttgtcattctaattatatagtagctaaataagttataggtcatgttcaagaacctaacagaggcgagattaagttttagattttcatggcacgcttttcaaactgcacaaaaactgtatatttcgtgtgaaaattttctatatgaaagttgttctaaaatatcagattaatttatttttcaagtttgtaataattaaaactcaattaatcacaagttattaccacctcgttttacgtaaaacacttaatcttcatcttcatcttcatctttataaaattcaaacagagccatactatgtaaaaaaatgtatttcggttaaaatttaagaaggtgaagaaaaaaatccaatctggtggtgtagattggataagctacataatttttatagattaaagtcaagattggaaggtaatattcgtgttggctattatccgccttcaagcaccgccaccgcttgccgtcgacgatggctagggtttcgggtccaaaagaggaatgagtcaagtctttggcatgcaaggacaattttgaccatataaaaaatacaaaattcagagcaaacaaaaccaagtcaaaccgagcttgtgaaccaaatattttcgtattcgggtggcatgattacgaatagtatggaaacgaacattagtgatacttatctaaaatcacacttttataataggatggatcaaattaacccatatacaaactctagagggggtgtgtgcacaaagtgacagtactagcatactctntattactacagtaataaaaagaagtgtggggggaccagtcagtcaccgaggtggaagagggaggagagtgctttaaataccccggtcccaaaaagcagttcatcagcaatgcaaatcccactctccacggtgcacacacaccctctcatccatccctcaccgacaggtgggccccaggcgcacccggccccacctgtcagcgaccgatgcgccagccggggcgagccgtgctcccggtgtaaacggctgcaaggctacacctattattatgcgtacacggcgcgtgcgcacccgactactcttactctcaccgacatgcgggccccactggcgcagggaggagatgcgttgccgtacgagtagcttttcgggtgtcctggtgacaggtggcgttcgcgcgaagcaaatgcggccagcattagtactccgagctcaaactgaattgggaaaaaacaaaacgagtactatatatatataatattttttttcttttttttttcctcgtcttcttcttcacgcactcttggctcggcccagcgcagcgcacgctccaatttcaaaaatttcgaagctgtgggcttagctggcagctaagctatactactactcgatggcgaagcgccaaaaagacgattttacccatgcgctcaagcaagtaaacttcccgcttggtattttaaattaaaaggaagatgcctctattatcccaatcgaaaattttgtatctttcgttatcggtgagctttttttatagtgccggctagttcatacggtccacacaactgtacatgtcgagctactaatctgcttaactctagtagctgtttttgttggccatgtacatgcaattgcaatgcgcacatgatctcacttttaaggtatgggaggtagagtgcatcaaaacaaaagttgagaaaacctaaattcttgttaaaaaaaattatacgaattttacttaagaaattttgttacttgtcttaatctatctaaattgttactctgtactcatgttctctagctatacaaatactacctcatactaaaaagaaccatgataaataggagcaattgcgaatttaccccgttctaaatcgttatggcaaaattcccactataaaattgaaaagaaaaaaaactaccaacagaactatcattcaaatagtattcttacaaaataagaaaatccagtggcaaatttgtaaatgccactatacttgtgaaaacataagaataggaaaaacgtaggaagagtgtcatgcccattgattttctataggaattaagaacacgtggaagttcaaaaattattgttttggatggtacatagaaaaaacagaggaaccttgtggctgtgccatggaagagataaacatgcggtagaaccttatgctagattgccctccaaattcctatgaaaatagtccattactgaatttcaaaataatctgagagagctattcctttattccaaaagactacatagaaatttttccatatgaatcaaatcctccacaatttccgtagttctctttgttccaaaagagttcacgatcatggcatcatatttgttcaaaggttaattcagttgcagaaaaatatttaggtataattttacaattcaactaattacattcccatctgttccaataggattgggagataaagttatgatttagtttctttctatgccggttttcatgatgggctgggtctttggagcttttattggaagctaggggatcgacatagcaggattttgtttttgggaaggatggatgaagacaattgcgcttttaaagtagctaagatataaaaagtggtttattagatcacatgtttcataagcccgagtgaccatttatttatttgaaatttagttacattaatattcgcttaatattttgaaagttaaaactttcctttttaaagtgttcattatatgtaaccataataatcacatctgcctaaaaaaaaccaaatatatttcttcgttgccttttacttagaatgtcttatcttaccaattatacactcaccatattacaactaatgaaaacacgataacttatagtagcactataccctattcatcaaccatatgcatagcaatactagcaagcatacatgtctatccactgaacattccgtgaaactctattttgaatctaaattaaaaacttgattttatttccgctcacctaagtaaagcacaaattcacaacacgttatgaaagaggtcaactatatttcacctaaatccgcaaatccaggcaaccgttgcgtagacttgaaattcagttgcactattcagcgccggacttttcggaagtaacaacttttctactatttctacattacgatttacctgtaatttaaacttcaataacaaacagatcagacaaaacctaaatcatcttaaaccaattacatgcataccacattacaaccaaaacaggtgtatttccagccacactataccgttgtacatcctcagctgtgcatgtaacaatattagcaataataacgatataaacacacacaactcaggggagggagggcatttccgctttgtccatgcagccaaatcacaggcctgaccaccgcccacctccacagaaaaaaccaaaaaaaagaggccaccacggagggcaataccgtcattccacagctcccccaaaaaaggcacccgcgggtcgggtcgggacgggaggcaaaagcaaacaaaacataaagctctcgagcgcgcgcgttctcccctcccctacccctacccctgccacgtcaccgatccgcgtgacccatccctccccgcgccgtccgatggcggcggatcgactcatcccagccgtccatcctcatcttctcacttcccctctcacacaggtgacacagccgagcttaacaataaaaaaaaatggagagaaaaaaaaaagaaataaagaaggcgagcccatccatctcctcttccttccttcctcctccatattttcttatctattcctgatccaaatccatctctctcttcttcatatatcctcctcttcgtgagcgaaaattccccatccccatctcccccaccccctcctcctcctccgccatggccgccgccgacgaagcctccaagccgccgcctctcccgccctacccggaggtgaatttcttgttttctctttgtttgggttggttcttgggggttgatttgggatttgtggtgtgcagatgatactggcggcgatcgaggggctgaacgagaagagcgggtcgaacaagtcggcgatctccaagttcatcgaggggaagtacggggacctgccgccggcgcacgcgtcgctgctcacggcgcacctggccaggatgaaggagtccggtgagctcatcttcctcaagaacaactacttccgcgccgacgcgcccgacgcgccgcccaagcgcggccggggccgcccccccaagccgcgggaccccaacgcgccgccgccgccgcccaagccctcctcgccgcgcccccgcggccgcccgcccaagtccaaggaccccatctccgacgccatccccaagtcccgcggccgcccgcccaagaaggccaagacggctcccgcccctcctcccgccgccggcgacggctccgctcccgtcaagcgcggccgcggccggccacccaaggtacgccccgccgtccccagcgaggcggcggcggcctgaccaaccccaatctctagggttagggttagggcgtagtggcatcgaattggggggggggggggcgagatggggtttgttaattacttcttcttaatcttaatctctcttaggcttcgcttcctttaatttcctctaattgttgtgctcttagtacaattaatcgggtaattaggcttaatcatgttgctgctgctgcttatgtgttgttgttgtaagattaaggctgagctaggcttctcctcctgctcctgctgatgctgctgagtggattaattaagctaagctaatgtggatgatgatgtgtacaattaatggatggtgatttgtttccaagggatgctgatttgatttgcctcgagtgttttgaccgtttctgatgctgataatgacggtgcttagcatgctaactgctgtgttgatggcgtgctaatcattcagctgcagctggtttgaccatgcttatccagtggagtggagtggacagtgagagagtggtggtggttgtggctgtgatagtactttggatgttttgtcgtgtagctgcccgtagtgttgcattgcattgcacacatccattcattctactgtactgtactggtgtgctgccagctgtgtgcctctgttgcatttgcgtataggagtttttgtttttgtttttttttgctttctcacttctgtgaggtattagtagttagaatctgggtttatcaaaccgtttgggataggattatcgttacttcacggtttagctgttaccgttgtaactttgcctttactgcgaaaaccgtgtggttactgtgagttatatcgtggtctggttttaaaaaaccgtgtggttactgtgagttatatcgtggtctggttttaaaagttgagaagattacctcacatcgtggtctggttttaaaagttgagaaggttaccgtacgtgataattgttacaaccgcgtccgcgtgataaccaagcaggaaccttggtggaatttttctttttttggtctgcagcttgtttatgccgatgccaatgtaggatcatcttgtagtttgtgcgcatatacatagcactctatacacgatggtagtgctgcataccgagggcctctttcagagaggaggaatttcacaagaattgaaaaaaaatatctgaaaaatctatgaaagtcctagttgtttcatggaagttctatgaaattctatgaaaggagccctaatagaatgcactgtagtacttgcaagggctctctattagccacgttttcgtaggagtttatgttagtcaagctgttcgaggttaaggttctgttagtctcttcaacgctgggccgtagggaaataaattttgttatttcagagtaaatacaaatggtaatggtaatgggcttctgctatatacttataactagagtttggcaagttgattcacaagtctaagggcatgttcacttcattgcttaccttaccaaaatttagtgttaccaaagagttacatttgaagcattcccctctcgttcccctttcctctacagtaacctctctgatttctctcccctccagcccctcttccccttcgatttcagcggttcgctgtcggcgagggttggaggaggggtccggccaccttcccctagtactctttagtcaggttggttctgtttctctagttagtctggcctctaatggtggcgaccggtgttctcgttagcggcggtggtgggagttggtacctctgcgcctcgtggacggcgaatcgaagacatggcggtcaaatcatccccgagcaagagccccaaagtaagatagagtttccggatctggatggccttggtggtggtggaggaggagcttctggcagtggttgccgacaccctgctcgtgtgcgggtttgtgttggtggtggagacggagtctgcgtcgcgcctggcacttcggtggtcgtcgttgaggtggcgacggtctctgcgctgtcctcggcgttacgacgtctgtcgtcccccttcgccgtgcccgagctagcggtggcgttgtttccctctgtcgcacctatgctagctgtggcgccggcaggcgtcggcatgtgtgctatgatcggcggtgtggcagttgtcgccccctgaactccagtcgcttgctgtgtgctagccggtgccactgttggtgcagcttcttcctctgttggcggcagcggttggctcgtcgtcatctacatcctccttcaagccgaagcctttggaagccttgtgattgggtgtttgttctgctcaaaatcttatggttccatgttgcaggtcgccctctccttagccatctcaggcctcaaagcaagacagaagtctattggcagcctctcaaaagccccattgttgttggttggctggtctacgttttggccctctcttttgattcctagtagcagaagccgcacatggtttgtcattcgggttgagctcggaccccctgtgcaatttcgattgtcagggttgttagaattcctcagattcaatgacgaatcctatggggatgttttgctgagtccggtgacgctcacaccaaaaatctacggctcaacaaccaacctcgatcttgtgccgttcccgtggaggcaaccgaaggggattaacggtttgtcaagtggtgtgcacttcaactgaggcccaaggtagcagtcgtcacggttttaagacgttgtggctctgcagtcgtcacggctccaccgcagctctctgtcggcttgctcctttttctgctgttcggtttcatctggaaggttgtttccatagttcggttaaccctctttcttcaggattgtctctgcttttaacttctatccgttgttgtgtaccggggtttatcccctaatatctgttcttgcttaataaagttgtttgtgtttcaaaaaaagttagatttgaaagtagggtttgtttggtttgctaccatgccaaaatattggtagaatttgggtggtagttttgagagtagaaagttgtagaattaccaaaagttgggacgtttgggttggtaatgggttgccttaccaaattttattttcaactttgaaaaagatgaaaatgctaagaaagtgaaccagtcctaaggcgcctctaagctgatgattttatagtccgatggttcaaacttcaaaacgcgatttgtgcttaggacatcgtaagtcaagcgcgacttctatacttaagtagtgagaagtcaattttagaacacagtactctgtaaattagtttttaacttgtttagctcacttaattactacactggcataatgtccgtccgtagaatcttcactctatcagtgacctaaaacgcttttactggtcgcgagctactagtacaggtgattatcaaggccaaagaaggtatatgtgaccaaagataacgaattgtagatgtgattggatggtctcgatggattcaaaaggacgctacttaacaaaaaatgatgccaaattggtgatgcttatttgatagattagagcaagtttaataggatagtccaccactagcttcaattcatacaatagttgcttactatactattaatatatagtctcacctgttatacacacactatgtcttggagtccgtgttatagctggctatagatctgtagccgctgctcttctctctccttatttattttattaaaatatgtttacagctgatttatagcctgctattgtacgtgctcttagcgttgatgttactctttctcctccgagtgagcgattattaatagaggatggagtttccctaaaccttgccacgtgtgttgccgatcgatcaacaacaacccatgcatgttccagccgtccagtgcatttgtttgtttactctagtcaacaaaagaggcttgggggtctttactttacagtatggcacagctgtagctcctagtaaacaaatggccggtgtagctgtaaaatgatgcttgttttagcgtaagaggatccgtttcgctgtacaatatgcaatcctcttctattatttcagatcaatgatgcctttcatttgaccagattttcttttgcctgacaatttagggttttgatagctgtaaaacaacctaggtaatccctccgttccatacaaaacaaatatatgacaaaatctggcatatcctatttgtatgtaatattagaatatatcattttctgttttaggttttttttatgggattgagggagtattccgcaagtacagccgaaacaaagatcgttctctttacagttttgacgccgagagttaatctactactcctacttcaaattatcacatggttaaatacttttaacatcgtgtaattctcaaaaagaaaaatacttttaacatctcgcggtaccttcgagtacgaaatgaaggcaagtcttggcactgtaagcagaatgaaaaatctatggtttcgccaaaaagagagaagaacagagagagagagagagagagagagagagagagagagagagctatgctacattgtctcgagctgtttcagcccaagctcactcggacagcccaacattctcgaaagtccatataggcccagccagaatgtagtccgtctctgagggatgacatcggtgggccgggcctgcccaacaggatgttgttggttttgggctggattcattccaataaaacggcccacgcgaatgaactacaaaattagggaagtctcatctcacgaatttgcaaaaatctcagcttatttattacatttgcaatgattttatttttctctttctttttccaatgttcgaaacacatgcatcagacccttgcaggttgcatgcttgcatctcaccaaagcggtttttgtattactgtggttgccttgttggtacttctcatgtagttcttgctgtttaaggtttcatgttactcaacctctcactttctcggtccactcaattctaagagagatgttgggaacatttcagggtttgcactctgcactcaggtaatttcaagaccaatagatatgtccacatccttagataatagaaatctgtagagattatctgtaacaataacatgtaggactggatccatctgtcagtcactgggactgcaggcgtagtattgcagaggatccatgtctatgaaatggagaacagcttctaaagatgtgtgtgctctatattttcactctgtaatatagtgtttgctccctgcacttaggtcactagaggattcaggtcccatcggttcgcctaataagctaaagcaaaagacaaaacttgaacttttaaacttaattttgaagtttattttaagatattttcaacgtagtttctttttacgcattagcttttaagtcacttaaaaacaaatatatacaagttttatctataaattattttatattccttaataggccgttttggcttatcatattcaattttactgtaaagttgatgtctactaacttctaaatctcaacatgcaa

SEQ ID NO: 26734 - DNA, 13158 bp, Oryza sativa
ggatggtgcatgcatagagtttgttgctagagtaaatatagtatgagagagttattagtttttcttggtcttgatgtacctatgaaatacgtagatcaattttggaatagagggagtactatcggacccattgaataagcgaaaacggtatatttacaaataaaaaataatttatgaataaaacttttatattcatgttattggcgatctaaaagtaaaaataaactctgatggaaaaaccctaaaatcaacgttaaatttaagtttgagaattcaaattttggctgataagtcgtataagccaaaagatgatttcattctgatatacatccgcctatacgcatccttgatagcgcgcaatatatgtatgagtaaatatatatgcatatataataggccaaaaattgcagatgagcagtacactggtagtggttggcaggcatgcactagatctgctgaattatttttcatgtagtcggtgaagatctctgacgatattatttcggtatcaaacgtaatagagagattaaacaacccggtgactagtaacttttaattaatctcgttgcagccgtgtcgagctttcttgtgtagctataggctgcaaatgagtccagtacactgttagtcatgcaaactgccaaactcactttaaaaatgaggttaattgcatcaatgtcactacaaatattctattttagataaatacgactactattcatgatattggctacgtaccactgtaatttaggaaaactagcatagtggcccatgcagattgtgcggctagcattattatattttctctcttataatagcatatatattttctcaatgtattattcaaatatattaaaatgacaatataattttacatgtcttatgagagcgaacttcaaatatgcctttaaattttagttatttgtaacttgtatttctatatgtactctaaattctactttaattttattagttttattttgaattttaaattcttatatgtattctatactcttcttctaatattccttattttaattcctaatttctattatttctgtatttctttatgttgatctaaacttatctttcaatattttttttaattctgaattttaattatttttaaattctatttctatattgactctatattctccatccaatatatttttaattttgaattttttttatttctaattgtatttttatatgaactctaacctctacatttaattttttttattttttaattccgaatttccattagttctattgtataacgatatagactctagtcttaccttcctatattccatacttttaattccgaatttcagctattattaaattgtattcctatatgaactctattttttctttttctccgattaatgtgataaattctaggccatgaaagcgaacgtggaggcttctttttctattcctttaataatataatagattggaaccataccactctagctcggattaatataattcaccaaattattatctcagattgtttgcttcttgcctctttaaaaatacgttttcaccaaaaactttctttgaaaatacgttttctcaaaaaaactttcttcaactgcattgattacaatacatgttctacgttatttgtaaatttatttttaaaaaatatttaatttattattgtaataaggtcgataatccacaacaataatatggtcaatcatctatccttattctctgtatggattttcatcctcttgtaaatcattaaatcatcccaagcaaattagaatgaagcctagtagtgactagtgagccaccgcatcaatattgttcgctctcacaactttcactagcctcatattcacccttgtcaccgagtggaaaattttgtggtttaattataactgcaattggaaattatctttgattttgctttaggtacagaacatcaaaacaatgcttcatccggtcaaaaatatttgttgttctagacaaatattgatcaaactgaagtgttacagttttgttcatcaataatttcttgcatgcaagagcaaaacattgcttcgaaatgtacttatatcatgataaaattgcccactatacaaaatcgtgaacttattttcatataaaatttcctattgaaaatttataaatcttttaatcaaatcttattttaaattctaagtatttatgataggaggaagtataatatttatatgcatacaatactgcattcgtacatggattcttcaattcacaattgaatagtcacaaactcaaactcagtcactggtcagtggttttgtatttctgtcaagtggtcctaggactaggagtatcttgctgcatgctctttcttatcaagggcattacagtcattttacagacggcaataaacaaatctgcccaaatcaacctggaccgaccaagaagaaaaataaaatactgcacttagaaggaaaaaaacgaaagcaactcacaaccaaaatttaaaatcagccatgcgcacatggtggtagggtcaaaaacaatagaaaaaattaaaggaaactaaacatttaaatttaaaaaaccctcaacgccacccccactagcacactaaccacatcgctaattccaaactcccccgtgacgcaatttctatcattttttttaaaaaaattcaatttaatctttttttaccactactccgtaccatgggtttgcgtgaacccgcacacgaaccacgtgggacccaccaccctcccgcttggccaggtgggccccggcgtcatactccgtggggcctcgcgggtttggatcgcaattcggctcgtgtgtgcgcgcccccgctggtggggacacgtgtcgcccccgcgtcgcgcacgtggtcgggcccaccttagagcaagtataatagtgagctataacctgactgtaaacttacgtgaaggagagatgtaacaaaaaaatcaagtggattggctctcatgtaagagctagcttaacacaatctccaagacaaatacattaaatgtataagtgagagatagagagaggagaagaaaattatagtcaattttatagctaatcttattatatactatgttggctttaagaagagctaatcttattatatactattatccttgctcttactccccccgaggcgtcgtcgcacgaggctttaaataataatccgcggcacaacgcccccccgccgagacccctgccacctcactgacaccgcggcccccaccatcccccgaccccacctgtcggtgaccgcggggtacgtggcgcggggggtggggggttcgcgtgtgcggaggcgaaccacgtgggacggggacgacgggagaggaggagccggtgggcggggtggggcccacacccccatcctctttttttaattaattaattaattaaatgcggtgagcaataatgattaaattatctctaactaatcatggctccctcctaaatctcgcgaataaataagcgagcaatcgaatcgaaacgaagagaaagagagagaggaaagcgaagcgaagcacagcagcgcgaagaaaggtcaaggcatcgtggagaagaaggagaggaagaggaagaggggataaaagttttgcttggattggttcttgttcttgaggcgttttttcgcgtgggatggagagggattttcttggcgcgatttggaggaaggaggaggcggccggcaagccggaggagcattcaggtcggtgctccactgttcttctttgatgatgaactcgtttggttggttggttggtgctagtagtagtagtagtagcggcttagctcgcggccatggcgatgcgggtttttaattgggtgggtgcgatgcgagctcggatttcgggcatgtgatgtgatccaccagagcagagatgaatgcgtgcagctgcggatttgggatggcatcgattggccgcccaattcgcagctttcctttttgtttttgtttagttataaaagaggctttcattttttttcaatttttttgacggctttaaattgcttgttcaaatcggcacgattttcttgtgcgtgatttagcgccttttttttcttcgattctgcgtaggtaaatctgtgctgcgattgttgtgttttttttggctgtgcgtcgtgatttgtgagtgaatttgtagtttctcgtgatgcagattatcgaggaggaggaggaggcgcgtcggcggcgatgcagtggcagtttccggcgaccaaggtcggcgccgcgtcgtcggcgttcatgtccttcaggtcgtcggcggcggcggcgagggaggaggaccccaaggaggcggcggtgttcgaccgcttctccctctccgggttccgcccgccgccgcgcccgtcccccggtgacgccttcgacggcgctgccgccatgaagcaggttcgcctcgcctccgacctccccgtcgcccacgtcgtgtccctcccatggtagattctaacggtctgagctgtgtgcagcggcagtttggattcaacggccggcagcagtacgccgccgcggcgcagcacggccaccgggagcagggcgtggactcctacggcgtcgcggcgccgcaccatttcccgtcgccgtcgccgtcgccgcgccaccccgtgccgttcggccacgcgaaccccatgctccgggttcatagcctccccaacgtcgccggcgggagcccctacaggaaccaatccttctccgtcggcaactcggtggccggctccaccgtcggcgtctacggcggcccaaggtggataatctctactctgctctaatagaaatcatttctgaattttgagtgcaaagctaagaaaaaaaaatgagaaagcattgagctgacaattggatcgttgacttgcaaaagggaccttcaaaatccgaaggtgacacagatgaccatattctacgatggattggtgaatgtgttcgacaacattccggtggagaaggtatcgtatctttgcgacgcgcgaaatctgtttgatgttacttcagttcttgggggtatgattcctgattgtgtcataactgtggcaggctcaagaacttatgcttttggcaagcagggcatccattccgagtccaccgagtgcagctcgtaaatcagattcgcctatttccgctgctgcgaaacttacagtgcccgaggctttgcctgcaaggcagattgtagttcagaaaccagaggcttctgtgcctcttgtatcaggggtttcgaatccgatcaccatcgtgtcgcaagctgtgactctccccaagagcttttctagctccaacgactctgcggggccgaaatctggaggcctaccgttggctgttactcctttgagccaggcatccccgtcccagccgattccagtagcaaccacaaatgcttcggctatcatgccaagaggtatatggctctaccttcatgttgctagttctgtaatgtttttggaattctgaattcccggcgtaactactgtagtgtttcataaggtattcgagattgattcatgttcttgcttgttccagctgtgcctcaagctcgaaaagcatctctcgcccgattcttggagaagcgaaaggaaaggtataaatcgtgtcatcgtgtgtcttgtggttttactttgcagctgaaatctgttactatggtcttgtgcatatttttgacatgtgccttgtttatcatgtagagtgtcaagtgttgcgccatacccatcctcaaagagtccactagagagcagtgacaccattggcagtcccagcacaccgagcaaatcatcgtgcacggacatcaccccttcgaccaacaactgcgaggactcactgtgcttaggtcagccaaggaacatcagcttcagcagccaggagccccccagcacaaagttacagatatgagacctggtgatcattgtataccgaagattcagctcagcgagagtcggctgaccttgatgccagatcggacgccttctttcgcatccgtgttagggtatgatgagacataggaagagatcactagatgctgtttctatcctggctgcaaaatctttctttggctagagctgtttataagtgctgatctagccacagccgccgccacttagtagtacgagagctgtgacattgcaggtaatttcaggctgttcttgattatttttgccctgagccatagcggcattggacttgagaggaaaagaaatgctgctgagttgtataggattacagattcggcgtatgtaattttgctgttttttggttctagccttaaacatacaaagctagcttcagaattcaaacagagtatccctgatgccaatatgccattgccatggccatttttatatgttcggtacatttgttgttgcatactgttttgtgcatacaggcgagaatgcttgtcattgtaatgactagcgagtttttgtagcatgcacatcacgcagctaactaagattattatgcttcccttggagatcgcatgcagtgatatgttacagtgtttacttgattgtagtctctcccaagctagtatactctacgtagtcataaatattgtaaaaaatgaccaaaacttgtgctaaatattaatatttaatatttatggctaaagggctaggaatgaaaacggatagaaaaatgctcagaccatttcctttgctttttttttccttttcggaaacagaaccgaacggtagaacaagaaaggatatactgttgaaacattttttttaaagaaaaatatatcagaaacataattattgctacctccctcataaaaattaaacttctacctttgaatatttgtctcgtagaaattgtatttctactcccgtttcatattataaatcattttgacttttgtcaaagttaaattactccaaatttaaccaagcttgtagacaaatatattaatgtttatagcaccaaattagtttcattatatgtaaatttaaatatattgtcataatatatttgtcttgtgttaaaaatgttaatatttttttctacaaacttaatcaaacctagaacagtttaactttgaccaaagtcaaaacaatttataaactgaaatggagggagtatttaatataggacccaacaaattgattacatcaaaatatatttccttgtaatctctcttccttccatcccatctctaactcattgttttaaccttattttaatcaagtttatatatgaaatgtgtgcatacactgtgttcattaaatgaggttattatgataatttgtctattctcctaatgtatccttagttccttagaaatttattttttacgggacaaaagtagtagaatagagcattagaaacaacgtatcgtaagtgtaaacaagttgcacccaatgttttgttataaatcaacatcatatacatctaccatttgaatactttactagcaataatgtctatgcgttgcaacatgtaaaaaccaattttaaataactgaacaaaactagcccctttggtcataaaaaaatgacgtttagattaagatttggtcaaacttttaaaattcaaatcattaatagtttctcaaaatgagtttttgaaacaaaataatctaagtactctaaaaaaaagtgatggttagaatttaaaaattttaactaaatcttattgtgaatgtcaaatatttatgaccagatggaggaaaaggtttgcgatgcatatatagttgtcattgtctagctactaatccatcacccactatggttgataaattgtgatggaattcgttagttttgaagttgcaaactgcagttttcttgtacagtagtgtgtgcgcacttatgttgactaaaatggctcaggtcatgaagaaaatattcccgatacaattatttagtctattgatatttatgagatttgaggtcagccttcgtcaataatatgaaccatcctatgataaaggtgagatacatgatagatggacaccgcatgaagtattgatgtgatgtggtgagccaatgtgtatgaggcaagtactgagattacacaatgggaaaagccgagatacatgatagacgtgcactgtctaagagaattaacatgacaactggctgacacaagtcgatgtgtatgatcgtcaaaaatcgcaaaaaaaaaaagtaagaacaatggtaacataagataaaaagaatcccatttttgaaatcacaaggggacacggtactggttggcttattgacttattgttttacgaaaacacggatacattttctatttacgctatgctagaaactgtccatttagttggcttgtgccaaacacatctaaatgtcagacacttagaaggcattgttaacaaaaatgaaaatagttcttaaatcaactcttaggctgcaaattagaagttcaagcacacatttgtaaggtgcaaataactatatcgtttgtgttcaaaatcctgaatcggagtaaaataacaaatggatcaatttgccagcaatctaggcccatacataactacaaacggacccaattaggccgctacactggtagcagcccagataaagatgggccaaagcgttgccatacccaacgcgggtgtattggattgggcccattggtagcgttccaatgttgggttgggcccaattgtctaaaatgggccgactgcttcctcctttctccgtccactcgccggagtgagtcactcgctccctcgcccaccgccgccggcgccgcctccctcccatgccctccggcgagcgccgcaaccaatccgtcctctggggtggtgagagggattggatgcggccacgccccacgcggcgcgagcaaactcagcaacatagcagcaccagcaccagcaccagcaccagcacgaagcgagcaagatggcaaggggaagatgacgaagaagatgaccagatcaacgggctccccgactgccttgagctccggcgatcgcgcgtgccgtctgcgaggctgatgccccaactcctgtatccatttgttgtgctactctttcttctgctcccgcacctttttttttttttgtgtgtgattatgatacacctatattttttttagataataaaaatgatttacatcttcggcctctgcgaataagtatatggccaattagtcaagaaaagataaataaaaatactcgaggctatgggacaaatcctcatctcccaaccgatgatatatcaagctgaaataccgaaagaaaacacgtagaatctataacgaatgatgcacctatatgctatgcctgtattcatgtttctgcaggtaatttttgtttgttaaattctatttttgttcctgaagaaatcatgtgttctgaacttctgataggttgctgttgcgaaggtggagcctgatctctaatacagcatgacactttctaccttattgcatctcatggattaattctcacagtgttggaaagaaggggttttcattttcattattcagttttatttgccctgtctttaatctattttgcttatctagttgtgctatttgaaaagtataaaggttgtttggatgtttacttatcagttggtggttacagaatagtatattcagtttttgagtctgttagtctcataattgtctatttatacaggtaaaatttgctacttagaagacattgatgatgttaattttttagattattctttagaaacaacatttatatttattactctatatttgtgtgcacaaggcctaactgttttatatgtataaagactgaagataatatggagtttgatatgattggtgttgatgcatcgataactaatgccttatgaagaatcctcgtaccagaggtatgcgcatgttgccatctgtaccatactaccatcttgaaaactgtttgttgcgttctaatgagtcatgtatttggtggttccattccaatacatgtacttcattattttaaattacaatgttcctacaacggaaaattgagaaagtcctcatggttgacaacacatcagttacaccagatgaagttattctacacaggcttggtttgattccactggatgcaaatggatcctttttattatatctcaggtcaataacttaaaattttctaattccacattcatatatttgattgctatgtatgaatacttgtgtatgaataatagctgtattattctttcgttgggttctgtagagaacgatgcctcattattgtgtacaaactgcgtgtttcatgttagaaaggcccccagcttacagttatcttcgctgtcctgcaacctaaccctttcacagtttccaatcatcttatttctaagtacgaatttcctcccttccaatttgaattgtgcaaaactgcaaaagtgatttatttctaaatattcttctccaggttattctttggagtcatttttattcactgctttttaacttttaagactaaatgccatgtttttctcatttttactaaataagcatcaagtttacaaatttatcttgaaattgtggaccttatttttatgggagacaatttgcacctgccagctgcaactggatagattaaacaacctgatttgatgctgttagtgaccttcaaaccaccatctcctttaagcgaggatgatccaattatctgtttgaaacatcacattctgtgctacgagacttacataagaagaaaactgtgttatgtttcacaaattgtggatccttagtctttagatatgcggttaatgggtaaatccccacattgacgacatttcatattattatctgaatatacagcataaatcagctaaggcaccaaccttttcttccatcttaaaaaattcttaataaaagccaaaactatttggaatcatttaaaaatattttgatgccacatcaatcagatttactctgttcagaataatttacaaagaaaaaagtgagggtaaatccttggcagcaaagcatgtgcctaatgctactatgtaccaatataatattttgtgtaccaaaaactcaaactatctaaacaaatttcttaactgattttctgataccatcatcattcatgcacgctgaatcaaacagtggatccttagttattggtacttcagcttattcatgccaattctgttatcattgttctacttggaaagctttgatggctagacttcttgttatctcttcttttttttttgcgaagttgttctcttatgctaatcaatcatgtaagaaattaaattgctaaaacctaagacttatatcaatgataaattaagtattctattctttgtgcccttatcgttattataatcctgtcatatttcctgtaaggttgactgatattttctactgaggtgtggttagcagaaaatagccaattaaatatgtcatctcctgctcaatctgggaacaagcaaaagacctacacttccttcggccaaagcaagaaggatatctcaaaaaggatggtgtgaaatttaacgatataactattatgaggtttggacctggccaagtaagtttgttatggtggttgttatcatggctttccccttgacactatatgatatacttggtacctatatctgctgtcatttaggcttactatttggattatggcgctttgctgagtccacatggtataataaagatttcaacgcagtcatttcctggaatcctgatgtatgtagctttaccattatttttgtgaccaatcaattttttttgcggcttaaatttctgctggaaacctgagttcatgtgcatgctgatagaaatttctgcaaagatattttcttgtagagacctgcactctgaaattgctttactaatttttcatggggtaattctccgcaaaccaccgtgccttctaatttgcctagtcggttctattttaggctattgaacttgaggcatatgctgttaagggaatgaggaaagttcattctaagtggtctccagttgctactacagcctggtacagaatttccctgaggtaaaattcttttgctggaatctcttataagaaaaccatgagttgctatatactattgttttcatggcttagtgttatattattgtgtagttgtttttctcaaagaagtaaaaattgatgatgcagataggctagtgaagaagtgcccactcaatatttttgacattggagatcagggaaactgcaatttctgttcccactagctatgggcgttgttattttactagtgttatcttgggatatatagttagggaatggttgtcacttgccaatcctagtagtaccaaacaatgcgaggtcatctacagctcttgagtaagaggttgtattattgtctgtaatgtctatgtctcttgcttggatggtattcttttcccaaagctactgaatggaggtgtgtacacgaggataaggggagggtgcagagttgtatagtatctcttgcttgagtaaccagtcaccttgtttattgaagactggctagtccttagtccttactatctaacgctgatcactcatattggcatttattttacagaattttctatatttgtagttgctttaatgtgtttggtggacaccgaaacacgagattctctttataatatcagttatcattaatcactgcaacattattaacacatttgatttacctaaacatgtttcaaattatgcatggtgagagctgatgagaagctctcatttagcattttgattggagaatgttcctcccgaaaaaatttcttaagcaggatgatggttttttagtctttctaagtccttaccaaataaactccaacacttgagtagatgtgaaaatgagtgatagtttgttgagttttaagttgatttagagttcaaacaataaaagaaaaaaatcaataaccatgaaaatttgcagaatgataggtgttcagaacttcagatcttcttttacaaagctctgctaaaatatcaaggtgctaacactggtgtgtgttgctgtggctttagccttctgactcatgctccctccgtttcgcaatgtaagactttctagcattgtctacacacatatagatgttaatgaacctaaacacatatttatgtctagattcattaacatctaaatgaatgtgggcaatgctagaaagtctcacattgtgaaacggaggaagtaataatgaagcaatggtttctacctgttctttatcatcccttctctctctgg

SEQ ID NO: 26735 - DNA, 1274 bp, Oryza sativa
agctggcttgaaatagtatcctccctagcttggctagctgctggctatgtgagaccagataccaagaaaggtggcagcatggatcctactgattatgtgaaagttaaatgtttagcatcaggggatccaagtgataggtatgttcttagctttgttgtttgactggtttttacatgtttgtactttccatcatatgaaactgatgggtgttccttttatgcagcaatcttgttagaggagtggtttgctctaagaatgtaaaacacaaacgcatggcctctgagcatgtgaatgcaaaattgctcattttagggggagcacttgagtatcagaaggtcacgaacaaactagcatccattgatactatacttgaacaggtttgtgttttcttcatggttgtgttgcatatatttgttgtttcttgttttgctgaatgaaataccattgatgcaggaaaaggagcacctgagggcaattgttgcaaagattgagtctcggcgaccaaatgtgctgctagttgagaaaagtgtctcatcttatgcccaggaactcttggcaaaagatatttctttagttctgaatgttaagagaccgcttttggataggatatcaagatgctcaggagcacaaattgcctcgtcaattgacaatattgcttcagcaagactaggtcaatgtgaattgttcaaggtgcataaagtttcagaattctcatcaggaaaacagacaaacaggaggtcaatgaagaccctgatgttctttgaaggctgtccgaggcgtttaggttgcacggtaataatctatttctgttccctaaatattccatttagattcatttcactaacataaattgataactccttgcttgtatattcaatcatacgcagtagtagcactggttctgtaattagttttcaattgaatatctcattttaccttttacactagttaaatgcccgttttttgccacgaataaaaatgaatcattcctgttcaaaagaaatgatttttccattgaatacactgaaacataatcacaattctgttacaacgggaactaagaatcaattgtaaaatcagcttgtacacattgtagggggagggtgtcagattcaccatcaccattgcattcttttcaaaggactatatatttctaatcaatgtacctcaacttctgcaggttctactgagaggatcatgtcgagaggaactaaagaaaattaagcgtgttgtgcaacttgctgtgtttgcagcttatcacctctctcttgaaa

SEQ ID NO: 26736 - DNA, 13742 bp, Oryza sativa
  unsure (1)..(13742): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatcggaaaggaaaaagtacaccgaaggtccctcaacttgtcatcaggataaaaaaagtactcgaaccgtaaaaccagatatgtggggtcccttaaataacaaaaccggacacccaagatccttcggtggttttgaccccggttttggtctacgtggtggctaagtcagtgtgggacccacgtgggccccacatgtcaacatgccacgtcatcactccctctctctctttcccctcctctccctttctcccatctctctatctctttctctctctcttttcttctgcaagctggccagtgaatggggaggaggtcgccggggcgacgaggtggcggcggtggctgcgacgcgggagcaggccaccacgccgggttagattcttgcaccggccaaactctcccgggatggtgctggtgaaccggttcccgaacagctgaagaaacttcgccggtgaaccggtgaggttgttgacgtccaaaccgagagcccacatagccgagcagttgtagaggcggctcgggatgccgccaccgcaactaccatcccactgtgcaagccgagccatcgccctttccaccgcttccggccgctccccgccggcgacacaggcctcgctcggctgtgctgccgccaccctcagcaccgccacgctccaccgctcctcggcgtccactcctcttcgccgaatacccaccggagtcccaaccacctcgcgttccggtgagttccgccccgagttccatcgccggcgttgttttcccaccgcttcggtcgcccgttttcctccctaacccatccaatctcttcctcaggtctcgccgatcctcggcctcccctcctcctgtgccggacgccgccaaatcgtcgtcgtcgtcctcgcccgagggacgccgccgcctcctcgcctccctccgtcggccacctctccccgccgtcagccgcttggtgagcatccctcctttcctccccgctcccttccatcgcttgtcggccgccgcttccggtgaggacctctcctccctccccttttttcccgtcctcctttcttgccggccaccacctcttggggtgcgccgccgtcccccgtgcgcgccgctgtcctccgcccgcccgccgccgttccgcatcgccggctgccgccgccgccgcaccttggctcggccgggccggctttgtgccgcgccagtggccctggccgctgctctcccctcgggtcgacctgggtcgtccacgtggtggacatgtgcccgaggccgtggtggaccgtgtccaccgtgcgcccttccccttgtgccgctgacatgtgggacccgcctgtcggcgccggttccccttgctgacgtccgcgaatgccttttcctttgagaaaataattattaattgcgtcataaatcggtaataattctagaaattcattaaaacggctcaaaacttctaaaatttatgtctaattcatacgaactccgaattgagccattcaagttgcaaaattcatctaaaattgggatctacatgtttttttactttttatgtactatttccttggtttttattagtgtttttcctcgttttgcacgccaacgagtagattccgccatttcggaagtctgcggtcgcaaagataagagttcagaagatccaagtaaagaagcaagggaagtcacacatttccccttgagcatgttgatcccaatttacaaatgttttaccgtttgcaaataaatatgcatgttttgctaattacatgggatcagggtttacctatctgctcgcttgtgccatgtttacttgatatctgtcatttgtcaatcgtgggtaataaatcgactagctcatgttacttatgtgacacatctagaactatatgcttagccatgcttaattgccactagctcagttgatgggataattacagttttagacctgttagtatcatgacgagccgcgtgctcgagacacccgaccatgttgcattggtcgtaattatctatctaaaatgcaactgaatggtgggctgtgggtgcatggttttgcgagtcgcacccatggcaattaagaccagtttacgggaaaccctggaagacttacagtgcttgccacaagcgggaatgggtaactgcctgatctgaagtatagctcgaccctttcctaggcaccggtggcgagggtgggcgtgatggagttgggtcggccggggtgtccaattgtccagctgccggattcaccgcggtgcacgaggggactgcctgctgccttgtgaggagtgggggtgaaaccttagcgtggtgtggatggttaggggagagttatatgaagggtcttgtcacaatcactcgacgtggtgacgtgttcatcatgggcacatgatgacacggtgacatgtcggtggattgtgtcttgtgcgtacagttatgcacctctggctagagtaaaactattcgaatagccgtgcccgcggttatgggcgatcgagcagattcaccgtgattagtctcacccctgataaatcgacccaatgcactgtagttcaggtgggttggttgggcctgttcaacgtggtgtagcattgatcaatggagatttaatattaccttaattactcaactgtcttactgttttgcgcaataaatgttttacaaccgcctttatgcaaatagccacaagccattcttgaattcccttgcatgtctgcattgttggtgtggcttgctgagtacagtggttgtactcagccttgctattatttcccccttttcagaagtgtagtgattctgagctgaagacgaagttagaggactaaggctcagaccccagttgagttttgcgtgtggagtggagctgaagcctcgttaggatcgcctttttccgctgcttctactttcgtttcagtgtgaggactaagtgcctcttctgtaagtattttacgctttatttatgtttgaaactgtatattacttgtcgctttatttacgtttggaactgtatattacttgtcgttttgtgtaccctggctggtactggacagggatttaatacacaaaatagtctggaaatttgggttaaatttctgggcgtgacactggtgttggcccatgtcagtccgacccgaccgtcgggccgtgtctgggcctcggcctcggcacagtgggccgacccagcatggcatagtccaagaaaaaaaagtctattttgcctccctcggcttttcctcttagttgagtctcatccccttgttgacaacataaatgttattcaatacacaataaatcaattacggtctttctatttgagtaaaaatataataaaacttataaaatccataactaactcatatgtactctgtttaactccattcaaaatgcagaaaattcataaaaataccccaaatccattcaaaatcctagtaggcttttcgctgacacactatatacttcatcttgagcaaattttgtaaatttttattatatatatagtttcatcctattgtgcatatgaaagaggattagctcttagattttttatgaactggacccatgttaagaaccttattcatattagctaatcttcagtgtgaaatcgttatcatctagtgagtaatgtctattcgctattgctagctcatgcacgcgatgaagtttccaaatacagacaatattaaaggctgacagatatgctagctatttgcacattagccaccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggccatggctcgcaacaaggtgaagttgcagcggatcatcaatgatgcgaagtggcgggcggcattcaagaagcggctcaagggctagaagaagaaggcaagcgagttgtcgacactatgtagtgtggatacatgcctcatggtgtatggtgagggcgaggtgcaagcaacagaggtttggctgtcggtgcaggaggcgacgagggttcttgagcgcttcaaggccatgccacagctagacagatacaagaagacgatggatctggatggcttcatcaaggagcgcaccgacaagctccaagaaaagttgcacaaggtaagacgtgatgccgatgaaagcgagaccaagatactcatcgttgaagccttctatagccgctgcgcaggcctcgaggatcttaccattgagcagcttaccagccttggctggatggcagatgcacaactcaagatcgtcaacaactcagtctatccgtaaccgtgccactgaaattttacaaaattagaaccatgccactgtcgtcacgttttccgtcaatttccttccttttccaccttcttccttctttctcctgtcttcttccttctttctgccatagcgaggttgagcgcgtttgcgattagcacggtgtccacacggcttcccgcgtcagtgcagccagcgtcggccgtagcgacatcactattcccgccatcgtggcggtggcgtgcccgcccgcgcagagccccatcttcggggccgagagccccatctcgtggcatctttcccttctctctctcttccccgtcgcatggttagcgggaggcgcggcgaagcgcgtggtgccggtgtccaagtgaggcggcatctcggacctcatttcccccctctctctgtccccaccccttgggtctgatcactctgcgtcgaggagctgtcgggtccaaagctagtgccagggtcggccgctgaagccttggggggggggggggttcctcatcgtcgcaggctagctccggccgctgtctcacctccttctcctccatctagcgggctccagcaccagcgccttgcctcctccactgccgccggtgctagcaagccggctctcccgctcccgccgccgatccgtgcgtccccaccttgccgtcgcgatctttttaactaggaaacctccacatcatttagcgatatttagatcatacatgttgcctgcggaaaacgtgagacattaattaggagatcatatgctctatcgtgtgttacctttatccgttataacgcacggacatttttgctatattcattatattaaaagttaaagcaatttatcaagtactacctctgttctataaaagttgaatttatagggaatcaaggatagaaaaacaatcataataaccttattatttaatgaatacagtgcacgcacacattctatatataaacttaattaacatgaaggttgagacttagagaagggatggaaggaagggagattaaaaggaaatatttttttatgtaatcaatttgctgggtcccacattagtagaaatacaattttagatagaaattcaaattttatgaaacggaggtagtaaattaatgtgggaaataaactttccttttaaaatcatggctgagaatattttcctaatattcttcattccctaatatactctataattttccttaaactttcatagtaaaaaacaaaggaataagttcaccggaggtccctcaacttaacagcgagaatttttgaggtcccttaaccacaaaaccagaaatgtttacctctaaactcacacaaaccgtgcactcaagatcctatagcagtatatatggctggtttcgctgacgtggcatcctagtcagaaaaaaaattaaaaaatgtacgtgaggcccacatgtcagttgcacatctcttctcttctagttttattctcctcctcttctctattctcttcttcaggccggcagcaggcggagagccggcgggcaagcgcagatgaaggcgacgggcggagagccgtcgggctgctgtcgccggagctgcatagccggctcctctccgaccaccgcgcgcccttgctctccctcctccgccgccaggatgacgagctccggaccaagatcaagaaccacctcctcgcgctcggatggaccatcgcctccaaagcccagcctccctggcctcgcgcccaggctccgctacgtctccctcgccggaagcatgcatgctatttgtatgtatgtatgtatgtatgtaagctcgctaatggccaggtgattagcgagcttaggaaatgggctcagcaaacaccacctcatcctggaaggcaaccatccatcatcataagaagtcaatactgccctggtccatctcctcgtggaaggcaacctcgcccgcccgcagcacccctgtgtccccatcacctggccgatctgcttaggagcatcgtcaaccaacgcctacgtcggacttccatggcagctagcacagccatcctcggcgccagtacgatgtacgccatcaactcatcatcagacgccagtcgccgacgatgctacctccacggtgccaccacgttgtcaagacgccggatgtcctcgcatgtgcggcagctgcaacaacaagagcacggcgacggcgatggtgcctccgcccctggccacctctgccgcccacggcctgccgactccccccccccccgcgcgccccgcccagcgctcccgccgccgacgacgccctccccttctcttgcgtcaccggccggcgccgccggcatccgaacctctcgtgacccgtggcccgtggctccatgcacgcccgccactccgctgccgtgctcgcccaccgatgctctgcccggcggtgctccaccggtgaagaggagaagaagagaagtgaagaggaggagaaaagagaagaaaacatatgtgaagctgacatgtgggccctacgtacttttaaattttttttctgactaggatggcacgtcagcgaaaccactcacatatactgccatagtaacttgagtgcacggtttatgtaagtttaggggtaaacatttctggttttgtaattaagggacctcaaaaaatctcgctgttaagttgagggacctccggtgaacttatttcaaaaacaaaaggagagagaagcaaggtccatcgcttgggccgacgtcctcccccctttccttcttacttgggccgacgctcccgcacggcccaaggccgcgctagcccatccccatgccgaaccagctagcccaaggccacgccagcccagcttgcccgcgcccctccttcagtccagcccactcgtcaattttgtccccctcctctagcctagtccactccctcggcccgtagagtaaaacagaatgccaaattagtgcacgattaaggccctatttctttcatgttaggattattataatctagattattgagagtaaactgaaagaaacagataatttattaaagtagcttattataatctggatcccagcttattataatccgataagctcatttatgtgagctttttccatattattgggtgaaaaattacccaccatgccaccccactccttctttaaacttgtaaacccaataatctagactctaataatctaggaaagaaacaactaaccgcctattctactacatattatagcttatagtaatctgactcaataatctagattataataatcccaagctaaaagaaacagggtctaaaccagaatgtcagattagcgcacgattaactaaatattagcttaaaaactcataatataaattaatatgatttttaatgaaacttttatatagaaaatttttttgggaaaaacgattgaattccattagccgataggcgaaaccgaatttttttttttactaggagagcattgcaggcgaaaccaaacttggctttggtttttcctccctctcgaaggaagcattcctcgccactctctctccatatgctgcccgccaccgccaccgcctccgccgcgccgccgccgccgccgccgttgccggcgtcccccggcggcgagccgcacgccgccctgctcctgtccctggcctacctgccgctgcgcgagctgctgtcctgcgcgggcgcgtgccgccgcctccgcgacgccgtcgcgggggacccgctcctgtggcggcgcgtcgcggtggcggcgccgccgctcgcccgccggctcaccgacgaggcgctcctcgcgctgacggggagggcgggggggacgctccggtccctccgcctcctcgggtgcacccgcgtctccgacgccggcctgctccgcgtcgtcgagcgaaaccctggcatcaccgaggtatatagtgggagggttttcccccacaccgcatgttcgcttcattttggtttgtgagaaaagtttggattagggaaagatctatagatgctttgggtagttgggtgttgctcgcctaatgtttgctgtaatgcctacgcaccgtggctgctttagctttcagcagtttggctcatgttaccgaaatcgaaagaggggggaaaatgcaataatgtaatgataattgatcaagttaatttgaattcattacaatttaaacattacatgtttacaaatacaaatcgatgttagttgatacttgatacactgtactttatcgtgtttggagcttgatagacttatgttggtgttcatgccctcagtaaatagcaccccccagaaagccagcgcactagcattttggacttttagttatttctgtatgaaatactatttttacacgaggacaactcgacatggagcttgaagctttgtgcttcgagagagaatgcatgttattgttattccaattcctgtgatatggacctttttgaaacaacactagtaatcttatatggtatctatggtggcaacaaaaggtagtggttggtttcttgcttggaagagataaattaattcgttgagcacattactcaatcaagtgtgaattctaggatcctgcttgcttgggtgcccattttgtatcctgtgatctgtgttaagtgatcccattagatactaacattaacatccacactagtcgacgctggatgacctctccttcgcatttattcgttgtaaattataaatataggtcaatgtgacattaataatattttttgttcgtactaaatgtaatagtaaaaaatagtcttagtgtcttatagccaaccctttagtgaaagatgtgctagagcaacaattttccattttgctgttcttggacagtgtgatctcattacccattaaaatattattattttttgggtgtcctagtattggtatacaagttagcaagcgagtcttcataaagttactccatactatggttttggccactgcttccaactttaggcttatatataccactcagtgtgctacatggtacatactgtgtaagtgaaataaagggttccgagatcctattttatgagccttttttatcacagattcctgcactttggaattgggataaagcaggtgccagatgaatagaaatcgatgcctaatacacataagaaaccatagataaataataccagacacagaacattcccattgaattgacaccacgaaataataagaatttcagtttgatcccatgggtataacagtacaaacatctgattgaattattgcctaaggctttaagatggtaacactgatcctacacaatcttgggtaaccacctcacgtattttatacatggttgtttgatgttcttgctgattaaacttgattttaacaaattttttgtgatctcagacattctgaatgtttcatgtatgcacaagatgcatctcattgtgcagtatgtttttggaattcacacgaaacagttaaactagtgcgggaaactggaaaagttattgggttccaaggctccgagcagggaaaagttcttgatttaggactctttgttaaaagatggaataaatggcacaccatgctgggtttctcttactcactttcgctggggttgagatttctctatacgtcttgggttgtttcactaaccttgctaactgcaatagctactgggattagggagtcaacagtatctattgtaattttgaatttaatacatcaaatctgcagtggattgattgtatccttgagagatttttccttggatatacaaccatgtacaccacataatactggaaaagaatgtttatcttgtcaagaaaaatatggaacaattagggcactgcagtatttgtgaataataatgtataggtcttcaactttgaggttgccgtattatttcccttagccacctgtttggggataatatgagatacatttgccttggactttggatgtaccaaaccttatatggtaaaatgtggtgcagttggtcaatactcaatacttactgctccctccgtcctagaatataaggatttttagggttggacacgggtattaagaaagtaggtagaattaaatagaagaaggttgtgattggttgagaagtggaggtaggtgagaaaattgaatggtggaggattgtgattggttgagaagagaatgttggtgaagaagttgttatattttgggacggagggagtactctctaatctacatcaccctttgttctttaatcaatgaaagattctcagtatggagtctagtacgctactgaaggacaccatgatctcaactagggctaaaatttacaaggttagttagaagattgccatgactaacttcccatagcctttctaacttttgaagtgagcaacattagacatctcacacacatgaagttcatttttctcttgtttttttttaaaattcaatctaggaactgataactgtcatatgacaatttctgataagtactgtaaaagcaccaaaagttccattttaaaaaataattattgctagcaactagctgggagcaagttatctagttccattccaaaatcatgattgttgaccacaatttttttatggagcaatagtgagtttgttaaattgccactttcagttaccagaatgactttggaggttctagttctaagaaaacatgggaaataattgcatgagctgatttgttgtatgaagtttgaacttgctttacctatatatagcactgttgacttaacgatgctattgcacttagtttttatccataatagatgctggccagaagttacagtcttctattgcgtaaatctgtttactactgcagaatgctaatatatatgttcaattttgatgctttgttatttctggaagatgaaatcaatatcatatgctcatgaaaagtacatattcacttcacgtcgtaccacttacttctatgcaatagctttagtgacctttgggtgcatcttatctaacttattctttaacttgcagctctatatgcccagatgtacaggcttgactgctgaaggtgtggtgaagattgtccaggttctttatgaatgcaaggggaatctaaaccgcattcgactccatggtatttgcaggatgactaagcatcatcttgatgctatcagttctgccatgtgcaagggtaaccaacaagaagatgatcaatcacttttctatagccacagagtccatgaagtgctcaacaccaacgatgaacgccgtattgatgttgatgtgtgccctatgtgcacaaatgtgaggctggtgtttgattgtacaagggatggctgtaggtttgtaccttctgatcttttgaactcttatttgctctttgcttcgaaaatttcccttcaaatttgttgaaagtttgccactgtttttcttatttgcttattgacaactcatctttgctatatggtcacaatattcagtgcctttagatatttgatagtgttgtctcctgtggttgtggaatagctgacatagggatctcatctttcctggaaagcttttaagtgatggtccagaaactcatttattctctcccctatgggctacaggaaagcaactgcacaattaatttttatttggttgctctcgtctttggaacaactggttcaatatgttaaatattcttcagtattttttcaggtctattgactttgacctgaactttgttcgcatttctacaaaataaggtttgatctattttgatgatttatttatatttcaggagaaaggatagttgggctcaatgtcgaggctgcttcttctgtgttgcccgatgcgaaacatgcggtgggtgcatcgacttggaggagctcagcgagactgaacttgcatgctcggacttcctgtgcatggagtgctggcttccgctcccgaaatgtagcacttgcaatcggccctactgcaagaggcatgaaaatctgaaggtagatttatcaccatctggccagtttacttgtcatcgttgcgtggaattttctagtaactcacgcgagaacctggaagaaagttcttagaggtgagttcctgcccctctacaggaaatacaagttgtcgagtatacttgggtatgaaactactgtctgtgtaccagtacttgctgatgacttttacttaaagcgtcaaatgtactagactaactaactgagtgtactggaaatctaggattctgaattatttattgatcacgtcaaatttagcgggtgcagacttcatggacttgtgcaacttgtctgaaactctgaataacactgaaacagtccattgccctcaagtcccatatgcctatggaatgtgtttaaccttccaggcttccagctcagaatgtgctcagcatgacagactgaaggacaccgttattaaccgccatttgtcattttggagcgtgctgtactctgtctggctgccatttgcgcctataatttcagaattcaaatgatactcctgcaagaaatgctactcgactggaataccttccatcatctgttcatcttttacaggaagaagatacctgtccctgtactatttcgaatccgagtctaaatttgagtagtcaattgagggtttagatcatgttttgcgataaacttgtacaatattgaaatactcgacagttgatagcactttgctttccaaaatttgttccgtagtctatatcagtattttggtccctcattatcttggtcgagagagggtcactaacaaaataaccaaaatgtaccttttctaatgcgattgtttttaactgcacatccatcttcttttccgcttctttaccgaattattgtcatgaattgtttactccgtgcttcaaaaaacaaattttcttttttttttaaaaaaagaaactttcttctactgcgttgcttggactacttgttttaaagttattagataagtttatttctcaaaatatgtaatttattcttacaactaaacagattactgtcacgataattcgatgaataatctgtttcaaatgctaaagcagatcagcggcacctactgaataatcccgtgtccatccctacttttttttagacacaatttctccatctccctcgaggggagcaagccagcaagatctgaaaaagggttttaataaaagcataaacaattacttcaagttcatgcgtctccatttgctatttgagcaaccattttcaggagggaatccaatagttggcacggtgaagtcagagtctag

SEQ ID NO: 26737 - DNA, 2334 bp, Oryza sativa
ttcctttggaatataggaattttacaggacttgaggtatgttccttttctcttacagataataaattatcacattcatgttttcaaagcacctaaatggtacgtttttttttggtaaaaagcttcctatttctatatataagtttcttgtaatacatctttagatcaacttttaaattttgtataactaatttattcacatgaaacacaagaattttacaagggccttcttcttttcctcttatagattacaggttatcacagtcatgctttctaagctgtgatttttgcaaacggtttctacatatataagttccttagaatactttttaaaatatttttttaactttataatagttacttcattcgcttgaaccctagaatattattttagaaagaaaatcaaataatccatcatctatttatccatttagaacaacagaactaggcctaattagttcagtcctataaaaatactctgaaatttctacattcctctgagtgatgaaacaggtggcagcagcagattggtcctccaaaattttgacatgtgaaaaaggaaccttgctactacacccttcaccagtgaggttccaaggcaaggcatcactgatcagtagttgtgctgttcccatctagtcccctgcttcttgccatgaactcaagtgaagggcacctcctttttcccctacacacaaaataaataaataaatcagtgctactaaatcacaagctggaactttttttccttttttttttcgcgtcggtgaccgtcttcaggtacactataactaaccaccaaaatccatgacatttacatgagcactaacaccccccggagcacacgcgtcatgggagacaggatttgcagagagcaacagcccaagaaaaggggcatgagctttgtgaaaattgtgactctgggtggcacatatgtcactgcaaaacttgttgcatgaacagggtcagaatgtgagttggagcaggaggaggaaaatgttggttgggagaacacaatctttggaccactaacagtctctccatcatgtatggtgatctgatcatctcttcctttgtgtggaattgaagtggattcagaaaggggaaaaaaaaagaaagaaaaggagctgccttgcatggcatggcaatggcacctggccctcctcatctttcagggtttcacatatcccaatcaaaggcttaatagcacatctaattgtctaatgataaaggatgatgggaggcaaaagtacatccatgatgatgataataataataatctctggtttttgtatagtaccatgtttttcagctttgagtggcgaaatttgacctcagcgcgacaccgagacgcggtgtactgattgatggcttgttctagctagctgaagtcagagggtgcccttttcttttttttgaactgcagtcagatgatgcttttgattgtctgaaaggatacttagtgttggtgccaaactgcccaatcaagatatgccagggaaaagaaatgatgaagtgcactactttaccctaaattgacttgggaattcaaattaagcatgcagttcttcagtcaacctatgaagtgatcattcatgttcgagaaaaaaatttgtaaaaaataagagtgtttttacgatggtctctaccagcagtattctacgactagtacagatcacaataaaaattgtcaaaatataaacgggtctttttgtttactgaagaagatgtagttgatcattccgaccttgtgtcctgaccggcctgaagtgaagtcttgatggatactgttaagttggtcgatcagttaaaatgaaggtcatctagtacaacaaaataatggctttcattgccaatcaatctattgctggcactactacaattcagaacacaattttaccactcaaattactttttactcactattcatttcatttaaacctataaaaatttagtcgaatatcctccaccgtcatcgtgtcgcgatccgcaatctctctgtatggatagaaggaagaatgttttggatcttagctcacagacttttgtgggcaatttcatccctgtgatatcatgggaagtttcatatgttgacaagggagagtgagcagtgttgacctcaatgatcattcaacatttcctgcctgctggaagccaaaatcttgtccaacaagccgtactccatactgcggctacatatacctctgaaattgctgatcaaatcttcaaaaaaaattgcaagttctacacgcgcttgctcgatccgtcgcggccccataatttttcaccggaaaaaaaatggatgaaaatttttaaccatggtaggacaataagg

SEQ ID NO: 26738 - DNA, 4917 bp, Oryza sativa
ttaatcttgtcaataactgttttcacctaaaaacaggtagtagaattctctgatctcacgtaaaatccatccagggcaaaaggtagaccagaggataattttgtcagaacatgagatgaaagtaaagggagaagaaaagaaagcatggaaactttgtagtgcagcacttgcaattgcaaagcaagcaaaagggacccaagagcagaagctcatgcttcatggtggcacgtaggccaccctcacagccttcactgccgacgcccggcccgggcccaccgcgcagcctcaccggcctcggacacgtgtacatagagctagtaagcaaaataaaaaataaaaaataaaaaaataaagagagatagaagcttgaactacacatcagtacatcacacacagagagacccttggtgcttactacacatcagtagttagctactggctggtttgttttgtctcctcttcttgcctcccccttataaaggaaggtgagcattgcatcttgctccttagtactcctcctcctgcatcatcatcccaatcctcaattcagaattcagaactgccatttgctaccttacataccatacctagctgaattgctgtcagttaatctcttgatcagatcgatcaccctgcagcttcttgttgtttctagcatttctggtgaagaaaccaaatcttcagcagcttaaggtaggagatcatcaatggggaggcagccgtgctgcgacaaggtggggctgaagaaggggccatggacggcggaggaggaccagaagctcatcaccttcctcctcaccaacggccagtgctgctggcgcgccgtccccaagctcgccggtgcgtcgatcgagatcctcgtgtcgcagtactactttatgtgtgttttggctatgtgcatcctacgatcgaggccgaaagtttatatactttcattgtctgaaaaagggtatgtttgtaataaaattatagggcttctccggtgcgggaagagctgcaggctacggtggacgaactacctccggccggatctcaagagggggctgctctccgacgccgaggagaagatcgtcgtcgacctacatgcccaattgggcaataggtacgataacattgtcctcgacacgttgggacaacatgcctgaacgtatgataaattagttttttaatgtatatataaccatttttatatacaaaacatgttaggtggtctaagattgcgtctcatttgcctgggaggacggacaacgagatcaagaaccactggaacactcacatcaagaagaagctcaagaaaatggggatcgatcccctcacccacaggcccctccagccgccgccgtcgccgtcgccagagaagaagcacgcagagagaaagaacacggcggcggcggcggcggtggccgagcagcatcagcacgacgaactctgggaggaggagtccccgggattctgcaccgacgaggtgccgatgatccacccggacgagatcatggtgccattgcgcgaccacccgccgccggtttgcacggccgccggtgcctcgacgccgacgacatcgtcgtcgtcgtcgtcctcgtcggtggcctcctcgacgacgagctgcgacgaggtcgacgccgcggcgctgctcccggtcctggagtggcccgacgacgccatgtgcctgatggagctcgacgagctgatcgccgcggcggcgccgccgtccctgctgtgggacgacgactaccgcctcccgctgccgccgccgccgctatcgccgccggcgatgtacgaggagctagacgcctttcagtgctacgaccagcagaggagcgcgtttgagcaggaggcagcagcttcagcgtggaacaagcttgagctcttctaatcaatcaaaattaaactctgtaaattatgtttacagtgtttattataatcaataattaccgaactaaaacagaacagtgttgtttcattgttctagtattgcctctctggttaattgttccattggaattgcattagtgtagtgatgtgaaatgatcaatgttctcagttatatattgcagaattcgatcagtttatgtcaaaaaaaatcgatcacttactaggcaacttcagtttttcttttttttttaaaaaaatcagatcgatgaaaattgtccctgcatgtgtggggtagtaataatccatgatattataatttcatatctaaatatgaccctgtttagggaagcttctgcaccttctcccagaatcagaaactcctctaaacagtctagtttttagtccaaattctgagaagctgtagttgtagaatccaggaaatgaactacaagctagaagctggaaaacccagcttttccatattcttggaagttgctaccaaccagctgcttctcagaattttaagttccccaaacaggctttatgtccctgtggctgatctttgtactttctataaaaaaaacagaaaattcagcaaagagccaatttttttcttagaaaataggatataaacccgacctctacatctaaccagatggacacaaccgagcataaagagcccaatgagagttatggatttacaggaaaaaaaatgttgtttgctttgctcttttttttaagagtaattctacggtctttgaggaggtaccatgactccatgaggtacctcataatatctaggtatcaaatttacaatagaaaaaataatacctcatggtatcatttcaaggactgtaaaattgctttttttttatgtcatgtgcacttgcacgcgtgcatgcagatgccgtaatgctaaaggaaaataaattcaggagagaaattaaagaatgagacctacgtatgaacaattgagaggagagagatagatgctgatggttgtagctagattctaagaagatcctactagctaccaaactctccttgagtgcagtgtgctttgtacttcacttcattcatatcccaggtgcaaaaggacaataatcaagtcgctggatctaaagtactcccatgggataaagttgtgtgttatgtgagttaaacataattttgtactttactatattctaaatcttatttatttagacgtgtgctataaatgtactccctccatataaaaaaacaacctaaaataatatgagatataatctagtataacaaacagatccatgtccatatttgttgtactagattatgtcatatcttatattagattgagttattagcggtttaaaagttaatactaagaacaaactaagggataaaaataactcgatcgaatgttaactctaaatttagattttaattttgaattccatggcggctaataagataataagtaaacaattggaagcgcaagtagattcaaactttctctcccatgattttacaaatttcactaaggttattgtatttcaatagattttgaacacgacttatcactagtgatcttcctataagataaattttagtgttcctgacggttagagcatatatgatagttgtagaaatattaggataagattaatttgtttagaaccatttcttattgctaatcctttcatatctctactcatataatctttatacatatatcatcccgagaggccgagacccaatacaatcattcagttacatactatatttctcttcctatatatttatcattgcttcttcgatcgactacggatatatatacccatagtggaagaagcagtgatgaatatagggagaatagctactttagtccctaaagtttctctgtaaaatcagtttagaccctaaccttttaaatggtccaaagaaatccttaacctttttcataaggcctagaatattcgttgggtccaccaaaatcatcatatggatatgccatgtcatcattcatgcaaaatcaataatgaattgtccaatttacccttacgtatatcatagaaaaataaatataagggtgaattagatataaccataggaaaaaaatacttctttttttcacccttttgaggtatatttttgctcttacaaataccatatattttttaactttttccttttgttttttactttcctgtgcgtaagggtaaattggacaaatcatatagattttgcataagaaggtgacatggcaggtccatgtggcgattttggtgggaccaaggactatattagcccacatgacaaatttaaaggacttgtttggacaatataaaagattaaggactaaactaatctaggagcgaaactttagggatcatattaactattctccaatgaaatatatatatatatatatatatatatatatatatatatatatgtatgtatccagcgtgcgtgtaacagcacagtggaatacatatccaacgcgaaagaaggaaagcagaaatagtttctctagaaaaaacataaataatataatactaagatcatccatgacgcatgatgatcatccttagccggacacacgctcacggctcacatcagcttctttctacgtacaatgggagagaacgaaagtcgcatccatatgcaaaccagctagtatctctttgctcaaatccaaaatttgcatgattggcgcatacaaattcaactgctcttcttattttttattaattaattagcttgaatgcggcttgtcaatcctcgtcatttcacttaataacattattaaccgagaggttctgtatactcgctcgatataaaaatataataacttctaactcttaaaaattaatatgtcttaaagtcgatttcttcactaccttccacatcttaatctatcacaataattattttttaatcatagatatgtccacttcccaaaaaaaagattatagatatgaccactacctagtgactagttggttaattaggttatgaaaaattacatatatatgtttgtttgagctacatataaccaat

SEQ ID NO: 26739 - DNA, 697 bp, Oryza sativa
ctcaaattaaactctatcgatgagaatcgtttttctttccacttatacttcctatattattcttttcggtttaaagattatggattactgcaagtttgcttcctaaacttccaaaagcgacacttattcttacgaaactttcttcattagtattttttagaaaaaaagatttaaatcaactttttaaatgttcaatattttatttattcgtctgtgcccttaaataattttcataaacttagttgtatccatcacccataaagaatcttagggtgctttcttttctcatatttctcaacttctaatttttctgtttatcaactagctttattttaaaagttctatgtaaaagttgcttaaaaattacattaatctatttttaaatttttttaattaatatttaattatttatgtgctaatgagctagtccgatttctatatgagaaaagttttcaactcttcgacccgaacgcagacaaaccgggcagaccggacagacaaaccgggtagacagacaagagagtttggaagagcttgctgcagcagtagctacactgccttcgtaaaaaaaaaatcctgattttaaagccggacaagtgatttattaaagtatgattaattgtgtattaattattttaaaatttaaatagacttgcataaatttttaaagaaaattttcgagtaaagtgtacgggcg

SEQ ID NO: 26740 - DNA, 2406 bp, Oryza sativa
gagacttcattccaacaagttttagatcgttcaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctacgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtagcgggagccacctccggtgactcatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcccgcccaatggagaaggtataaacatgtcatgctcattttcatcttcctaattatgcgcaccacttctgtctgctgctgctccacttcctgattcttgctctccatgcttcacccaacatgtatagccctccatgaatcctcgttgtatcagatgaccgtgtacgtcctctgcgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagttatctctatcgggccttaataaaagaccgtcaaaaaagagtgtcatctgtgacgggcaataaacttatctcaatcgggcctctagttggagcccgtcacagatgaccctcatttgtgacgggctt

SEQ ID NO: 26741 - DNA, 3046 bp, Oryza sativa
gaaactttggcccgattgagattacttccttgtgacggcccgcaaattccagtcttgttatgggccgtcacagatggaaggatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtgtaagcttggaaaaaaattggcctttgcaaaaccacctagtggaggccacataagctagaaatcatgaaacatgagaattatttggacatttatccaaccaatactttggaatatctaaacaaagatagttttgccaatgctttggtgcatggaaagaaaatatgttgataaggctgtgccagattgctttggcattttgcaaagttaagttagcagttttgtaaattatgagctaggtaaagaatcttttagaactgaatttgtatgggacttgtagaatgtgttacacaagtcacaacttacacagataacaattaagagtatgagtcattgccatatgtgaatgattgagaaggtaaacttggatatttgtaaatgtactttaatagcatacatacatatgcagtttggcatgtatttggagttttgttaacaagaattggaagtaacgaacattgctataaagggaaagaagtaaaggagaaacaaattttgggtccatcccaaaaaataaagcaatgattagagtttggccatactctttgctatcctactttccatgtatctagtcctttatcttacaaataaagagaaatgaggaagtaaacatatttcatgtattcatattatgacgagacacatttcttaggcagacactactgacactatgcaagtattaagttgcattattttcaaatttaactatgtcataattatccagttcagaatcttcatgcttttagttgcattataaattgggatggagaactatacaatgtccatgttcataatcttcatgcttttagtgctatagtaatagagttgttccaaatatgatgtatagatcccgaaatttccatcctggattgaagaaacactactaaaaaacgaatttcctgtacgagcccctcgttagattccagacggtccataaatgaccgcgtctggaaaaatcatcctcccatttttgcgtgcggacccttaagaggacc

SEQ ID NO: 26742 - DNA, 3699 bp, Oryza sativa
acgcaaaaataagcttatttttacaggcagacctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctcatgggcggcagcggagcggcctcgcactcccccggtggcggccgggagcggtggcgggcggcggaagcgcaacctcgcgtgcaagctgcgaccgggaccggcagcagcgcggcctctcacacgctccctggtggcagcgcccctcgctcgcccggatctagaggcggcgcccctctcctgcccggatccggctgtgggcgccggcggcgacgcagccgggagcggcggtgggctcgggagccggccgcggcggccgatcgcggcggaagtgtggcgacgctgacaacgacgatgacggatgacggcgatgacgatgacggcggatgacgacggcgacgatgacgacaaccacgaggagggcgtcagcttgggttagggtttgaatattatttttttggggttttttttcgtgcgggtgacataagccaccctgattttcgcgtgcgggtgcatcgcccgcacgaaaaaaaatcagatttttgcagacactttggtgcagacaggcaggagatccgcatgcgaaaacccttttcgactgcacggaaaaattgttttcgtagtagtgaaaaattcaaccccactccgaagccatacaacaactcacaaattgcaatcgggttcaatgtggtctgccaatccagatgactagattgtgataaatctagggttaaggcttcatagaagatagaactgattcatatgctcaagtgaagtattgttcattgcttgagtagataaaagttccaaggacatgattttcagtgaactggatggagaaaactattgcacatgtaagatcaatatattgctgaaacagaaaagatctatcggacatgctggcaggtaccaatgtactatgaataaaccatcctagcgagtacttatcttgttaacatgttatatgtatactaatatatgtatagtgccagctcattgaactcaaatacaacaactatcgtttgacatttatcatgaataccttcaatgtgatcttccctcagctagaatgaagttttctttcgctctcatgaagttactctactaatgagatgtatatggttgacaacttggcatgcattttccagtttcacaacaatatgttcattatttaaggtccgcttgcaaccttataagggctctcgtatagaaaaaaagtcatttttatagtagtgtcataaccggggagaaatatatactactaacactataccaaaatataacaacttttagccgtgaatctatagataagtatttgtacggatttgtagctaagacttatttaattttagaatggagaaagtacctctgtatttaaatatacaatgtcctaggtattatttgtctttggcatacaattttaaccactacatgtattattagaacatggcgataatatccaacaaaactatatattatagaagtatttataaaaaaaattgaccaaaaatgacttatatgtttgcaagctaaagattttgagagctattgaaggtaaaaattgtaaaattttgaccaaataaagttaatagtgttatattttaaatatggaggggtactttcttttatatcgttaatttttcacaacgatgatcatgaactcttctattttgatctttggaccataaggaataattactccttccaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttcttccttataaagagtgagcactgaattaatttggttgcatctattaggtcaagcagtagaaaagatgcagcacatggtttgtaattgagtgcagactacactgagccaagataagcatttagtgtcagaaaactccatatgaggtctacaacgattccaacattttgatcatactataaaccatttacatttgttaaattgtgacaacgaaaagggaaaaaaaagagaagaacgtggccatgcatgcacggtaacaaactgggaagcattatcggagaactgacacacatatgacttggtgagactattggtattagtttttattataaatcaacaccaatgagtgcgttagatgccgattcttaatttgatcccgtcaaaagggatcatctgtgtgagaaacctttcataggtgtcggttttaagtaaactggcacatatgagggcgttacagatgtggtgttcaggctatcacaatgcttgcacctatttcttgatgtgtcccactcccactcctacttctccatatttatctctactatatttgtactgcaaaataaaccaacatatatgtgccaggaatcacgactgttctattcatcaattacccaaagtggtaagttagacactgtcacattgcaaagttcacatgtaaaggtatggcttataagggagacgaggtgcttgctatggattccagagcttacatgagggaaggtagagatgggacagaatggcatatatgaacatgtgtaatcttaatatctagtgtgcacaagttaacctccaagttcattttgtgatcgctcaaaaaaatggtttattttgcaatgccaaagagaaccgatggagatggtattaggattgggacgcatcgagaaatgccgaggtgcaaatattaatattgtagtctaatgtggtttcctcttccttaatttgacaatctggaaggttatttttcctattctaattcaatgtgttt

SEQ ID NO: 26743 - DNA, 13680 bp, Oryza sativa
catgaacccctaatatttaaacattatagtcttgcgcctgtatggctatatgcctcccaaaactttgaaatcatcatacggtatagtgatggagcgatcgacgagccgacgagcattgcaaggttaggaacaggaggcgtttgggaacgtaccaaagcatgaaagtgaggatcttgaactggttgtgacaacacaagaggttctatcctgctagtccgtaatcatcatatgctagtttttgcttttcgatgtcccatttttcttcttttccacagtccctgcacatatttgatcctttgcgtgagttgtgaatgtgagaggcatccagtaaaacaacatctgccgaaaacacaagttctttcctctttttttttttaggaaattggagcggttgaaacacatttaaccattgtaatagcatattatgaacagatatctactggcccgtagataaaacccaatccaacactgaaatcaaccaaaatcttcatgctaatcacagttcccctgaacaccggaagtggggatttatgcacaatgctctggagcacatgaacaaaatattcagaattaagacatgaatgggaaaaaaaaagagatcaagatcatgatcatggacaattgtgctacatacatcatacatcatgttttgtttatcttagatggcctacaaaaatatgtaatacgattcctaggatattgccctgatttcacatactatgtgggatcagcttaagcaaacacatgctgtgatttctgtgcaactcttttagcatgctctctgaaaatatgaattctggtttttactgttggtggaagaattcagtaatcctatgaatgaatactatagtgagatacacatcatctaatcgcatcccgtaaattgattttttttttaaaaaaaagaaatttggaggctcaaaccggcccacaaaagtttgcacacaacaagagcccacactaggacagagagaaccacataaagtatggccgaagaaaaagttttaaacgtttcagaaaaaagaggtaagtttttaaggaaaagtatgaccaatagaattgatggaatttctcaatctgagtcctagatagattcatgtttaccaccaaaaagcacatggtggcaacatgttgcttttctctggggatgcagtttcatcattcaaatcataggccattgttttatttttctcgacgtaagaaaaattaataaaagaagaaacataatctccaaacaattgtgaaaggtactatatattcaaacaatataaatcatccaattgctctagacacagtgatcacaatagaagattaattattcttcccctactacaccactcttgacaatcttcctaccctattgcagaaacaagcatcctcgcattttgcacaaacaaattaaggggatggctacacacagatgaaaatgtactgcttttgagaaattaatatatttcgtggaataatcaacaattccacacaggatattaaaactggatcagatgcatgtatgttaatcttagaagatatcaatacagaagcatgtgcatctctatgaaaaacatttttttaataaaaggtaaataataaatatatgataaatcgacaaaataaatttctgggctagtcatgaattggcttagcccattactctctaatccacctataaaatggctttgcaatcgataaataacgtagccctcacgccgccgccatcgccggagtccgccgccgccgccgtacacttccgccggcggcaagggcaaccatgaagtttttgattccgccgccgctggttcggccgcctcctcctgacctctcctacatcaaccgatcgtaccgatctgtccgtcgacgagaagatcgagatgataatctaaggtgcgttaattcgttcattccttcgtttcaacgagatcgtacttacgtgccaatgcaagctgagatcgatcgatcgatctcagattcagttgccctcctaattaaaattaactagtagtaataactagtggggattttcttcttgctgttcttcagaaacatagtggtgcacctataccattcgaggagtcgcaaatccttgaatattacaagaaatttttggcccagtactctgactacgaggatgaggattcagaggaggattcagatgaggaggattcagaggagggggagaaaggcaagaagaatgtatgttaaaaggggggagatgtgattttatcacaactgtctgtctgagtgacagtttagaagaaatcagacgattggagtttagcgtctcccatttatctatcatttatcagttaatcggcgtatataagatgctatcaaattcatgagtaaatttcagaaaatctcaattattatggtcaaagtttcagaaaaccacgtgaactttgacatatggcacataacctcaggtattatggtcctaacatttcacaaagccacatcactaattgttttgacttgatttactaccttttaagttctacaatcacatcttaaatttatgagcattttattcctaactagaaaggtagcccgcgcacatgcgcgtgcaactaatttaatatgtgtgaaattttattacgaatatctatgtatgtgactttgtattaaaatattactttactatatataaattattatttaacttatttaatgtgctttcaacgtgggttatgattttcttctaattacccttgcagcacataaattctaaactaaaattacttaaaatcgtacagttttcactttatgagataatattatgtcgagacaatagatgtagttcctatgaaaaatttttgggtatttcaactacccatggggatatctttccccaaacatttgctcaaaaagtccaaatttttatcagattctattcgaaattttagatattttcgttctattagtcctgctaaaatatttgaatatttccatttagaatgggttttaaacccaacaattttttaaaacatttacataaattttgaattcttatcatgtccatttttaataaattggagaattccattctaccaagcatctttgaaatgatttgatctctgcaatttgggttataaatatatgtgggttaagcctacaacctgacatggggtaaaatcatctattctaattatctctctggaattgagtaagaatatgaaaatagaggtcatataataaatgcacatttctatattattctacagtaaatattatgaatttacgatgtagcatagcaagttttaccaaaaagaaataaatgaacatggtctttaattccatatggaattaactcactatattggtaatgccacctcagagttgtttcactgctaagatttcttggtgcatttcctcaaaaaaaaaaagatttcttggtgcaatccacatgtttggtactatcagttggatgttcaactgagcatgtttttttacttttaaaatgttgtctataaaaaattaacgctagatggagtacacattatgacataaaaattgttatcatttaaagatttttttctctaatttattagtgacttcatagattatatataattttatctcctaaaaatatcatttattgataaaagcaccaaaatcaaattgtataggcaaattaccccatatacatgttgagagaaattaattaagttgatagaaagttgttatgtgtctaatgggatacaagtaataggtctacaggctttattaaaaattaagatgtgatattttgatttataatgatgaattttcatttttgttttactaagtggatgcctcaagatggatgtgggtccggaatgtaatttttatgttaacatttaaatatactcaatatggatattaaagttgatttcactaagaaaatacaatagttcaaacaaatcataagttgaatatatgatttaaaagattatattattttatttatattgttcccataaatgttagtaagatgagaaagagaagaaaagggatcatgggagagctagctagacctgttatgtggaggtccatttgtggttttttcccatgaagataattttaatttcaattattataagaataaaaataagagaaaaggatgaacgatgcacaccatatagggataaggtgggcgagatgtttttcttaaataaattattgatatatttttttcaaaaaaataaaagattgatataatgactaaaataatgtgttggatgtttaatgtataaggctttaacattgttgggtgggggagagaggaaaggaggtttgtttctttttttaaataaaaatctcataacaacctaaattctatgcccatcgatttaagtcgaaaccaatgattagatgttttattcttaaatttttattatttactctatttacgaagtgttacagagtggtttacaaacatttataaggatggttaatgggttttaacgccacatatgaacgcgaggggagtttgggatgttttacgtaagaaaaagatatatataataacctaaaataatgtaaatcgatgaacgaatgttttatatctttttagattttctctaatttaggtgtcaaatagatgttcggtaatatttatatgatgtttaatagacttattaggatgggctagaggaagaatagatctagtagattgatggattttttaggcatgcatttttctaatttaattattatggaaataaaaaaacgaaaaaaaaatggaaacggagggatcgtacgtacgtacgttgctgatggattgatggaaagtacgtacattgcggaggcgtcggagggggattttattttaatgtaaaaataaatctaacggtcaaaattaatgagtccaccaatttaaatgaaaatcgatggttagatttttctattttattagagtgacatgtggcgtctcgagagcgtttataggatgccacatggcggcttaggagtgtttatagaacgtttaatggacttttagtatataatagatagaagatataaatattacatccgttttttctattttgatatagcagtatgttaaaatggttaacaatatgattttgtgaaactttaggatcataatacatggggttatggtgtcacgtgttaaaatacatgtggttttatgcaatttggatcataatagttagggtttaagaaaatttactccaaattcattcgtttgttcgttcattcattcaatgtgtattaattcaagtgttgggtgatgaaaaggaaccgggtatcgtgaagcgcccgccggaggcggctcctcttgaaggcgagcacgagtgcaagatggcaagaacagcaccaccgcaaggaggagaacataactcgtagtcccctctgtaggtaaaccctacctccgttttcccaatctgcaacgtgtatagatgcaatttatttaaatgatctacactaaatggttaaacaagcgtgtgtcttctctagtggcttggcttgttcatcctaaaataacccctcaaatctagttttaaaattatcctgcctatgcctttgtttatggacaaataatagagcagtactgttgggttcttatttgaatgtactttgatatggccatggttgtgtggttgttagcattgtaccatctcaaataattagcagtactccgaactgtctgaataaaaggtcccagaactcgagttagctgaatagtagattttttacatgttggactctttaacagaaacaatggtgcagtttcatggtctttaaccaagaaattaggtgagggcaggaatgtagttaaagaggggaaaaacataaagtacgtgtttagtgtcaaatcgtttggttgcggacattttcttaacctgcaatgctcaattgcacaacttttgcaagtcattgcatcacttaagagtttatgcagtagtagaatattttttctgtgtgtttccaagttaagagtacatgctctataagtataaataaatgaatcaaatcatcattgtaatacagacaacaaacataaaaggccaccaaatgcattattgttccggtgatttctcctgagggagagggaagaaccattttttttttcgctcagaatcaagttcatagctgcagttctttgttaaatatgacctatatttatcttcatcgcatgatatggtgtttttgtttagagcaaatttcacaaaaccccatgtttagaggcaaatatatcaccaagccctagcatttttttgcccccacttaacggcaggcacacaaccaatatactgtaacagctaatccagttttttgacattacacatagacacatgggcactgagctggcagcacaatccttgcaggcttgaggcaatcttgtcctctaaacatggggctttgtaaaatttactcttgttaatcttttcatccatcgacttcaaaatgtttctatccaagcttcgtgcagttcctttttaacccagccttgaggtttcgaactgttgcttacatagatttggtttggtttgacaggatttgatgaagacaggagaatgcaacaggagacgaacttgtgacaattttctgcattacttgtgctccgttacgtttcagtggcaactgaataccgaaactcctattgggcgattgatcgccaggggccgccaggagcgatcggatcgggtctccccctccctctacctagttttcttttttggcaccacattactttcctattttagtaaatttatgcatctaaagtttatacacctcaagtttacacatctaaagtttaaagaccaaaagtttataagtcaaaagtttatatatccgattcaaatttgaatttgaattcaattttttttatatatagtatttctatatatctaaagtttatacacctaaagtttatagatccaaagtttataaatcaaaagtttacatacccgtttcaaatttgaatttaaattatatctgattcaaatttgaatttgaattcaaatattttctatatatagtatttttatgcatctaaagtttatacacctaaagtttatagacctaaagtttataagtcaaaagtttatatacccgattcaaatttgaatttgaattatatctgattcaaatttgaatttaaattcaaatagtttctatatatagtatttctatgcatctaaagtttatacacctaaagtttatagacccaaagtttataagtcaaaagtttacatacccgattcaaatttgaatttgaattcaaatatttttatatatatatagtgtttctatacataaattttttcaactttatttttttatttttttttaatttatagtgtagtaggaagagaagaaggggaggaggaaggaaggagaggtgtgtacagggggcgtggggatcgatcgcttgatcgatcgcccattagccacactgtaatcgtaatgttgggtaatagcaattgtgaatcttattaggtaaaccttttattaggtggatcttgaaccatatgctactgatgtcgtcgtttggttttcagttctcatgcaacttaattatggcacttgtaataatgtgttcatcaagcattattgtagctttattgctagcgttgcaaaaaagttctcatgaaacaaagagcgagcagatctgttcacgagtgtatgattggtgctgtagccagatggctaatataatcttaacaaatttcacttaaaattttccggtatttcagatgtcggtacgtacggatccttataatcgtattccttcgggttatcgagttactgaagacggccacagtttgaacccgagtgatttctgtgtgagctttctccgtcttttttttaaggaaaaacaacactagattgtactttttcgtgggagaaaaaatacaacccctatcgtgccaaaaaaaaaaaagctctttctccgtctattgtctcaaccaaatgttagttttgatttatatttaagtaaggagcttaagcttactgtgcatggtaattaacaaattttaccaacaatctattattatatacttaaaaattcattaaactttttacaaacttttctaagacatcatgtgatgtttctacatacatcctaaaccgccacgtaacattgtctaatcccactattgattttcacttaaattggtggacctattatttgacattattagattagatctatacatatttcaattttcacttatattactatcggtggacccatagatcattagattatgtaataccttcctcatatataagagaatatataccgctgaagggagaaaaaaaaacatatatacatacagtatgtatgatttggaaaaaaaacaataaagattaagtacagttcggtggaaaaaaaaacatgtccacatacataagataaaaaaaaagataaagccacgtgtaaaaaataaaaaaaataaagccaacggaaaaaaaatcgaaaatagaattttcgaccatatacgataaagtaaaagaacatataccataaaaaatgatgatatttataatataatttatatataaagataaatatattatttcataaatataggaagttaaactagatcgataatataaatatcaaatatcgaaccaatggtctataaacgttcacatttgaaaatatttttaaattatatatccaatttgtgatatttgttgtatacctttaattaaatgaactattgatgtattataaaatttatattattgatatttgtagtatgtcttatttgctagttccaaactactatgctcagtactattattaatgttaaaatattaaaaaatatataacatacgaaataaattgtttttcaaagtaatagcttatttttttaaaaaaaagggttcatttcaattagattgttaatattaattttagaaataaataaataaaattcttagttgagattttaatatggatataacttcatatttaaaattcattgtttttttaaaaagaaaaactaaagagctaatttacaatggcacaatatatttaacacgattagtatattctgtaggataaaagaatgatttaggatattatatttaacacgattttatattctttaggtataagggtttctatgttgcgataaatattcatgatcatatttgtttcagtttgtattcactctatgactatattcgataatatttgattatgtttcgaaatccaaaatagaaataaaaataaatatggtagataccttccatccgttacaaagccgttttcatccctaaccggggctccactgaccataggcctggatggcggttggtaggattgtggtggggtaactgaggcaccaacaagttaagttgcgagggacagaggatggcgacaaggaaggggactgtgcagcaagggaatgatagaagttcaggtaaccattatatatgggtctcatcgtgtgaaggaagatgaatattgggtcatcaggtaggcggccatgggactctcaagtcatggctcgagagtagaagagaatgaggaagggaaaaaggacaaaccgtgtgtgatcacgcgtttcacgcagcggcgcatgaattaaaatcccctggctcatgttgacatagtaactactactaactcaggaccaattttttaattaataataaataatattatttaaattaaattattagtaattagaggataacatttaccaaaataagatggacactaatagaaacagcgtccagatgtggacgctattaccattaacgtacagatgtggacgccaattggatcgacgtccaggttggtgcggtcataacctggcgctaatcatcgcgattagaaaaaagaaaaaagaaaaatcccccaacgctagggcagggtgcctctgccgccgtccaaatcgacgccgggagtctgccgccgccgccggcgtccgcctcaacctctggagtctgttcctccttctaactgagcgtagggactacccacgaggcaaatggcgcggcagcgctaaggcagggggctgccgccgccgccgccgccgtcgtccacctcgatgccgggagtccgccgtcgccgtccaccaccaccggaagaccacgccaccgcctgaatcgacttttgaagttctgagaggtggctgccgtcagccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttgggacacaatttatggatggtaattacaggagatggagaatcaagaaccggcttcacaacttctaaaaaaaaaagaaccggcttcaaaaatataacataggttcatcctgataagtctaatgtataatagagatctttataaaatatatgtcaactgcatcagagttgtcattggagttccaacttcggaactggaattacatttattcacacagtagaattgaaatactaatttagcttattgattgttaacattttgtgcagctaaaaaatggctgatagtgatcggttcagtgatttactatggatgcctcatgggcagcacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctcaacaaaatattagtttctatcaaattgcaaagatgaggagtatcaaaattgacaaatatttgatatctgctttggtagaacgttggcggcctgagacaaatagctttcatctaccgataggggagatgacaattactttgcaagatatcagttgcctttggggtttgccaatcagtggaaaactaattgtgggccaatctgatggaaattggaggatatgattgagaggtatcttgggattccaccagaagatcaagaaataaagaagaaaaagaggaaaaaggaagatgatacatttgcactgagttactcacgatactccataactctgagcaaattgcgtgatcactttcgtgtcatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttgtacaggcagttgaacaatggtgctgagaaggcaagatcaaaaatttttggccctctagtattgttacaattgtggtcatggtcacggttgccattaggtcgtccaaaaaatataattcaaaagacggatgaagtggaggagcaagaagaagaagaatcagatggctatcctatatttggggccaaatggtgtagttatcatgaattccccaccccacataattgtggtaatgttttacatatcttttgaattatgtctcattgtatattcttataacaaacaacatatatgtcaacatgcttatctttttatactaatattatacaggcactcaatactaccgaaaccaaattgacttgattcgagaaggtactgtacaatggcaaccatatgaaggtctcatagagcagatgcctatccaaattcagaatgaccgtacttggtggtttgctagactacctctcatccatttttgggttgtagagttccattatccagaaagggtaatgagacagtttggaagaaaacaattaattccaccatcgcctccacatggtgaggttgagcttcggaagctacgcaaagtgaagcatgtaggaggaaaagtgtgcgattggaataaattccatgccaaatatgtgcaacaatatgatgggattgaagcaacaatcgttcaagaggattgtcctttcgacgtagctagcttaaaggagtatagatgttggttccaagcaaatggtatgttcactatgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtataactaatggatgcaagaagataggtaaatctatattgatcacatgtcaggggaatattagggatcttaacttggaatacaaattgcaaaacatgttatctgaggctggactaccaattaaggttgaagaaattccatctgatgacgatggcactactgcttgcacgccaagtcctccaaatgaaagttccgttgatatatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccattgcatcctggtgaaagaacgtcaagtcattcagaaagttctatccaagtggttgattggactagtactgagaggactcctatgttcaaaaagaacactccaagttaggaagaccatatattctgttggatataattttgtagaacttttggagctatatgttctaaatatatgttaactagaaatcagccactccaagttaggaagaccatatattcctgttgacatatatgttcttttcgaccactgtcttatatgggtgctatactatgtaaaatatggtcatgctgtcagtggttgaatggcgtgttactttactttgtactgacttactatattaatggatttttatgttgccaacttacatcccatttgaatgagcgcatgctatttacttcagtttattgccacgatatgtgtgtgttgtagggaacaaatccctgtttaaacatgtgctcagatacatcctacaaatagcagtacagcagcaattctgttgtgtaaatcaaatcatatgaaaaattgataaggtaattcaaattgaactgtctgtactctcaaataaatacttcaaaaacaacgttcgttgagctccattcatgttcaaagccaaccagaagaatgtcctattcctggacaactataagctaaattgacactgtaatttatagatagactacacgatgcgtaaaactatatggtgccagagggtccatcaacatgtgttctgctcgacgttgcacctacaaaacaatcaaagagagtcatatatcaagtaaaagttaactaaccattataatgcatataattcccattgtttgctacctaaattgtcactatctcttgtggaacggtgtgcctggtgtccaagtcgtcttccttgcatttcatccatgtacattggtatcctgtt

SEQ ID NO: 26744 - DNA, 6443 bp, Oryza sativa
aacaaaccattctaagcactttgaaaatgtttcctccacaatggctgccaccggtaacctccgagaaaacttaaacacattgttcaatgactcagatccattgcttgtcatgattccccaacgatatcctccatccttgcattgaaataccttctcgagcttttcttgctcatctttatcttcatgcaagtactttccaacatttttaatatatgttattgcctcaggacaaatatttgcaattgatcacattccttcatcaaattttctaggtttctttttcttcactgtccacttaaatgtcttgagcattatttcattgcgacaaaatttccatagattctcagctacatgctgtgagcaaaggcggtgcacacattcaccggcgctctcattccatccaatgtggggctgcttaaacaaccatttcatggctttatgtcgatcagatataacacacataaactttccatagcctattacctcacttcgtagccatctcataaaccacccctagtttgcactatcttccttctccacaatagcaaatgcaagagatagtagttgattgttagcatcatatccacaagcaatcaacaatctatccttgtacctccctgacaaaaagcatgcatcaacacttataactggccgtaggtagggaatgacatcgatacaaggtccaaatgcccaagcaacacttttaaatgctcgccgtccttcctgagtcattggctttgacaaaaggacatactttgtacctaggtttttagcttttatagcctgtaagaaagggatgaggaggccatatgaaccttcccaactaccaaaaagttgtgctattgccttctctctgcctcgccataatttactataagatggcttcacatttctatatctctgttggactagtgacctcacattttttatactcaattccagatcatcccttaatgcatcacgtatcacattagcaatcatagaagatgataactgagcatgatcaaatctatcagccggtgctcaacaggtgtgagcatatggacatttccttatcatccaacctgaacctatctttgtgggagttgcatagagcctccacatgcagctattatccgtgcattcagctacaagtttagattgactacttgtgttgtacttgatttctgaatttttacatatatgaaactcacctatagcaatttgtaggtgcttttttgaatcaaaagactttccttctgctagtgggttagaaaattgattcttacgtccaaagaaactctcgtctgctgttgtctccctcaatatagatatatcactaaatgcttttataggattttgtccagatgcacgcataaaaggaaatgcattgacagaatgaacaactcgtggttctggtggctcatcatctaaactattatcaagggcaccatcacaatcctgctcgttgtcatcgtccagtccaaatctatcctcaccaacatatgtgtcttctgcagtattgtcatcatctatagttggttgtgttttggaaaccacattatcctggttgataggttatcctggttgataggtgaagacaactgaactgttgttgaatgcagaccatctactaaagtgggtacaacctttgcttgtgaatgaactgtacctggctccaacaaaacacctgagccatccctttccgaatgcctagttgatgcaaccaaggttgtactattaacctgacttaatcttgcttccgtataggcgcatcaacataaagctcacaacctacccacatgtcttctcaaatatcatcctccatcccctgtcttcataaataggaatcaattgaaaatattgtggtccaggatttccgatatcaaaccgagcttggatattcattgcacaatgatcctcagtgtatccaagggcctgaaaaatttcttttttgacttcctcaaaggttgtagcctccactgccggaaaagttatttttggaggaatattatattctgcacccttagctccatattgtattctcccatcaacatacactagaacaataatcattttttctcagtcaaatctgcaaaacaaactaaacaagttagcaaaacaagttatataattaactttaagttagataataatctgctgatatatcctttcaagttttaaaaaatgttgttttgcatattaaaaatgtcaatgaacaatagtcattttatttcctggctgtgtcttccaaacgaactcaacaattaacaaaggcatggtatatgtctactagttggataataatctatacatatattcaataaaacactcatgtcatatatcaagtatagatatgaacaatgtagtacatatcaattaatgctaattagatgagggtgagcaaagacatgctataagtgaaaagacatgcatgcgtgatataaattgcagggcaaacctgttgctcacgacgagagagctgccaatgcacacggcgccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctcccccattgccgcccctttctcttcctccttccttccacctcaccccaaccccaaccccaaccctggccccgtcccgcgcgtacggaggaggggcccatgcatgcatgcgggtgaggtgacaaggacgcggccacggggatcaccggcgcaccgaccgggatgttgaaggtgaggtggttgccgttcaagaagacccatctcgcccgcagcaacgcctccgacgcgtcctcccccacctccgccgccgccgccaccgccaccgccgtcaccacccaccgcctctaccaagtctggaggggcaggaacgtacgttttcaaaaacgaattcggacaaaattcgtgcgtttccacattaaaaggagcccatatattttgttgttgttgttgtgtgtagagattcctgtgcggcgggcggctcatcttcggcccggacgccagctccatcgtgctcaccgtgtcgctcatcatgacgccgctcgcgctctttgtcgccttcgtctccttccacctcgccgccctcatcgggaagccgctcggccaggccgtcccggccgtcgccatcgccgtcggcgtattcgtaagcccggccaccaccatttctgcgtcgctcgagcaaaatgaagcaattgaccgatcactttgcgtgcatgcgtgcgtgaaggacgtgatcgtgctggtgatgacgtcggggcgggacccggggatcatcccgcggaacgtgcggccgccggagcccgaggacatcggcgtgtcgtcgccggcgttcggcggcggcgggtcgctcccgccgacgcgcgacgtgtacgtgaacggcgtggtggtgaaggtgaaatactgccacacctgcctcctctaccgcccccctcgctgctcccactgctccgtctgcaacaactgcgtcgatcgcttcgaccaccactgcccctgggtcggccagtgcatcggcaaggtaggccgtcttctccgtctccggcggcgaccatctccgacgtgctgaccaactgttcgatccattgcctcgcagaggaactacaggttcttcttcatgttcatctcgtcgacgacgttcctgtgcctgtacgtgttcgtcttctgctgggtgaacctggcgatgaccgcgaggcagttcggctgcagcatggggcgcgcggtggtggagtcgccggtgtcggggatcctcatcgtgtacacgttcgtgacggcgtggttcgtcggcggcctcaccgcgttccactcctacctcgtctgcaccaaccagaccacgtacgagaacttccgctacaggtaccaatgttttaaatagcgggctaaaacatttagcggttacttcttaaacagctatagcaggctaaattgagctatagcggctaatttgtactctctccgtattttaatgtatgatgccattgactttttgataaacgcttaatctttcgttttattaaaaaaaattatgtaattataatttattttattgtgacttaatttatcatcaaatattctttaagcataacataagtattttttatttgcataaaatttttgaataagttgagtggctaaacgttggttaaaaaatcaacggcgtcatatattaaaatatggagggagtacacgagagcaaatagctcgaatccttctcaaacagttatagcgggagataagcagcagtttagcgagagattttaaaccttgacaggtacgagcggaaggcgaacccgcacaaccgcggcgtcgccaagaacgtcgccgagatcttcctctcgccgatcccgccgagccggaacgacttccggtcaagggtcgccgtcgagcactactacgccgccggcgccggggcggcgtcggggcagtacttctactcctactcgatcgggccgctctcgtcggagtccaaggcggccagcttcaacacgcgggggagcctcagcttcgacatggccacggcgagcttcgacctcggcggcgtcggcgtcggcggcggcgtcggaggatactccgccaagcgcaccagcgtcgacgtctgctccaactcctccgacttcggcgacatctacggcggcgagcagcagccgccgcggcactccatcttcggcggcgacggcggaggagggaggacgagcgtcaggaaggccgacgacgtcccgacggagttcgggcactacggcgccgccgctgccgccgccgccggcggcggcggcggccggcctcgcgggagggagttcgaggccgtgtgacgtcgccgccgccgtcgtctccaagtgcgttggcgccattttcttgggagctcgacgatgcaacgcagctaattaatcgatcaattaatgtagcgaatttttctctgtttttttttggtgatcttgtgcttccgctgctcgtgtgttgtgtagtagctttggttgatcagcttcctcatgcttgctaatggagtagtggtttccatagcattctagtactacttgcttaacttgatttagtgaaggtgatgtatacacacacaaatgcacacacacatgggtttaattttgtgtaattaggactgtgcatatatataaacggtgttcatgagttatccaaacattatcttttggcatgtactatgtttcatattataagtcgttttgacttttgtcaaattcaaattattttaaatttaacttaagtttgtagataaatatagaaatatttacaacacttaattagttccgttaaattgaaataaatcaatagttgaatatatttttataatatatttatcttagattgaaaatgttactttttctataaatttgatcgaatttgaagtagtttgactttgacaaaagtcaaaacgacttataatctgaaatggaggaagtaatgtttctttagaatacaagaatttggcctttctacatctgattcctataaaaaaaatcctacaaaatacataaaaaattatgtgtaatgaggcgttgtggatggatggaagaaaatgagaacaaagaaggtgttgcctgacaaaaaaaattattcaactgtttcagtgggagagagaaatgagacattatgagtatgtcagctcctaagaacataattttgacacttctgttgacctaattagttggtagagatacataatcctgctatgccacttcaacttacatttaatctttttacatatcatgaaagaacatatagccaaaacaaggaacagcatgaacccagaaagttgcttcgctggattatgggctaaaatgaacaactaagagagttgctgcttgttgccttcacaatttggtat

SEQ ID NO: 26745 - DNA, 1693 bp, Oryza sativa
attgtagtgcacctacaatttcatactgatcatgatcaaccttgtaacagaaggaagcagagtgctactatctttagagcaccttgatgcaatgcgtgcagatccatcagcagcaaaacttgggaacctattagtcctcttgtattccggctattttacctgcggacttgtaagggagatggttaaaagcacccattcaatatggccaagacaatagtataacatatatatatgcatgtctaaaatattctcggcagtttttatgtggttctatgtattcataaaatgattggatagaaatacttaggtaggcatttcttgactgcactccaaagaaattaatccatctgtctatgaagattaaacttaccatattacgagaaaacaatcaggtaatctatatttttgaaaaataaatcccaacacccaatgaacaaagtatgttgcttaactccagtagccatgcagcatttcttgttacttgagctaatgcaactatgcaagctgtaaatttagacactgtggcttgcttggcttctctcctcccccgaaggctttctcagtttcttaggcaacaatggtgtacatcaaacctccatgagatagccttcaagggagagagagatccaagaaaaccgtgccgtttaacatcactttgaatgtagtaagtagaagtactaaccaatgcttttgcagacacatgaatttgtatctgcaaagcacatggagtggaatgactggaatataagtttgtggcagtatatatagtgtccacaaagctactatacatacataaaacaaatgagaccaaactaaaagggacaacagaatcctgcactaaataaaggggagataattgtattgtggagtgataatgtaattaatgaagaatcgactcaactgcctagaaagcagaaagagatacaaggccatgaggataggagagctttgcctccattagttctagaaaacttacatttagtacaatggcacctttccttcatgatcttttggacaatggtatctgactatgccgaacaattggtccaactcatggttacaattgattcccacccttaacacataacagcagtgccaattaacaaatatcatctataaagaggttagaagacaacgtacatgtcaccacaggttcttaatgttgagtgaaatactagctaatcttatggtgatacaacattagaaaaaagtctatttaatactccctccgtttcaggttataagacgttttgactttggtcaaaatcaaactactttaagtttgaccaagtttgtagaaaaaagtagtaacattttcaacccaagaaaaatttattatgaaaatatattcgattattgatttgatgaaactaatttagtattatgaatattactacatttgtctataaacttagttaaatttgaaacagtttgactttgaccaaagtcaaaacgtcttgtaacctgaaaccagtggcggaactgagggggggctggcaggggccatggcccctcccaataaaaacaatttttttattacccccatatatcatagcagattcagtgaacaagcaatagagcttctcaatttgtgtacgtctttggatccaagtgattcattcagttcattcaacattgataaagtgtgctctctagcttcaaagttctatcctgctgattttttagaacaaga

SEQ ID NO: 26746 - DNA, 2883 bp, Oryza sativa
atgaaaaaaaagagaaattgctaattttttgaactgtcaaaagccggctggcccccctttgattttctgtccagctccgccactgcctgaaacggagggagtatcaaattgcttaggatagatgtcctccaaaatttagaaaagccataaaagaagcttgttaatggtcagactgaaatgttcagtacaagtagctatatgtatatagttctcaccagtcaccatacagaaaattctaagagacttgtgtacagatcatacacaggtgacactgttctaaaccaacaagttttgatcatattgtcagcaaaagtctaaccacaataccacaaacactcaccaagccgcattcagctgcagaagaactggatattctcatataacattgacaacggaatctgggagatcaatcgatcatcacattacaggtacaagtgaccctttggacactagagaagccaaaggcttgtccaccaatacaaagtagcactaagtaataggtccctaaagtgttagatttggaagataattggtaccataagtggttactcgtcagtgtcagacagtcgatcagtatgttccaggggtttcttttgctgcccaccgtatctctgaaaagtttatagcagatcaactgcagctaagaaaaggaaaaattccagctctataacctaggaaagaattagaaaaggccccaccactaacaggttttacttcatttctccaccaggtaaaagtgattgcacataactaaaaagttagaatgaaaaagaatgcatgaatggattttacaattctaaacagagagagtatatgatccagttatgtcatagaaatactgcagaaaagaaagagtcaactctacaaacaaatggaactctattccaaaaagaaggaataatttctttaggcaaaagtcacccagataaattctaggagaaagaatattatcatctgcagccagtatgaaggtttaaagaagagaatcaaataaaaatgaaccaaagatgcatgtagacaagtctagtctagaagaaacattcgcttgcattagttaaggtgtaaggtttgcagagaatcaaactgaatatggttcttgtcaatgctctaatgaattaattccacttagttggatcaccattttcttctcttttcaattctatatgagtatcataaaggtattgctgtcaagttaggaattaggcattaggcaaattgcctggataatgaataatcctcttgttcaaaaccattttaagtttctcttcttccagtcagtacaatagcctatattttgtagcacttgagttatgaaatgtaatatgtacaaacacctagtatcatcatggggccaccggcaaagttatttctcacttttgtagaaaatattccatccaagggtaaatccatgcaactgagtttcatccatatccacgatgtgacacattgtgtgtattggaccatagacccacatgacagtgagacatcattggcgcatcgtacacattggattaagaatctttcaaatcccaaatgatgaatctttggtaagtccgaatcacccaaaaacagatgcaaatataggtttaaaaaatgtctaaaggaattaaatggaggccccatattcaccagagatcgagaactggtatgcaattttttgcaaattacaacacgtatacacaaaatatatatatatcagaacctcaagaagattccatgaaatgaatatcaagcagtatggaagtaggagagcgataacgcagctcatatttggtttagcacaactaacagcatgcaatcatgatgaagttttacatctgtaacaaagactactgtcttaatgataaagagttgtgcctgcatgcaacagctgaatgcgcatgtgtatgaagttttattaaggaaatgggatgaatgtcggaaggttcgaagcaaagcacagattttaaacgaaatgtgaggacaattcgaaactgcaggtgatcccaatccggaatagttctttgggttttgcatgcttgcagccaagggggccaatagaaaagaaatactgcatagcagtaaattcaccatgatagagtatataaagctaccacaatagcataatgtgaacaaactacaaaactatgagatcattgaatgagttacaacaagtggcctatcctacatttggatccattgactgattcaataagataaaggttaccacagtgttcatcccaaaacccccataggccatacggctaaatatttcaggggatcagcatgtgaacatatcacattacttgagaatgatcaaaatgtacctacttaatcaagcacaattgaagcaacacaatcttattcctgcgcaatgctcttgccgacgacgcccttcatcggcaaatgttccatctccgcctcggcagacgccaccgtgggcattgcatcgtacgacccaccgacgccattatgcctcctccctgtccccatccccgccccggcgccgccgtccaccccgcaccaccaagccaccccgaggtgcactcccacggccaccgccgcgacgaccacgcagtgcacggacagcgcgaggtccatgagcgccacggcgcggagcctggcctcctcgacgtcgcaccgcgtggcgggcgtggccacggcggcgtccatgaggcggtggcacccggcggggacgcaggcgtcgacgtagaggacgaggccgctctgccccacccagaggccacccacggcgccggcgcaggcgagcgcggtctcggcgaggagcccgcggttcgggggggagatcgcggcgagcagcgaggcgacggccgcggcgaggaggagggccgcggcgacgtggagcgcgtgggactggaggtcggaaggcgggaaggaggcggc
